United States Patent 8,344,211 (PLANT NUCLEOTIDE SEQUENCES AND CORRESPONDING POLYPEPTIDES) - sequence listing, part 6

SEQ ID NO: 22462 - DNA, 736 bp, Zea mays
  misc_feature: Ceres CLONE 1392248-F
  misc_feature: Encodes the peptide sequence at SEQ ID NO. 22463
  misc_feature (454)..(454): n is a, c, t, g, unknown, or other
aagctggagctccccgcggtggcggccgctctagaactagtggatcccccgggctgcaggaattcgcacgagaccattacctagaacatcctaatcgaaaatctaaatccataatacaggagctgggagcaaagctgcagtcaagggaaaaggcagttgatgaactatcaacaaaagttaagatgctcgaggatttgtgccatgcacaactttctcagccagaacctagtaaagacagatcatttgaagcatcttcctcaacaattgggtcagatatatctgatattgaagatgcaggaccagtgggcaagacaacatcagtttcatctgtttctacagctgcacatgctagaacaatgcggaaggggtcagcggatcatcttgttgtcaacattggttcagagtcagaacgattgattgctgcacaagattcagatgacaaggggcgtataanatcgctccatacatctggcttcattccagctcagggaaagcacatcgctgatagggtcgatgccttctgggtctcggggagccaaattctgatgaacccggcacgagcaaggctagggcttatgttgtactggctggctgtgcacctatggttgctgggcagcatcttgtgacaccgcttctcaatacaagacccatctcatagcataatggtacatagcacgtattagcagtttcttcctccattctacaatacatggaagatgttagaaataacattttt

SEQ ID NO: 22463 - protein, 207 aa, Zea mays
  misc_feature: Ceres CLONE 1392248-F
  misc_feature (151)..(151): Xaa is any aa, unknown, or other
AGAPRGGGRSRTSGSPGLQEFARDHYLEHPNRKSKSIIQELGAKLQSREKAVDELSTKVKMLEDLCHAQLSQPEPSKDRSFEASSSTIGSDISDIEDAGPVGKTTSVSSVSTAAHARTMRKGSADHLVVNIGSESERLIAAQDSDDKGRIXSLHTSGFIPAQGKHIADRVDAFWVSGSQILMNPARARLGLMLYWLAVHLWLLGSIL

SEQ ID NO: 22464 - DNA, 714 bp, Zea mays
  misc_feature: Ceres CLONE 1392252-F
ccccgcggtggcggccggtctagaactagtggatccccccggctgcaggaattcgcacgagaccattacctagaacatcctaatcgaaaaatagccggatcccttctttcattccccttcgccgcctcctctctgctgccgcgcgcgtgcgaataggggcagacaaatgctatctacctctctagattaatccatacccctgctcctgccttcgtgcggtagtcactggcccctcgatacgcacgacgaggcgttcatgctccttctccatcccacgtgcgcgcagcccaagggccggatctgcgtccttcgtcagatctcacctggcgccgtgagacatacacgcgaagtggccgtatgagcggtgctccggaggaagatgtttagcgagacacagaagacttgccagttgtgcaccaagacggtgcactctcatggaccatctcatccaccgacggggttcctcttccaccggtcctagcttcaccagccatgacaggagagctaccctcgcaatgaccaactattcctgtgccaaaggagtgccgtactggataatccatttccgagcagctgatcaagaacacggtgagttacaacaagagcttccaatcacagccacctgtaaagatcacgccccgaaaagatgaccccgaaactgaacaagagcacaagcaagactgtcagcgatgcttacaccagcacgagaagagg

SEQ ID NO: 22465 - DNA, 732 bp, Zea mays
  misc_feature: Ceres CLONE 1392256-F
  misc_feature: Encodes the peptide sequence at SEQ ID NO. 22466
  misc_feature (629)..(629): n is a, c, t, g, unknown, or other
  misc_feature (655)..(655): n is a, c, t, g, unknown, or other
aagctggagctcaccgcggtggcggccgctctagtaatagtggatcccccgggctgcaggaattcgcacgagaccattacctagaacatcctaatcgaaaactccccattgtttccatccgcaccggagggcggtccgatacaagcaacggcaacgcctcccctctcctccacctccccacctatattgattctgattcatccacccagcaggcagcagctacagcaagatggtgcacccgatcgcggaggccgacgagcggagccccttcggccgcctgacgccggacgagttctacgcgcgccacggcgtgacccactccgcctcgtccttcgtcaacccgcgggggctccgcatcttcacccagcgctgggtgcccagtggggacgcccccgtcctgggcgccgtcgccgtcgtgcacggcttcaccggagagtctagctggacaatccagctcaccgccgtccacctcgccgccgcgggcttcgccgtcgccgcgctcgaccaccagggccacggcttctccgaggggcctcagggccacctccccgacatcaaccccgtgctcgacgactgcgacgccgccttcgcgccctttccgcgcgactaacccgccgcgctccctggtnccttctacggggagtcgctcggcggncgcatcgcgctgctgctccactgcgaacaaggaactgtggcgggaagggggcgtggtcaacgcgccaggtgcggggt

SEQ ID NO: 22466 - protein, 126 aa, Zea mays
  misc_feature: Ceres CLONE 1392256-F
MVHPIAEADERSPFGRLTPDEFYARHGVTHSASSFVNPRGLRIFTQRWVPSGDAPVLGAVAVVHGFTGESSWTIQLTAVHLAAAGFAVAALDHQGHGFSEGPQGHLPDINPVLDDCDAAFAPFPRD

SEQ ID NO: 22467 - DNA, 741 bp, Zea mays
  misc_feature: Ceres CLONE 1392258-F
  misc_feature: Encodes the peptide sequence at SEQ ID NO. 22468
  misc_feature (290)..(290): n is a, c, t, g, unknown, or other
  misc_feature (409)..(409): n is a, c, t, g, unknown, or other
aagctggagctccccgcggtggcggccgctctataatagtggatcccccgggctgcaggaattcgcacgagaccattacctagaacatcctaatcgaaaaattttttttgtttggttgttcctctcgctcgccagtcgccaccaggcagcaggcatcccaatctcgcgagagccagtagcggcggcggcgcttccggcttcccttcccattggcctccgggatggcgctccgcctccacgacgtcgcgctctgcctctccccgccgctcgccgcccgccgccgcagcggnggcagtttcgtcgccgtcgcctccatgacgtccgccgccgtctccaccagggtggagaacaagaagccatttgctcctccgagggaggtacatggtcagggtacacattcaatgccatnctcacagattgaaattttcaagtcacttgatgatggggctagagataatatcttgacacatcctcagccagtcgagaagtgttggcagccacaggattccctccctgacccagcatctgaagatttcatggaggaagtaaggagctcaaaaaaccgggcaaggaaaaccccggagaataatttgggttgttgggggggaaacggattacggaggaagtcccaccaaaaccagaatagggtttaacccccccgagggggaaaaaaatagaaaaggggcaaaccccctttgtttggtttgtttgcaaagggcatggcacggtgaaaaaaaaaac

SEQ ID NO: 22468 - protein, 143 aa, Zea mays
  misc_feature: Ceres CLONE 1392258-F
  misc_feature: SWISSPROT Homolog: EC 1.14.19.2 Acyl-[acyl-carrier-protein] desaturase
  misc_feature (63)..(63): Xaa is any aa, unknown, or other
MALRLHDVALCLSPPLAARRRSGGSFVAVASMTSAAVSTRVENKKPFAPPREVHGQGTHSMPXSQIEIFKSLDDGARDNILTHPQPVEKCWQPQDSLPDPASEDFMEEVRSSKNRARKTPENNLGCWGGNGLRRKSHQNQNRV

SEQ ID NO: 22469 - DNA, 741 bp, Zea mays
  misc_feature: Ceres CLONE 1392261-F
  misc_feature: Encodes the peptide sequence at SEQ ID NO. 22470
  misc_feature (386)..(386): n is a, c, t, g, unknown, or other
  misc_feature (581)..(581): n is a, c, t, g, unknown, or other
  misc_feature (599)..(599): n is a, c, t, g, unknown, or other
  misc_feature (605)..(605): n is a, c, t, g, unknown, or other
  misc_feature (655)..(655): n is a, c, t, g, unknown, or other
  misc_feature (741)..(741): n is a, c, t, g, unknown, or other
aaagtggagctccccgcggtggcggccgctctagaactagtggatcccccgggctgcaggaattcgcacgagaccattacctagaacatcctaatcgaaaatcgtttgaccttcgtctgtcgtctcgtctcgtccacctccccagcggcgcgtgaagcttgaggcaatccccgccctctctagccctgcgcaaccagttcggttccatggccaacagcaatctcccgcgccgaatcatcaaggagacgcagcggcttctcagcgaaccagcaccggggattagcgcgtcgccgtcggaggagaatatgcggtacttcaatgtcatgatccttggccccgcgcagtcaccctatgaaggtggagttttcaagcttgaactattcttngctgaggaatatccaatggctgccccaaaaagtagatttctcacaaaaatttaccatcctaatattgacaagcttggtaggatatgcctcgacattcttaaggacaaatggagtccagctcttcagatacgtacagttctactgagcattcaggcacttctgagcgccccaacccagatgatcctctctcagacnacattgcgaaacactggnaatccnacgaagctgaaagctgtgagacagcgaaggagtggactcgcctgtacacnagtgggcatgacagccaagtgtttgtccagatgtaacacacttccataggttggggtcgattgaacacccctcttgcttgtgtgcn

SEQ ID NO: 22470 - protein, 165 aa, Zea mays
  misc_feature: Ceres CLONE 1392261-F
  misc_feature (9)..(143): Pfam Name: UQ_con Pfam Description: Ubiquitin-conjugating enzyme
  misc_feature: SWISSPROT Homolog: EC 6.3.2.19 Ubiquitin--protein ligase
  misc_feature (60)..(60): Xaa is any aa, unknown, or other
  misc_feature (150)..(150): Xaa is any aa, unknown, or other
MANSNLPRRIIKETQRLLSEPAPGISASPSEENMRYFNVMILGPAQSPYEGGVFKLELFXAEEYPMAAPKSRFLTKIYHPNIDKLGRICLDILKDKWSPALQIRTVLLSIQALLSAPTQMILSQTTLRNTGNPTKLKAVRQRRSGLACTXVGMTAKCLSRCNTLP

SEQ ID NO: 22471 - DNA, 618 bp, Zea mays
  misc_feature: Ceres CLONE 1392264-F
  misc_feature: Encodes the peptide sequence at SEQ ID NO. 22472
  misc_feature (113)..(113): n is a, c, t, g, unknown, or other
  misc_feature (323)..(323): n is a, c, t, g, unknown, or other
  misc_feature (349)..(349): n is a, c, t, g, unknown, or other
  misc_feature (381)..(381): n is a, c, t, g, unknown, or other
aaagtggagctccccgcggtggcggccgctctagaactagtggatcccccgggctgcaggaattcgcacgagaccattacctagaacatcctaatcgaaaaaaccatattatntgagaccaacaagcaacatagaaagtggaatccagtagcaacaacagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagcntcttcagccctataggctccacaagncatcgcagcaagcacataccttatcaccctgntgtttcacaaatcgcagccctatcttggtgcagcattgtacaaccatcaggcacagcagctgcagcaactcgtgctacctggggaacaaaccaaggaggttcggggaaaaccttttcccctaaattctaagaaaaaaaaaaattttttccattaaacaaaggggtaacctggaacccggggtgtatttttgggaaaaaaaaatttaccattttccccccgtttggtttggggtaatc

SEQ ID NO: 22472 - protein, 56 aa, Zea mays
  misc_feature: Ceres CLONE 1392264-F
MATKIFSLLMLLALSACVANATIFPQCSQAPIASLLPPYLPSMIASVCENPASSAL

SEQ ID NO: 22473 - DNA, 725 bp, Zea mays
  misc_feature: Ceres CLONE 1392265-F
  misc_feature: Encodes the peptide sequence at SEQ ID NO. 22474
  misc_feature (602)..(602): n is a, c, t, g, unknown, or other
aagctggagctccccgcggtggcggccgctctattaatagtggatcccccgggctgcaggaattcgcacgagaccattacctagaacatccaatcgaaaaaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcagggaacctgctggcgtggcagcaccccgatcctgggccagtgcgtcgagctcctggagcatcagtgcagcccgaacgcgacgccctactgctcngctcagttgcagtcgttgcggcagcagtgttgccagcagctcaggcaggtgaagccgcagcaccggtacaagcgatcttcggtttggcctccagttcatctgcaaaagcagccgaaagggtcc

SEQ ID NO: 22474 - protein, 186 aa, Zea mays
  misc_feature: Ceres CLONE 1392265-F
MRVLLVALALLALAASATSTHTSGGCGCQPPPPVHLPPPVHLPPPVHLPPPVHLPPPVHLPPPVHLPPPVHVPPPVHLPPPPCHYPTQPPRPQPHPQPHPCPCQQPHPSPCQLQGTCWRGSTPILGQCVELLEHQCSPNATPYCSAQLQSLRQQCCQQLRQVKPQHRYKRSSVWPPVHLQKQPKGS

SEQ ID NO: 22475 - DNA, 734 bp, Zea mays
  misc_feature: Ceres CLONE 1392267-F
  misc_feature: Encodes the peptide sequence at SEQ ID NO. 22476
  misc_feature (553)..(553): n is a, c, t, g, unknown, or other
  misc_feature (619)..(619): n is a, c, t, g, unknown, or other
  misc_feature (715)..(715): n is a, c, t, g, unknown, or other
  misc_feature (718)..(718): n is a, c, t, g, unknown, or other
  misc_feature (719)..(719): n is a, c, t, g, unknown, or other
aagctggagctccccgcggtggcggccgctctataactagtggatcccccgggctgcaggaattcgcacgagaccattacctagaacatcctaatcgaaaaatgtctgaggattgggatctcttcgccgttgtccgaagctgcagctcttctgtttccacggctactataaacaccaactctcgtggtggtgacgagggaagagcgaactgcaagcaacacgatcttcctcctctgttccaacacatccatggagacataagcagagagtcttcttcttgcaacgagctacaagattcttgcaaaccctttttacccgttacaactacttggtcttctcctcttcctcctcctcctgtagtttcatcagctcctaatatcttaatgaaacaagaacaagggctcatcgaatcacaagatcagaaacctcctcttggtgttagggttttcccgcctcccacaaccatttcttcttcctcttctgtctttgttttcagaggtcaacgtgaccaccttcttcaacaacaaccccaagctcctcttcgatctagaanaagaaaaaatcagcaaaagagaaccatatgtcatgtaactcaagaaaatctctcttcggatatgtnggcatggcgtaaatacggtcaaaaaccaatcagaggctctcctttatcaaggaaatattacagatgcagtagctcaaaagggatgttagctcgaangcnnagtgagagaagcatt

SEQ ID NO: 22476 - protein, 211 aa, Zea mays
  misc_feature: Ceres CLONE 1392267-F
  misc_feature (169)..(211): Pfam Name: WRKY Pfam Description: WRKY DNA -binding domain
  misc_feature: The sequence is a functional homolog of SEQ ID NO 239 in the 11/479,226 US patent application
  misc_feature: The sequence is a functional homolog of SEQ ID NO 26 in the 10/374,780 US patent application
  misc_feature: The sequence is a functional homolog of SEQ ID NO 76 in the 10/225,068 US patent application
  misc_feature: The sequence is a functional homolog of SEQ ID NO 98 in the 10/412,699 US patent application
  misc_feature (151)..(151): Xaa is any aa, unknown, or other
  misc_feature (173)..(173): Xaa is any aa, unknown, or other
  misc_feature (205)..(205): Xaa is any aa, unknown, or other
  misc_feature (206)..(206): Xaa is any aa, unknown, or other
MSEDWDLFAVVRSCSSSVSTATINTNSRGGDEGRANCKQHDLPPLFQHIHGDISRESSSCNELQDSCKPFLPVTTTWSSPLPPPPVVSSAPNILMKQEQGLIESQDQKPPLGVRVFPPPTTISSSSSVFVFRGQRDHLLQQQPQAPLRSRXRKNQQKRTICHVTQENLSSDMXAWRKYGQKPIRGSPLSRKYYRCSSSKGMLARXXSERSI

SEQ ID NO: 22477 - DNA, 707 bp, Zea mays
  misc_feature: Ceres CLONE 1392271-F
  misc_feature: Encodes the peptide sequence at SEQ ID NO. 22478
  misc_feature (419)..(419): n is a, c, t, g, unknown, or other
  misc_feature (624)..(624): n is a, c, t, g, unknown, or other
  misc_feature (707)..(707): n is a, c, t, g, unknown, or other
aagctggagctccccgcggtggcggccgctctagaactagtggatcccccgggctgcaggaattcgcacgagaccattacctagaacatcctaatcgaaaagtcctcgtgcccatctctgtcccaatcaaactgattgatccgtcgcccgcagggccacagcagccgcggcgaggtcgtccgtcggattcggaggctcagttattactgaaaagataatacagtacctatggcttctctggacgccgtgcgaggagacctcgccctgctgattctgtacctgaacaaggccgaggcgcgggacaagatctgccgagcgatccagtacgggtccaagttcatcagcaaacgggagccagggcctgcgcagaacgtcgacaagtccacagcctggcccggaaagtgtcccggctctgtaangtcgtcaacgacctgcacgctttgatcagcccctcctgccagggggactccgctcccgctgatcctactcgggaagtccaagaacgcgatggtgtcgactttcctctttcctggacagatcgtgtggggcgggaggaccaggatataccagaacagggagcgggcggagtttctcgggaggataagggtctactgcttcctcggntcaacacctggacggccatcatcgagttaagcgaattgcaacggttgtccacgtcaatgaaaaaactggaaaagagctgaacn

SEQ ID NO: 22478 - protein, 71 aa, Zea mays
  misc_feature: Ceres CLONE 1392271-F
  misc_feature (64)..(64): Xaa is any aa, unknown, or other
MASLDAVRGDLALLILYLNKAEARDKICRAIQYGSKFISKREPGPAQNVDKSTAWPGKCPGSVXSSTTCTL

SEQ ID NO: 22479 - DNA, 734 bp, Zea mays
  misc_feature: Ceres CLONE 1392272-F
  misc_feature: Encodes the peptide sequence at SEQ ID NO. 22480
  misc_feature (267)..(267): n is a, c, t, g, unknown, or other
  misc_feature (366)..(366): n is a, c, t, g, unknown, or other
  misc_feature (393)..(393): n is a, c, t, g, unknown, or other
  misc_feature (468)..(468): n is a, c, t, g, unknown, or other
aagctggagctccccgcggtggcggccgctctagaactagtggatcccccgggctgcaggaattcgcacgagaccattacctagaacatcctaatcgaaaagccagaagcatccaagtcgttggcgggagaccgggaaatggcggaaaaagagggggcgaaggttggggcggaagagatggaagagcgggagcaggaaggggaggcggaggaggtggaggtgaagtttcgtctcttcgacggctccgacatcgggcccgtgcgctgncacgccgccacaccaccgtcgccgctctcagggatcgcgtcgtcgccgactggccaaagataaacaattatcccaaaggctgctagtgatgtaaactantaagtggagcaaaattctagaaatgancagaatgttgcacagtgcagagctccttttggtgatcttcccagtagtgctatcacgatgcacgttgttgttcanccatcatcagccaaatcaaaaccaggatagaagggcgacaaattggcccaaaccactccgtgctcatggaccatactgtgaactatatggaaggtcagtccctaccagaccaaacataatttgtacgtccacaatattctgcagagatttggagaccaagattcaagatgtccatgccattctcctgcaacgggtgggaatgcggaagacaacgcccactgttgaaacctatatggaatggaacttagggaccaagaggcgcgctg

SEQ ID NO: 22480 - protein, 63 aa, Zea mays
  misc_feature: Ceres CLONE 1392272-F
  misc_feature (43)..(43): Xaa is any aa, unknown, or other
MAEKEGAKVGAEEMEEREQEGEAEEVEVKFRLFDGSDIGPVRXHAATPPSPLSGIASSPTGQR

SEQ ID NO: 22481 - DNA, 708 bp, Zea mays
  misc_feature: Ceres CLONE 1392273-F
  misc_feature: Encodes the peptide sequence at SEQ ID NO. 22482
  misc_feature (203)..(203): n is a, c, t, g, unknown, or other
  misc_feature (204)..(204): n is a, c, t, g, unknown, or other
  misc_feature (205)..(205): n is a, c, t, g, unknown, or other
  misc_feature (237)..(237): n is a, c, t, g, unknown, or other
  misc_feature (275)..(275): n is a, c, t, g, unknown, or other
  misc_feature (276)..(276): n is a, c, t, g, unknown, or other
  misc_feature (353)..(353): n is a, c, t, g, unknown, or other
aaagctggagctcaccgcggtggcggccgctctagaactagtggatcccccgggctgcaggaattcgcacgagaccattacctagaacatcctaatcgaaaacagtcccagtcccagtcccagtcccaggacagtcccgtcagcagccacttccccggcccctcccgctcctgctcgccggaggccgggcccggcggcgatgnnncacggcgctagctggcggcgaccaagcgaggnagtagacttcttcggcgcgccgcagtccggggaatggnnccgctcgccggcgctctttcgctccgccccacttgctcagccgcaccacgctcttcgaccgccctctccgcgctcanatcgccgccgcacacggccaccctgcagggggtctccctggcattggatctttgcgtgcaccccgacgtcgttaaccgcacaagcagacgtggttgatgctcccggcgatgcacgggaagaccgactgggtccgccgggtgctcgacgccgccgcaataacgggatggtcaattcctcgaaggggggaaggtgctgcactagcaggtgactacgggcacgggaactgcctccggaccatcttctcggggggggccagtcccgcgcgggtccgaaatcccgggggttcccgcgcttcttgaaagggggggaaaaaccgaaagaaccccctttcccctccgggaaaggaaggtttgg

SEQ ID NO: 22482 - protein, 63 aa, Zea mays
  misc_feature: Ceres CLONE 1392273-F
MHGKTDWVRRVLDAAAITGWSIPRRGEGAALAGDYGHGNCLRTIFSGGASPARVRNPGGSRAS

SEQ ID NO: 22483 - DNA, 720 bp, Zea mays
  misc_feature: Ceres CLONE 1392274-F
aaagctggagctccccgcggtggcggccgctctagaactagtggatcccccgggctgcaggaattcgcacgagaccattacctagaacatcctaatcgaaaactctctgttcctctgcgattggcgctcgtgatgtggccttcctgttgctgataattcgttcattcgatgtcgctgtctgaaagtcacaaatcccactggaattcacagcactacagtttgaatcaggcgcctaaacttcatctcatctcacttgtgaaaagctgctcctctgcgtctgaagtcggttcttattactagattcgatttgaacctccgacgacgtcgaggaccgcggttcggcaacagttgctttgagatcatgatgccacaggagattgcttacttccggacactgtactattacgctcgacatgactttcacagcataggctgtcatgttaggaatacattcaaaacttatgaagacggagcctaaaatcatgattctggttcgcaggggcggcctaatctgcttcatctgagatggacctggcaacagactggaggaattcaaccaaggcaggggttgtgggactcccccagaattgggttcaaaatgcccatcagaaaggttttggagatatctaaaatcaatggggccttccccgcaaaaagagtttttgccctgttccctccggcccgggggaattttggaaaaagaatttgcgcgggggaatg

SEQ ID NO: 22484 - DNA, 732 bp, Zea mays
  misc_feature: Ceres CLONE 1392275-F
  misc_feature: Encodes the peptide sequence at SEQ ID NO. 22485
  misc_feature (458)..(458): n is a, c, t, g, unknown, or other
  misc_feature (602)..(602): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
gagctggagctccccgcggtggcggccgctctagaactagtggatcccccgggctgcaggaattcgcacgagaccattacctagaacatcctaatcgaaaagaaaggtagatattttttcccgtctcgctcaatgattcaccccatcgcagccatcgatcagaaaatttacggctcataattctcgtctgcttatccgctcccttctctccctcaacttcagcaagttccccgcaaaaccgcagccggaggtcgccggtcgccaccaccaatggggccacccgccatggcgttccaagccctcaccctcacgccactccccttctcactccacagctcgagccgccgcgtccgcgtgcttgccgttgcggccgaccagactcctccgcccgcccccccttcggagccggcgaacagccctagccgcctccttcgcgagctcgcgcagcggaagaaggncgtatcccctaagaagaagcatccgccgcgtcgcttcatcctgaagccacctctcgatgacgagcgccttacccggcggttcctcagcagcccgcagctgtcgctcaaggggctcccgctgctctcttcctgcctcccctccgngcgnnntctcacgcgaaaggacctggatggacgagtacctccctcgaggcaagcaggcgctcgggtacccgctcgcgccctcggagactctcggggaaagcgatgactgccccgcgcgtcatttcaatgg

SEQ ID NO: 22485 - protein, 34 aa, Zea mays
  misc_feature: Ceres CLONE 1392275-F
MDEYLPRGKQALGYPLAPSETLGESDDCPARHFN

SEQ ID NO: 22486 - DNA, 839 bp, Zea mays
  misc_feature: Ceres CLONE 1392276-F
  misc_feature: Encodes the peptide sequence at SEQ ID NO. 22487
taccttactactttctattcttttattttttttttgtcctctctcatactggagctccccgcggtggcggccgctctataatagtggatcccccgggctgcaggaattcgcacgagaccattacctagaaaatcctaatcaaaaaacaaccctcctcacggcgcactcgtgttcgtgtcatcccgcccgcaggccgcagtccatggccaccgccagcctcgcgctctcgctgcgcctcgcgccgtcctcgcgcccgttgagcctccgccgccggggggccaccggcgtcacctgccgcgccacaccgccacgttcaacagttcaaccccgtcccgtgaaggaaggagaatcccatgtttccggaggggggggggggaaggtccgaaacctgctgccgatcacaaggggcattctcccccaatgacgttaggcgaggggttcccgaaccgcttggcttctcaaggaaggaacaaacccgaggccccccagcttttctatttcaaagcctgggcaaaaaaaggggtcccaaaggcaaacaaatgggggggaagggtacaaccggtggccgggggccccaacactttttaaggagaggactgagggcccaacgcccaaccaaggtcaacgctccctggccaccctaacaaataaatccgagagaaggagaccctttccgggccctgatttccctgtcggttccccccgagacaattacgggagctcccgggaacaccccaaaatttggcagaacgccccccctggcgcgatttcggagagaagcgggtgtttgatttcactctaaaaagcaaagtgggtgtttctccttaaacacaaaaact

SEQ ID NO: 22487 - protein, 73 aa, Zea mays
  misc_feature: Ceres CLONE 1392276-F
MATASLALSLRLAPSSRPLSLRRRGATGVTCRATPPRSTVQPRPVKEGESHVSGGGGGKVRNLLPITRGILPQ

SEQ ID NO: 22488 - DNA, 963 bp, Zea mays
  misc_feature: Ceres CLONE 1392277-F
  misc_feature (22)..(22): n is a, c, t, g, unknown, or other
  misc_feature (25)..(25): n is a, c, t, g, unknown, or other
  misc_feature (26)..(26): n is a, c, t, g, unknown, or other
  misc_feature (963)..(963): n is a, c, t, g, unknown, or other
cccccccccccccgcggcgacnggnntaaagacgcacccccaaaatgggggtccccgcggtggcggccgctctattaatagtggatcccccgggctgcaggaattcgcacgagaccattacctagaacatcctaatcgaaaaactgatctcagatgccatcctaatcgccgaccgataggagagaactcgacctgaggagagagagagcagcaggcggcggcgcgtagtatcacgcggaggggaatgcgcagcccgtgtgagcctctcgcccccgcgaaaccccaccgattctgattccgccggcgaaatcgggcgcctcgcggctcggccgactaaagcggtggatggcgccgcccgaggggtttcttcgactacggagagggtgaggcccgtgaggcacagacgtctcacgggcgacccagaatgatgatcgggcggggcggtcggcacaggatacggtgtgccccccccccgtcctcccgcgtgcgagcatcctggactcctacatccccgcgcgaagggcccgggtcaccagctgtcgacgcccgccgagcgcccctcacgtagtgaaggggcccggcggctacgtcagaaggcagtcccttcacaaacttggcgaggcggttgtagatcccgagcgaagtgttccccacgctccccaccgggggggtggtcgctggggggtatcctccctcagccgcacggattaccgccgcctgacagccgggaggggcgagctctcagcgcgcacacggaggtgtaggagggggctcgtggtcgcggcatgcgcggtggtctccgacaacgcaccgtatccacggtttctaagccgcgcggacagcacaggtgcccctacctggtgcctgcggagagaggggccgaacaaggagggctgctggccactcaggccgctgaggccgccggtcctacagtatccgttgtaatcgtgcgcggatcggttn

SEQ ID NO: 22489 - DNA, 737 bp, Zea mays
  misc_feature: Ceres CLONE 1392278-F
  misc_feature: Encodes the peptide sequence at SEQ ID NO. 22490
  misc_feature (552)..(552): n is a, c, t, g, unknown, or other
  misc_feature (632)..(632): n is a, c, t, g, unknown, or other
  misc_feature (708)..(708): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
aaagctggagctccccgcggtggcggccgctctagaactagtggatcccccgggctgcaggaattcgcacgagaccattacctagaacatcctaatcgaaaaatcacttatcatccccatccgcacctctctccatctccctgctcctccgccttcttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggtcatgccaaatgccactttgttgccatagatatattcaacgggaaaaagctcgaagatattgttccttcgtcacacaactgtgatattccgcatgtgaaccgtactgagtatcagctgattgatatatcagaggatggatttgtgagccttcttacttcagatggcaacactaaggatgatcttaaactcccaactgatgagnactcttgtgccagatcaaggaaggtttgaagtggcaagacgcgcgcgacgacggtcgctcttctcgacacagatcctccngtcagaaacggagatcgccgcacccagcgtcctctcatcgatgcagacaaaaacgcaggtccggaatcaagggttnaagggnnnnnnnnnnnnnnnnnnnnncgg

SEQ ID NO: 22490 - protein, 131 aa, Zea mays
  misc_feature: Ceres CLONE 1392278-F
  misc_feature (86)..(132): Pfam Name: eIF-5a Pfam Description: Eukaryotic initiation factor 5A hypusine, DNA-binding OB fold
  misc_feature (30)..(64): Pfam Name: KOW Pfam Description: KOW motif
  misc_feature (123)..(123): Xaa is any aa, unknown, or other
MSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLKLPTDEXSCARSRKV

SEQ ID NO: 22491 - DNA, 716 bp, Zea mays
  misc_feature: Ceres CLONE 1392279-F
  misc_feature: Encodes the peptide sequence at SEQ ID NO. 22492
  misc_feature (391)..(391): n is a, c, t, g, unknown, or other
  misc_feature (396)..(396): n is a, c, t, g, unknown, or other
  misc_feature (613)..(613): n is a, c, t, g, unknown, or other
aaagctggagctcaccgcggtggcggccgctctagatatagtggatcccccgggctgcaggaattctcacgagaccattacctagaacatcctaatcgaaaatctctatgacacgtgccccttcccccctcttaagctaagggacccttgggcagcccggcatcttctccaatctccaccctctgcccctctcgatttcttcttcccatctcccgatccatcgcaacccaaaccctactccaggcagatctccgtctccgccgacgctgccggcgtgagcacagcatcagatccgctgtgatggcgttccgccgcatcctatccaccgcggtgcgccgccgctcggccgtggccgccgcggcggccgaaaacgcgcgcgaggcctcacggncgtcnctgcggcgccaggtgtgctcgcccccgatgcgaccgcggtgcgcgctcccgtgatggcgtatgaccgcatcgccgaagccgtcaacgccaggctccggggggtcgagcacccagacccgggcttcctccgctacgccagccccgtggcgtcccacgcggaccacatggccatcccttgcggcggcagagacccgcggtcacacactggccaaacggnctgcgcaatcgcacggagtcttccctcgccgggggaaggcatacggtcggggtggtggatccaatgcggcagcaggtacaagaacaaggaggcggtcggcctc

SEQ ID NO: 22492 - protein, 89 aa, Zea mays
  misc_feature: Ceres CLONE 1392279-F
  misc_feature (55)..(55): Xaa is any aa, unknown, or other
MAYDRIAEAVNARLRGVEHPDPGFLRYASPVASHADHMAIPCGGRDPRSHTGQTXCAIARSLPSPGEGIRSGWWIQCGSRYKNKEAVGL

SEQ ID NO: 22493 - DNA, 747 bp, Zea mays
  misc_feature: Ceres CLONE 1392281-F
  misc_feature: Encodes the peptide sequence at SEQ ID NO. 22494
  misc_feature (747)..(747): n is a, c, t, g, unknown, or other
aaaagtggagctccccgcggtggcggccgctctagaactagtggatcccccgggctgcaggaattcgcacgagaccattacctagaacatcctaatcgaaaaatccgctccccgccttccgcttccctaccccccgcatcacctaccaacgccgacaccatgggggccttcgcgaaggaggagcaccagttcctagccgagctcggcctcgcgcagcgcaacccaggcgcgttcgcatgcggtgcgtggggcggctcaggtcccaccgtcacctccacgagcccgaccaacaatcaggtcatcgcagagggcgtggaggcgtccgtgcacgactacgaggagggcatgcgcgcctgcttcaatgcccccaacacatgggagtgggggtgctgctccaaaagggaggagaggatcgttagggcaatccggggatgcactgagaggcaagcctccatcacccttggcagggtttggggcacttggagatgggggaaaactccttcctggaagggaatcgggggagggtcaggaaaacatccacgatggggggattatgctgggggggctaaggcccccaactaaatgggatccccttatacccttcctgaccgacccaaaccatttggttgatgggagggggggcaacccccctttgggaggtggggggggggtcataaccgggattttaaatttcccccttgggcctggcgctttgggtgggaaacggtctgcatttgcttttgggcn

SEQ ID NO: 22494 - protein, 140 aa, Zea mays
  misc_feature: Ceres CLONE 1392281-F
  misc_feature: SWISSPROT Homolog: EC 1.2.1.3 Aldehyde dehydrogenase (NAD(+))
MGAFAKEEHQFLAELGLAQRNPGAFACGAWGGSGPTVTSTSPTNNQVIAEGVEASVHDYEEGMRACFNAPNTWEWGCCSKREERIVRAIRGCTERQASITLGRVWGTWRWGKTPSWKGIGGGSGKHPRWGDYAGGAKAPN

SEQ ID NO: 22495 - DNA, 711 bp, Zea mays
  misc_feature: Ceres CLONE 1392282-F
  misc_feature: Encodes the peptide sequence at SEQ ID NO. 22496
  misc_feature (456)..(456): n is a, c, t, g, unknown, or other
  misc_feature (573)..(573): n is a, c, t, g, unknown, or other
  misc_feature (698)..(698): n is a, c, t, g, unknown, or other
aaagctggagctccccgcggtggcggccgctctagaactagtggatcccccgggctgcaggaattcgcacgagaccattacctagaacatcctaatcgaaaaatcatcacactcgaaacccaacagcttccttcctggcgatccaattaacggcttctcttctgagctcagcacgaacaatggccaccatcctcaccgtcgcaagcttcttcgcacttgtgtgcatctctcaacaagcgcgggctgcgaactacacgttcatgaaggacgcggtgcacgcgccgcggacgggcttctacgactacatcatagtcggcggcggcacggcgggctgcccgctggcggccaccctgtcggcccgcgcgcgggtgctgctgctggagcgcgggggctctccgtacgaggacgcgcgcgtcctgaacatggcccactttctcggacgtgctggcggacacngtcggcgtcgtccccgtcgccagcggttcgtgtcggagggacggcgtgatcaactcccgcccgcgcgtggctgggcggcggcagctgcatcaacgccggcttcttcagcggggcggngcgggctacgtcagggcccgcgctggaacccaggggaggtgcggccgccgtaccccggggggtggaaggaacgtgaccccctcccccccgcgctgggccccgggaaaggcccccctgcggatggnccttgctgaaacg

SEQ ID NO: 22496 - protein, 175 aa, Zea mays
  misc_feature: Ceres CLONE 1392282-F
  misc_feature: SWISSPROT Homolog: EC 4.1.2.10 Mandelonitrile lyase
  misc_feature (93)..(93): Xaa is any aa, unknown, or other
  misc_feature (132)..(132): Xaa is any aa, unknown, or other
MATILTVASFFALVCISQQARAANYTFMKDAVHAPRTGFYDYIIVGGGTAGCPLAATLSARARVLLLERGGSPYEDARVLNMAHFLGRAGGHXRRRPRRQRFVSEGRRDQLPPARGWAAAAASTPASSAGRXGLRQGPRWNPGEVRPPYPGGWKERDPLPPALGPGKGPPADGPC

SEQ ID NO: 22497 - DNA, 744 bp, Zea mays
  misc_feature: Ceres CLONE 1392283-F
  misc_feature: Pfam Name: Pantoate_ligase Pfam Description: Pantoate-beta-alanine ligase
  misc_feature: SWISSPROT Homolog: EC 6.3.2.1 Pantoate--beta-alanine ligase
aagagtggagctccccgcggtggcggccgctctagaactagtggatcccccgggctgcaggaattcgcacgagaccattacctagaacatcctaatcgaaaaattttatcgtcaacaatttccgtcttctcagtttctgacttattcccggggcatttttttattggttcgagcctgtgagtctgattccattttgacccatgggggcggctgcggttcatgaggcggaggtgatccgcgaacaggcggcgatgcgcgcgtggccgccccccccccgcgcggaaggaaaagggcgtcgctttagtccccacgatgggcttcctcccacgaggacacctctcgctcatctccgggggcgggggggcctccgccgaccccatcggcggggggggctccatctacgtcaaccccagccagttccgcccccccgaaggacctcgccccctaacccctccgacttcggcgggggacctccgcaagctggctgccccccggggtcgtcgacgcaatatttttgccccccggaccctctacgtccggggggagggttgaatccccccctccgccgcccgggcggcccgggggcgcggggtttttcccgggggaggaaaaaccaggggggccttccggcccaaacaccggggttccggcgggggagcgcgcttgagaaaggggcctggggcgggaacccggcgcggcccccctttccttccgggggggggggcccccccgggatcgacaaga

SEQ ID NO: 22498 - DNA, 718 bp, Zea mays
  misc_feature: Ceres CLONE 1392285-F
  misc_feature: Encodes the peptide sequence at SEQ ID NO. 22499
  misc_feature (384)..(384): n is a, c, t, g, unknown, or other
  misc_feature (461)..(461): n is a, c, t, g, unknown, or other
aaagctggagctccccgcggtggcggccgctctagaactagtggatcccccgggctgcaggaattcgcacgagaccattacctagaacatcctaatcgaaaaacatttcgactctcaactcccaaggtccctttttttttctcgatctggaagcgccgcagtagcagccatggacgtgagcggagcaggcggtaaggcgaagaagggcgcggcggggcgcaaggcccggcggccgacaaagaagtcggtgtcgcggtcctccagggccgggctgcagttccccgtcagccgcgtcgggcggtacctcaaaaagggccggtacgcgcagcgtgtaggcacgggtgcccccgtctacctcgccgccgtcctggagtacctcgcggncgaggtgctcgagctcgccggcaacgccgcaagggacaacaagaagacgcgcatcattccgcgccacgtgctcctcngcatccgcaacgacgaggagctcggcaagctgctggccggcgtcaccatcgcccacgggggcgtcctccccacatccacactgtgctcctccccaaagaggtgggccgagaaggcgccaaaggagcccaagaagggccgccagtccccaagaagggcggagagtgatctcctctctaagaggggggcgggattctccattagaacctattaccattagcgatcgtggagtaactagaccagtgtttagggaaaatcc

SEQ ID NO: 22499 - protein, 169 aa, Zea mays
  misc_feature: Ceres CLONE 1392285-F
  misc_feature (29)..(102): Pfam Name: Histone Pfam Description: Core histone H2A/H2B/H3/H4
  misc_feature (72)..(72): Xaa is any aa, unknown, or other
  misc_feature (98)..(98): Xaa is any aa, unknown, or other
MDVSGAGGKAKKGAAGRKARRPTKKSVSRSSRAGLQFPVSRVGRYLKKGRYAQRVGTGAPVYLAAVLEYLAXEVLELAGNAARDNKKTRIIPRHVLLXIRNDEELGKLLAGVTIAHGGVLPTSTLCSSPKRWAEKAPKEPKKGRQSPRRAESDLLSKRGAGFSIRTYYH

SEQ ID NO: 22500 - DNA, 703 bp, Zea mays
  misc_feature: Ceres CLONE 1392286-F
  misc_feature: Encodes the peptide sequence at SEQ ID NO. 22501
  misc_feature (418)..(418): n is a, c, t, g, unknown, or other
  misc_feature (436)..(436): n is a, c, t, g, unknown, or other
  misc_feature (465)..(465): n is a, c, t, g, unknown, or other
agagctggagctccccgcggtggcggccgctctagaactagtggatcccccgggctgcaggaattcgcacgagaccattacctagaacatcctaatcaaaaaactccaacctacccagcctcgggcagccacctccccgtcgctctcacgctcttcgtgcccgccgcctcccctcttcccctccacctcactcctcccgtctgacgcacatggcctccatcgccggatcttccgctctctccttcgccatgcctgtcaaggcaatcaactcaaattctctagccttctccccggtgaggaagggtaacacattcctccgcctgcaaccagtgcctatgagatctgtttcctgcgctgccaagaaggatacggtggacaaggtttgtgaaattgtgaagaagcagcttgctcttcctgnacacactgaagtgtgtgntgaatcgaaattctctgaacttgatgcgnattcgctggacacgtttgagattgtgatgcgccttgaggagcacttcgacattagcgtggaggactccagcgcgcagacatttgcaccgttgaagacgccgctgacctcattggacagcttgttgctgtgaaggcataggccgcatctcttctatcatgggcttaccactctaggtttctatggcctgaagacttgtgattttctccggactggtggtggtattcccgtgtcgaaaaa

SEQ ID NO: 22501 - protein, 128 aa, Zea mays
  misc_feature: Ceres CLONE 1392286-F
  misc_feature (70)..(70): Xaa is any aa, unknown, or other
  misc_feature (76)..(76): Xaa is any aa, unknown, or other
  misc_feature (86)..(86): Xaa is any aa, unknown, or other
MASIAGSSALSFAMPVKAINSNSLAFSPVRKGNTFLRLQPVPMRSVSCAAKKDTVDKVCEIVKKQLALPXHTEVCXESKFSELDAXSLDTFEIVMRLEEHFDISVEDSSAQTFAPLKTPLTSLDSLLL

SEQ ID NO: 22502 - DNA, 675 bp, Zea mays
  misc_feature: Ceres CLONE 1392287-F
  misc_feature: Encodes the peptide sequence at SEQ ID NO. 22503
  misc_feature (125)..(125): n is a, c, t, g, unknown, or other
  misc_feature (136)..(136): n is a, c, t, g, unknown, or other
  misc_feature (467)..(467): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
aaagctggagctccccgcggtggcggccgctctagaatagtggatcccccgggctgcaggaattcgcacgagaccattacctagaacatcctaatcgaaaaatcaagttttgtagtgttgttagntgtttctaccngtatgtctgatttgtactttattagtacttaagtctgtctttgagaaatataagatactagtctgttcactgaagaatgtggccttaaacactagtttgatttcagggtggttatgttctttatcgcctcttctggaaaccagaggagaaaactgtgcgctccagcccagaaaaaatggatagaagtggcaactcgcctactactccccgttcttcacgtgacaaccaagaggcgaatgaggaagctaatacaccattaaataagaaatctctagaatctgctctgcatgatccgattgagctgcccaattctgctgaaacccctgctggnccaggaatgtgctgcgacgatgatattgtgtactgacgtgtcttctcgatggggatatgctctgtccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 22503 - protein, 63 aa, Zea mays
  misc_feature: Ceres CLONE 1392287-F
MDRSGNSPTTPRSSRDNQEANEEANTPLNKKSLESALHDPIELPNSAETPAGPGMCCDDDIVY

SEQ ID NO: 22504 - DNA, 703 bp, Zea mays
  misc_feature: Ceres CLONE 1392289-F
  misc_feature: Encodes the peptide sequence at SEQ ID NO. 22505
  misc_feature (542)..(542): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
aaagctggagctccccgcggtggcggccgctctagatactagtggatcccccgggctgcaggaattcgcacgagaccattacctagaacatcctaatcgaaaaaacaacaacccgcacaacggcacgattctcctcctccgtccgcgtagctctcggtttcggcgatgtcggggcgcggcaagggcggcaaggggctgggcaagggcggcgccaagcgccaccgcaaggtgctgcgcgacaacatccagggcatcacgaagccggcgatccgtaggctggccaggaggggcggcgtcaagcgcatttctgggctcatctacgaggagacccgcggcgtgctcaagatcttcctcgagaacgtcatccgcgacgccgtcacctacgccgagcacgcccgccgcaagaccgtcaccgccatggatgtcgtctacgcgctcaagcgccagggccgcacgctctacgggcttcggcggctaggccgcctccccttctgatgctttgatgtgacggccgtgggtcgttgtgtgtctagttgggcggnctactgtagtttgttctgtatcttcggttcgaggtggtcagtttctagcccatttggtgtatattttcactgctattatcagtgggaagccctcggttctatcccccnnnnnnnnnnnnnnnnnnnnnnnnnacnnnnnaaaaaaaaaagctatcgatccg

SEQ ID NO: 22505 - protein, 109 aa, Zea mays
  misc_feature: Ceres CLONE 1392289-F
  misc_feature (25)..(94): Pfam Name: Histone Pfam Description: Core histone H2A/H2B/H3/H4
MSGRGKGGKGLGKGGAKRHRKVLRDNIQGITKPAIRRLARRGGVKRISGLIYEETRGVLKIFLENVIRDAVTYAEHARRKTVTAMDVVYALKRQGRTLYGLRRLGRLPF

SEQ ID NO: 22506 - DNA, 732 bp, Zea mays
  misc_feature: Ceres CLONE 1392290-F
  misc_feature (627)..(627): n is a, c, t, g, unknown, or other
  misc_feature (629)..(629): n is a, c, t, g, unknown, or other
  misc_feature (630)..(630): n is a, c, t, g, unknown, or other
  misc_feature (732)..(732): n is a, c, t, g, unknown, or other
aaagctggagctccccgcggtggcggccgctctagaactagtggatcccccgggctgcaggaattcgcacgagaccattacctagaacatcctaatcgaaaaagctctgagacttttcacaaggagcagagaggacaccgcaccagcccgttctcgttgcactcggggcaccgcctgaatgtggccgcctcctcgacgaacaccttgcagctgccggagcactcctcgcagggcacgaaccgcacgccgccgcagccggagcacgcctccagggcaacgcccttgccgcccgggcagctcggcgggggcgccatctcgcaggcctcgagcgcctccgacagctcgccggcctcgggcatccggcggacctcctcggcgccgcccaggtgcctgccgtccgcgaacacctgcgggagcctgcccgcgctggagccgcccagcgcggcgtggagctcgtcctggaaccccgcgtgcatcgacaggtctcgctcgtcgacgcgcacgccgtagctctggaggacggaccttgtggacagcagtcctcgtacgtcttgcggacgcccgcgaggctggtcaggtacacacccacttccggcgctgtcccggcggggcggcaaggccgggcgncnngcgccccacttggcgagcttcgcgtcgatcctctggtggaacgcgctgacccggggcggacgatgcccggaaactctgtatctcgcggttcctaacgccccn

SEQ ID NO: 22507 - DNA, 727 bp, Zea mays
  misc_feature: Ceres CLONE 1392293-F
  misc_feature: Encodes the peptide sequence at SEQ ID NO. 22508
  misc_feature (387)..(387): n is a, c, t, g, unknown, or other
  misc_feature (453)..(453): n is a, c, t, g, unknown, or other
  misc_feature (485)..(485): n is a, c, t, g, unknown, or other
  misc_feature (541)..(541): n is a, c, t, g, unknown, or other
caaagctggagctccccgcggtggcggccgctctagaactagtggatcccccgggctgcaggaattcgcacgagaccattacctagaacatcctaatcgaaaagccgtctcagttctcatgtccgggtgaagaaaagaaaaatcctcctgttccctgactatcgctacccctccacatccagtggccatggtgaagaagcccaacgacgttgccaaggccgcggcgacctccgccgacgcggcagccaggccatccaaggcgaatccgtccacccctcagtcggtcaagacctcgaagtttaagaagcggaaggtcaaggccaaccgccagaagccagcggtagctgccgcagcttgttgacgatgtcgccccggtaggcgcaggcnactgggggatggcgatgcatcttgcatccgcggttttaccgcagccatccaatgttgctgaggcantcgcctgtggtgcaaacgccaaagtcgacccngcttttgttgaggcgtcacctggtggtacagacgcagaagacagccactggatgcntgaagtacccggtgcattcaccaatgccagccactgctgaagcatcagctttgtcgccaaagccaaagccaaaccagctcatgctaatgctgatgctgcagctgcaatttctgtagcagggcaaaaaggcgtggtgctgatataagcggggggtgatgccagaatgagagcaaaaaagagggctag

SEQ ID NO: 22508 - protein, 57 aa, Zea mays
  misc_feature: Ceres CLONE 1392293-F
MVKKPNDVAKAAATSADAAARPSKANPSTPQSVKTSKFKKRKVKANRQKPAVAAAAC

SEQ ID NO: 22509 - DNA, 702 bp, Zea mays
  misc_feature: Ceres CLONE 1392294-F
  misc_feature: Encodes the peptide sequence at SEQ ID NO. 22510
  misc_feature (151)..(151): n is a, c, t, g, unknown, or other
  misc_feature (163)..(163): n is a, c, t, g, unknown, or other
  misc_feature (400)..(400): n is a, c, t, g, unknown, or other
aagctggagctccccgcggtggcggccgctctagaactagtggatcccccgggctgcaggaattcgcacgagaccattacctagaacatcctaatcgaaaatccaacctgttccgatccgccccgagccggctggccatggcgatcagggntggccgctcggncctccacctccacgctctcgctttcctcatcctcgccgcctccccctgcctccaagtccaagctctagtggaccatcgcaaacaggtatctgactgggggaggcaacccaactttgaactgcagaatatgtcctcgagtcaaagggatggctctcatctcttgggcagatcaaaggaaataaacacaggaaactaagggggggaattggtgtaagggacaaaatggaagtagtgcancaggatgatgaaacatttagtaaacttgagaacacagggattgaacgctcaaaagctgttgattctgcagtgctgggaaaatatagcatctggagacgtgaaaatgaaatgagaaggcagattcaggggttcgtctgaaggggaaatcaaatggacatggccaaaaaaaatctgtccttgcaaatctagggaacaactgatttctatcaggggctgctacaaaaatcaaggaaagccgcgctccccttgggaaattactgctgaggccaaatttccaaaaagggtcaaaaaaaacaaggaag

SEQ ID NO: 22510 - protein, 50 aa, Zea mays
  misc_feature: Ceres CLONE 1392294-F
  misc_feature (5)..(5): Xaa is any aa, unknown, or other
MEVVXQDDETFSKLENTGIERSKAVDSAVLGKYSIWRRENEMRRQIQGFV

SEQ ID NO: 22511 - DNA, 736 bp, Zea mays
  misc_feature: Ceres CLONE 1392297-F
  misc_feature: Encodes the peptide sequence at SEQ ID NO. 22512
  misc_feature (444)..(444): n is a, c, t, g, unknown, or other
  misc_feature (590)..(590): n is a, c, t, g, unknown, or other
  misc_feature (625)..(625): n is a, c, t, g, unknown, or other
  misc_feature (626)..(626): n is a, c, t, g, unknown, or other
caaagctggagctccccgcggtggcggccgctctagaactagtggatcccccgggctgcaggaattcgcacgagaccattacctagaacatcctaatcgaaaaattaattaacaaagagaagacttcttccttcctcgtcgtctccagcccattccaattcttgattccatcgccccaccatccacaactcccctaatccttccaacctcctcgtcgtccagtccaccacctccacgcgcaatggccagcggctaggcggcaccaaccagatcacaaggattcgtttcatccggcagcgcagctctagagcctccatgggcagctacgcgtacaagtactgtatgtgcttcacgcgcaagttccgatccccggacgcccagccgccgccggacgtccgcgccgcccacctctccttcgcctctgacgcccatgccctccgccgncttcgtcgccggcgtccagggcgagcccccccgccgacgtcgaccgcatcctcgccatggctctccgggggccacagccatggaatcgcccgcctcgtcaccaggtcgccggcggcatccacgcccacgctcgaagacttcttcgncttcctcttctccccccgactcaacccaccatcgnngcacaggttcacaggaatggtcagcgccgtctctcaactatttcgtggtcaccgggcataattcctacctcactgggaacagctcatagtgactccgtgacgtccaattt

SEQ ID NO: 22512 - protein, 123 aa, Zea mays
  misc_feature: Ceres CLONE 1392297-F
  misc_feature (92)..(92): Xaa is any aa, unknown, or other
  misc_feature (104)..(104): Xaa is any aa, unknown, or other
MGSYAYKYCMCFTRKFRSPDAQPPPDVRAAHLSFASDAHALRRLRRRRPGRAPPPTSTASSPWLSGGHSHGIARLVTRSPAASTPTLEDFFXFLFSPRLNPPSXHRFTGMVSAVSQLFRGHRA

SEQ ID NO: 22513 - DNA, 744 bp, Zea mays
  misc_feature: Ceres CLONE 1392298-F
  misc_feature (325)..(325): n is a, c, t, g, unknown, or other
  misc_feature (519)..(519): n is a, c, t, g, unknown, or other
aaagctggagctccccgcggtggcggccgctctagaatagtggatcccccgggctgcaggaattcgcacgagaccattacctagaacatcctaaccgaaaaaacccaggcaacacagcaatcagcagaaaaacatctccttggccttccatccatatgatccatccctccaggctccagctaactccaaactaccctctggttcgactcgcgttcgcatcgcaagcagcagcgtaccatcgaggcaatggcggtgatggccgaagtagtgtcgaccaccggcgcggcgctccggagcccggcacgcagcagccggcggcggcggncgcggcgaagggcaccgacgctgagaagctccagttcatcgaggacatgaccctccacggtggacgcgtgcaggagcgcgtgcttggggaagatctcgcccggcaacgcgaacacgagtacctctccaggagggcgggccttcggcggggctacggaccgggccacctcccgggccagggggccaatggggaantaaagaggacctggaaccgaacttcggggaattcgccaaagggaacggtcccccattcgggtggggccccgggtttccgaattctcccaattcccgaaatgcgggggggaaagggatctcctgccccccctggggggggggccccccgcgcccggggtggtgaaccccccaagacccccaaaaaaacatgaaggcggggaaaaaaaaaaaaaaaacccccttttg

SEQ ID NO: 22514 - DNA, 725 bp, Zea mays
  misc_feature: Ceres CLONE 1392300-F
  misc_feature: Encodes the peptide sequence at SEQ ID NO. 22515
  misc_feature (523)..(523): n is a, c, t, g, unknown, or other
  misc_feature (544)..(544): n is a, c, t, g, unknown, or other
aaagctggagctccccgcggtggcggccgctctagaactagtggatcccccgggctgcaggaattcgcacgagaccattacctagaacatcctaatcgaaaaaagagcgtgcagagcgagacgcgtcgcctcctcccttcccccaccccgccgccgccctcgcgtccgtccgtccgtccgttattagggttcggtcgccgccatggcgatcctctcggcgctcgccaccgaggtgctcatccccgtcgccgccgtcatcggcatcgccttcgccgtcgtgcagtgggtggtcgtgtcgcgcgtgaagctctccccggccgcggccggcggtggcggcggcaaggccggctacgccgactccctcatcgaggaggaggagggggctcaacgaccacaacgtcgtcgtcaagtgcgccgagatccagaacgccatctccgaaggagcaacatcgtttcttttcaccgagtaccaatatgttggtatcttcatggctatcttcgctgttgtgatcttcctcttccnttgttccgttgagggattcancacgaagaagcagccctgcacatatagcaaggaccagtactgcaagcctgcgctgtccactgcactctttagcactgggtccttcttgcttggagcatcaactctctggtctctggtttcttgggatagagatgccacatatgcaaatgccaaaactaccctgaaagctaagaagggtgtg

SEQ ID NO: 22515 - protein, 79 aa, Zea mays
  misc_feature: Ceres CLONE 1392300-F
  misc_feature: SWISSPROT Homolog: EC 3.6.1.1 Inorganic diphosphatase
  misc_feature (12)..(12): Xaa is any aa, unknown, or other
  misc_feature (19)..(19): Xaa is any aa, unknown, or other
MAIFAVVIFLFXCSVEGFXTKKQPCTYSKDQYCKPALSTALFSTGSFLLGASTLWSLVSWDRDATYANAKTTLKAKKGV

SEQ ID NO: 22516 - DNA, 711 bp, Zea mays
  misc_feature: Ceres CLONE 1392301-F
  misc_feature: Encodes the peptide sequence at SEQ ID NO. 22517
  misc_feature (656)..(656): n is a, c, t, g, unknown, or other
aaagctggagctccccgcggtggcggccgctctagaactagtggatcccccgggctgcaggaattcgcacgagaccattacctagaacatcctaatcgaaaaattccgcaccacgcccagtcgcccacgcagccggcccaagaccaaaaacctttctccatcctctactctcatccccacgatggccgacgccgccaccaagccggactccctcctcctccagagcgccgcgatcccggccgcgcaggcgaggacgaccggcaccagcactagggagagactcaatctgcccgtgactggcagcgagtgggtcgggtggggtggttagttgaggtcacgatgatgggaggcggactgatgatggatcagagcgctgttccctggcgtccacaacttcgtggatctcctgcagcagaacggcgacaagaacctgggcttcgcctcactcatgccgcagacgtcctccggcgaccagagcgtgatgggggagggtgatctcgtggacccaccgccagacagcttcccggacggcgtggaggacgacagggatgacgacgttgaggacatcgaggagctgcagcgccgcatgtggcgcgaccgcatgaagctgaagcggattaaggaggtggagcagagccgcggaaaggatccatggntaagggagggggcctggccgacggttcatccagccaaggaagtcgaggaggaggc

SEQ ID NO: 22517 - protein, 87 aa, Zea mays
  misc_feature: Ceres CLONE 1392301-F
  misc_feature (70)..(70): Xaa is any aa, unknown, or other
MPQTSSGDQSVMGEGDLVDPPPDSFPDGVEDDRDDDVEDIEELQRRMWRDRMKLKRIKEVEQSRGKDPWXREGAWPTVHPAKEVEEE

SEQ ID NO: 22518 - DNA, 738 bp, Zea mays
  misc_feature: Ceres CLONE 1392303-F
  misc_feature: Encodes the peptide sequence at SEQ ID NO. 22519
  misc_feature (415)..(415): n is a, c, t, g, unknown, or other
  misc_feature (515)..(515): n is a, c, t, g, unknown, or other
  misc_feature (593)..(593): n is a, c, t, g, unknown, or other
  misc_feature (606)..(606): n is a, c, t, g, unknown, or other
  misc_feature (665)..(665): n is a, c, t, g, unknown, or other
  misc_feature (666)..(666): n is a, c, t, g, unknown, or other
aaagctggagctccccgcggtggcggccgctctagaactagtggatcccccgggctgcaggaattcgcacgagaccattacctagaacatcctaatcaaaaagaacacatcttgccgccgccgaggacgacggcgatgatgtggcgttcgcgagctcgtgcgctgctcctactccgctcgaccattacccggccaccgccaccacctccacaaccatatcccactcgaaccctaacccgagtcccacctccccgcttcctgtcctcctccccggatcccatccccgattcctcctccgccgccgccgcggatcccttccctgaagccttctcctccccgaccaaggcttctcaagatgccgctgaggccggagaggacaacctgagctcgatgtgggaggaagctggcgacgccnacgacatctttgcctcccccggcagcgccgacgccgtagcccgacgatgaggaggtcgcccgcatctgcgccgccgtggagtccacccccgaggacgagnatcgctccaccctcgctgacatggaccgtggacttcaacgagccactccctagccgcagtccctccttgctgctgatncatgctcctgtangaagctgatttccctggttcactatgcccgcgaggataaccccgcttccagagctctcnnaatcgtgaggttctcgtgaggcagctagctgattctgctgagatagacagcagacgcttactggctttggga

SEQ ID NO: 22519 - protein, 109 aa, Zea mays
  misc_feature: Ceres CLONE 1392303-F
  misc_feature (94)..(94): Xaa is any aa, unknown, or other
MMWRSRARALLLLRSTITRPPPPPPQPYPTRTLTRVPPPRFLSSSPDPIPDSSSAAAADPFPEAFSSPTKASQDAAEAGEDNLSSMWEEAGDAXDIFASPGSADAVARR

SEQ ID NO: 22520 - DNA, 724 bp, Zea mays
  misc_feature: Ceres CLONE 1392304-F
  misc_feature: Encodes the peptide sequence at SEQ ID NO. 22521
  misc_feature (1)..(1): n is a, c, t, g, unknown, or other
  misc_feature (675)..(675): n is a, c, t, g, unknown, or other
  misc_feature (724)..(724): n is a, c, t, g, unknown, or other
naaagctggagctccccgcggtggcggccgctctagaactagtggatcccccgggctgcaggaattcgcacgagaccattacctagaacatcctaatcgaaaagcgaaacagaagcacggcaatctcgatctcgttcgttcccctgagcggcagtcagtgcgagcgagcgcgcacacagacaactcatcctctcccctctctctctcacacacacacatccatcatcccatccctgtgacgggcgatccgagggccctaccgacgatggtgtccgccgtgctccggaccatcctcgtgacgggcggcgccgggtacatcggcagccacacggtgctgcagctgctgcagagggcttccgcggtcgtcgtcgtcgacaacctcgacaacgcctccgaggccgccctcgcccgcgtcgacgagatcgccgggcacgacggcgccgacctcgtcttccacaagtttgaccttcgcgacaggtacgcagtaggtggacatcttctcgtctgacagtgtcgagggtgacaatcactttgctggactcaaggctgatgaaatagagcattcacaatcccctactttactactacaactgcctggtcgtaccatcacgcctcctggaggagatggctgctatcgaatgactctagcaggtgttctcgtaatctggcatcgtncgatgtgggaggcgaaggaagtctcttgcttcgaacaatatcccgctcn

SEQ ID NO: 22521 - protein, 80 aa, Zea mays
  misc_feature: Ceres CLONE 1392304-F
  misc_feature: SWISSPROT Homolog: EC 5.1.3.2 UDP-glucose 4-epimerase
MVSAVLRTILVTGGAGYIGSHTVLQLLQRASAVVVVDNLDNASEAALARVDEIAGHDGADLVFHKFDLRDRYAVGGHLLV

SEQ ID NO: 22522 - DNA, 705 bp, Zea mays
  misc_feature: Ceres CLONE 1392305-F
  misc_feature: Encodes the peptide sequence at SEQ ID NO. 22523
  misc_feature (233)..(233): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (505)..(505): n is a, c, t, g, unknown, or other
  misc_feature (543)..(543): n is a, c, t, g, unknown, or other
caaagctggagctccccgcggtggcggccgctctagaactagtggatcccccgggctgcaggaattcgcacgagaccattacctagaacatcctaatcgaaaaacggaagggcccggacagttttgcgcacaagccccccattcccattctaccaccgacccgtcccgtcccactgcctgccagcgtctcccccgctccctctcctcgagagatctcgcgctccggcgatcgnggcgcggcgggcggagggtcgcgaagtgccctgcccacccccgatgctcttcccgaagcgcatcaactacgtggccccgatgctcgcctccgccgccatcctgctcctcctcctctcgggctacttcgagctcccctccatctccaccccggcgcgnnntcctcgcggggcgcagcgcgctttccccaccgcgctcgacttccgtcgggatcgcgcgaccgcgaccccttcacctcgctcctcgaggccttcgcgggtctggggaccgccgnccgtcggcttgcccccgcgtccgcgccagctccgccgnccggggggcttggggctgggccccggccctgccgctggccgagtgcgagcgccagcgccagcgctaccggcaccgcggaggaccttgcggggggtcccgtcaggggggggcgccccgtggcccgaaaccccgaggtgcaaggaactgggcagcgccccccgg

SEQ ID NO: 22523 - protein, 143 aa, Zea mays
  misc_feature: Ceres CLONE 1392305-F
  misc_feature (39)..(39): Xaa is any aa, unknown, or other
  misc_feature (77)..(77): Xaa is any aa, unknown, or other
MLFPKRINYVAPMLASAAILLLLLSGYFELPSISTPARXPRGAQRAFPTALDFRRDRATATPSPRSSRPSRVWGPPXVGLPPRPRQLRRPGGLGLGPGPAAGRVRAPAPALPAPRRTLRGVPSGGGAPWPETPRCKELGSAPR

SEQ ID NO: 22524 - DNA, 716 bp, Zea mays
  misc_feature: Ceres CLONE 1392306-R
ccgattgggtaccgggccccccctcgaggtcgacggtatcgataagcttttttttttttttttttgacagccaaagcgataaacatccagcggtgcttacagtggaacctgcaattcatggctgagaacgacattgttgcctgcatcgatccaacataaaatcccatcacctccgcagggaagaggattagctacggggctgctcctaatctaggaaatagtactgacaatgggcaggtatggtgaaggcgaacacactggcccaggtacgggaaatcctttggatagtatccactgatcagcaacttcgtggtatagattaaacatgtacgggggctgatgttttgttcactcacatgctctcagcttgcacgtccctggaatatctaccggccccaggaaattgcagagcccacttgccttctatgcggacatccagaatgtgatcccattcgaccatgacaagaatgaagttcggcggacatgttccctaaaggggccaaaaaaattatagagtcgcccccccaatccaaattggtggaaaaagaccccttccacaaaattccccccttaaggggcccccccggaggcccccctccccaaggccccccggggtttctcttattttaaattggaaggggccccccccccatttttaaaaattttgtgagaagaaaagttgctttcccccccccgggggccccctcaataaaacg

SEQ ID NO: 22525 - DNA, 744 bp, Zea mays
  misc_feature: Ceres CLONE 1392310-F
  misc_feature: Encodes the peptide sequence at SEQ ID NO. 22526
  misc_feature (460)..(460): n is a, c, t, g, unknown, or other
  misc_feature (464)..(464): n is a, c, t, g, unknown, or other
  misc_feature (467)..(467): n is a, c, t, g, unknown, or other
  misc_feature (473)..(473): n is a, c, t, g, unknown, or other
  misc_feature (596)..(596): n is a, c, t, g, unknown, or other
  misc_feature (728)..(728): n is a, c, t, g, unknown, or other
aagctggagctccccgcggtggcggccgctctagaactagtggatcccccgggctgcaggaattcgcacgagaccattacctagaacatcctaatcgaaaaatcgatcccagccccaggccatggcgacgaggtggaggaggtcgctgctctgggtcgccgtcgtccagttcctgaccctgtgcgtcgccgagcatctcgtagtggaagcatacaaaaagtcctacattgtgtatctgggatcacatgcatatggccgtgatgcgtcggcggaggagcatgctcgcgcaacccagtctcaccaccacctcctggcatcgatcctcggcggcgacgaccaccaccaccatgagacggcgcggcagtccatcttctactcctacaccaagagcagcatcaatggcttcgcggcgcacctggaggagtcggtcgcgcagcagatcgcggagcaccctgaggtngtgncgntgctgnagagcaagatgctcaagctgcacaccacgcggtcctgggacttcatggacctggagcgcgacggtcacgtcctccctgggctcatctggaaccacgctaggttcggacaggacgtcatcatcngcagtctcgacagcggagtgtggcccgagtcccacagcttccaagacgacgggcgccagtgccagctcgctggaagggctcctggtcagacaccgttaggtacgggtgtcgctgcaccgcaaactcatcggngcttagttcttcaaca

SEQ ID NO: 22526 - protein, 207 aa, Zea mays
  misc_feature: Ceres CLONE 1392310-F
  misc_feature (33)..(125): Pfam Name: Subtilisin_N Pfam Description: Subtilisin N-terminal Region
  misc_feature: SWISSPROT Homolog: EC 3.4.21.25 Cucumisin
  misc_feature (115)..(115): Xaa is any aa, unknown, or other
  misc_feature (116)..(116): Xaa is any aa, unknown, or other
  misc_feature (118)..(118): Xaa is any aa, unknown, or other
  misc_feature (159)..(159): Xaa is any aa, unknown, or other
  misc_feature (203)..(203): Xaa is any aa, unknown, or other
MATRWRRSLLWVAVVQFLTLCVAEHLVVEAYKKSYIVYLGSHAYGRDASAEEHARATQSHHHLLASILGGDDHHHHETARQSIFYSYTKSSINGFAAHLEESVAQQIAEHPEVVXXLXSKMLKLHTTRSWDFMDLERDGHVLPGLIWNHARFGQDVIIXSLDSGVWPESHSFQDDGRQCQLAGRAPGQTPLGTGVAAPQTHRXLVLQ

SEQ ID NO: 22527 - DNA, 726 bp, Zea mays
  misc_feature: Ceres CLONE 1392312-F
  misc_feature (604)..(604): n is a, c, t, g, unknown, or other
  misc_feature (608)..(608): n is a, c, t, g, unknown, or other
  misc_feature (634)..(634): n is a, c, t, g, unknown, or other
  misc_feature (635)..(635): n is a, c, t, g, unknown, or other
  misc_feature (649)..(649): n is a, c, t, g, unknown, or other
  misc_feature (726)..(726): n is a, c, t, g, unknown, or other
caaagctggagctccccgcggtggcggccgctctagaactagtggatcccccgggctgcaggaattcgcacgagaccattacctagaacatcctaatcgaaaaatgtgtttgtgactttgtgctcgtcctcatacccccaccccccagctcccgtctcctcgtgctctccactgctgcatgcgcctcttgtcctgtccccctccccaccttgttcctcccatcccgcgccgtctctgcacgaagcagagcgccggtccaccgacaaggacagctacaactacgacgcgcaggcagagccatcgctcatctggggctgccctcggttactcctcccctccgccgctgcccctgccttgtccacagctgttgttaattccttcatgagttggcgtcggcgccagcggggcggaggggaaggaggcggggcttcagcttccccggcgccggccgccgcctgaagatcccttcttctcctgtagtcctgtcgtcgggcgggcgaggtccaagcatcatggggctcttaggtatgatgggcggactcttttgggttgctcgcgactggggagcgacttgtgtctgctgcaagagatggagacatccagnaggncagggctctcttagactcaatcccgnncttgctcgtactcnacgttcgggatccggaattcgctctcattactcggcagcaaaggccaccatgagattgctcctctaaatcaagtcgn

SEQ ID NO: 22528 - DNA, 752 bp, Zea mays
  misc_feature: Ceres CLONE 1392313-F
  misc_feature: Translation starting site: 512
  misc_feature (318)..(318): n is a, c, t, g, unknown, or other
  misc_feature (424)..(424): n is a, c, t, g, unknown, or other
  misc_feature (465)..(465): n is a, c, t, g, unknown, or other
  misc_feature (505)..(505): n is a, c, t, g, unknown, or other
  misc_feature (521)..(521): n is a, c, t, g, unknown, or other
caaagctggagctccccgcggtggcggccgctctagaactagtggatcccccgggctgcaggaattcgcacgagaccattacctagaacatcctaaaaaaaaaaccgagtcgagtccacagtccacaccaccaccgcgaggtccactaaaaaaacaagagcattaccggcaccaatcaatcaggctggcagtggagtgacagcggcggcaacaccacgcccacgcggcgccggagccgatcccccgatggatctcccgccgctctcccaccaggccctcttcgccgccgtccgatccgccgacgcgcccgccgtccgncgcgggtcctggccgacgccgaggcgtcggccacctccttggccgcgctcgccgccgctcagacggacgcccgggaaaccgcgctgtacgttgccgcggaggccgnaaggcgaggaggtcgtgcgcctcctcctccctctctacganttcgaggcagccaccgtccgctcacgccttgacctcgacngcttccatgtcgccgncagcaggcccaccaccgggggttgtgaaagagtcctttggggcggtgcccaggggctttgctcagtctgtgactctttcaacactagtcccctctactcggctgctgtcaagaatcacctgggatgggggaaatgctataactggaccctgatgatagcttgcataaagattgggcgggaggaatggaaaaacttcccctacttacgggtggaagaaattgaatacccttc

SEQ ID NO: 22529 - DNA, 861 bp, Zea mays
  misc_feature: Ceres CLONE 1392314-R
  misc_feature (841)..(841): n is a, c, t, g, unknown, or other
ccgattgggtaccgggccccccctcgaggtcgacggtatcgataagcttttttttttttttttttgaatggaaacagatcccaatgtttttttttacattaacattcccattacaatcgctcaaccaaacgccacctatcgtttctacggatctgtatgggccaggcctaacgatcgattcaggcaaccaataatttgcatgttgcatctacaaagccgggctgagctatatgcatctggctctacatataggaatccctcggtctccgtgatagggaaaataaattcgactcaaacccaaccccaagcggggaaaacaatggcaatggataaaaggtgaaaaatgttcccggtctatggcagcaggcccccatccaaaagccaactttgccccccaggaaaatatcagtgcgcacagcaactggctttaagcgctctgcccctccaaaaacgcggggaactcccccctggccctccccaaacccggcgtgatgcacggcgataatgggcacaacaacaacaacaacccatcccccgccgccaccgtcaagaacctcaggtgcctttgcaaaaacttcaaccccttggccaagtcaagccgcgacaatcccaagttcttcagtatccccctcttcgccgcgggtggttcgccttcaaacacaaacgccatcttgaccagcgcctccgcgtcgtcatccgcgcagttggtcttggccacctccttcgcgtggcattcaacggcttcgtgctgcgcggcacaggcgggcggaagaggagggctccacgacccgaattcgaacttctccggcgacgccccccgggaagcgttgacaggacaacngagccctcaagcccgaacgg

SEQ ID NO: 22530 - DNA, 755 bp, Zea mays
  misc_feature: Ceres CLONE 1392315-F
  misc_feature (235)..(235): n is a, c, t, g, unknown, or other
  misc_feature (361)..(361): n is a, c, t, g, unknown, or other
  misc_feature (363)..(363): n is a, c, t, g, unknown, or other
  misc_feature (364)..(364): n is a, c, t, g, unknown, or other
  misc_feature (370)..(370): n is a, c, t, g, unknown, or other
  misc_feature (445)..(445): n is a, c, t, g, unknown, or other
  misc_feature (466)..(466): n is a, c, t, g, unknown, or other
aaagctggagctccccgcggtggcggccgctctagaatagtggatcccccgggctgcaggaattcgcacgagaccattacctagaacatcctaatcgaaaaagtttcgacagtcgtcgtcccctctactctcccggcttccgcagaatcccagcttctctggccctctcactccaaacatcgggctccaggccgtctcccgccaacccaaattcgcttcccgccgctccccattnaacccgcttgaaaggtcgcgccctcgagcagagcaacccccctgacacaatccgatccgtagcccgcgtgcctcgatttcgtctcttcccctctgctcgagtacgagcggctactcccggcggcgncnngcgcgncggcgatgagcgcggtgaactccaacatatcagggagctgatcaggtggggaacagactacatcctcaaaacttncaatcatctgctgacacaatnaacggattgcccctcagggggggggaggtgacacctcttaagggagcagtcaccttaaggacaatacgggttgggaggaaaccaagggcactccaataaaaaagggcccggccccggggggcgcttttggcccaaattaaggcttaaaaagggggtggccctgggttaccttttccaaagggggcaggggaaaaaaaaaccgatccccaaaaatttttaaaagggagaaaaaccccttaaaaaatttgggaggggtggggggggggaaaaaaacacccccaaggggttt

SEQ ID NO: 22531 - DNA, 757 bp, Zea mays
  misc_feature: Ceres CLONE 1392317-F
  misc_feature: Translation starting site: 261
  misc_feature (290)..(290): n is a, c, t, g, unknown, or other
  misc_feature (368)..(368): n is a, c, t, g, unknown, or other
  misc_feature (371)..(371): n is a, c, t, g, unknown, or other
  misc_feature (372)..(372): n is a, c, t, g, unknown, or other
  misc_feature (397)..(397): n is a, c, t, g, unknown, or other
  misc_feature (399)..(399): n is a, c, t, g, unknown, or other
  misc_feature (415)..(415): n is a, c, t, g, unknown, or other
  misc_feature (460)..(460): n is a, c, t, g, unknown, or other
  misc_feature (516)..(516): n is a, c, t, g, unknown, or other
aaagctggagctccccgcggtggcggccgctctagaactagtggatcccccgggctgcaggaattcgcacgagaccattacctagaacatcctaatcgaaaaacgaaacccacccgcatttcccctgtgcagctgtgctggccaagtcgtctggactctggactctggagcctgtctgcccgtcccggttcagcttgctcgcctcgcttatgagttctgagctgtgacaagaactcaggaggtggttgacgggtgaagcgatggtggggagctacgcgaacggtggcggngctgcgccggcggcggtagcggcggagaagctcgacgagctgcggctgctgctggggaagtcggacgcgacacgctgncgnntcgtcggggtgggcgcccaggcgtngnggaagcgtgttctgcncgcttttgcaggacgcgtacggccggcaccgcgacccggtgcagntggcgcgtggtggcccccccgccgggcgcgccgtaaaccgcgccgacgccgagcgnccttctcgaggtcatcaactccccgcgaggacgtggcttgcgccggttcatccgccgctggcgcctacctcaagtacgtcgaggcggcgcttcggggaccggacgctgcaacgccgaacaagatcctccggggacggttttctgcctcaacatggtcgacaccccggtctgcccggttcaaggtgtcaacaacctggagggagggccgtttgggaccccaacataattataaaccgcctgg

SEQ ID NO: 22532 - DNA, 718 bp, Zea mays
  misc_feature: Ceres CLONE 1392318-F
  misc_feature: Encodes the peptide sequence at SEQ ID NO. 22533
  misc_feature (530)..(530): n is a, c, t, g, unknown, or other
  misc_feature (576)..(576): n is a, c, t, g, unknown, or other
  misc_feature (632)..(632): n is a, c, t, g, unknown, or other
  misc_feature (646)..(646): n is a, c, t, g, unknown, or other
  misc_feature (655)..(655): n is a, c, t, g, unknown, or other
  misc_feature (664)..(664): n is a, c, t, g, unknown, or other
aaagctggagctccccgcggtggcggccgctctagaactagtggatcccccgggctgcaggaattcgcacgagaccattacctagaacatcctaattgaaaaagaccacacaccacagcactaaaatctgttcatctctggctccccaaattcagctggagagcactttttcccatcatggataagaactacggtgaactctacaacatcctcggatggggtgaggagtacttcgcggtgaacacggaggggcacctcagcgtgaagcctttcggccgctggacggagcccgggcaggagatcgacgtgcactcggtcatcgtggaagctctagcgacccaacccaacgacagcaccagcaaatctcagttccccatgatccttcgcttccccgacgtgctcaagaaccgtatcgagacgctccataacgcattcaacagcgccatggagtccaccgggtacacgtccaggtaccaaggcgtgttcccgatcaaggtgaaccagaacaagcacgtcgtgcaggacatggnttaggttcggccagcaatggaactatggggctcgaggctggctccnagccagaaactgctcatcgcatgagctgcctccccgtcaccgaagcgagccccagncgtacttgatctgncacgctacnaggacgcgnactacatcgcgtcgcgtttttcggggcggggccatgggctgaacccatctcgtg

SEQ ID NO: 22533 - protein, 117 aa, Zea mays
  misc_feature: Ceres CLONE 1392318-F
  misc_feature: SWISSPROT Homolog: EC 4.1.1.19 Arginine decarboxylase
MDKNYGELYNILGWGEEYFAVNTEGHLSVKPFGRWTEPGQEIDVHSVIVEALATQPNDSTSKSQFPMILRFPDVLKNRIETLHNAFNSAMESTGYTSRYQGVFPIKVNQNKHVVQDM

SEQ ID NO: 22534 - DNA, 776 bp, Zea mays
  misc_feature: Ceres CLONE 1392319-F
  misc_feature: Translation starting site: 199
  misc_feature: Pfam Name: Ribosomal_S6e Pfam Description: Ribosomal protein S6e
  misc_feature (414)..(414): n is a, c, t, g, unknown, or other
  misc_feature (486)..(486): n is a, c, t, g, unknown, or other
  misc_feature (557)..(557): n is a, c, t, g, unknown, or other
  misc_feature (613)..(613): n is a, c, t, g, unknown, or other
  misc_feature (614)..(614): n is a, c, t, g, unknown, or other
  misc_feature (627)..(627): n is a, c, t, g, unknown, or other
  misc_feature (726)..(726): n is a, c, t, g, unknown, or other
  misc_feature (734)..(734): n is a, c, t, g, unknown, or other
  misc_feature (736)..(736): n is a, c, t, g, unknown, or other
  misc_feature (744)..(744): n is a, c, t, g, unknown, or other
caaagctggagctccccgcggtggcggccgctctagaactagtggatcccccgggctgcaggaattcgcacgagaccattacctagaacatcctaatcgaaaactctcgtccaaaaccctagcccttgcgccgccgcctcctccgccacccagggctcgagctcctcgcgtcctgcgagcgcgcgccgcaacgccaccatgaagttcaacatcgcgaacccttccaccgggtgccaaaagaagctggaaatcgatgacgaccagaagctgcgtgccttttatgaccgaaggatatcccaggaggtcagtggtgatgctctgggtgaggagttcaagggttatgtcttcaagatcatggggtggatgtgacaagcaaggcttcccaatgaagcaaggagttttgactttctgggncgtgttcgtcttctgctccataggggcactcccctgctttccgtgggtatgggcaggcgtaatggtgagcgncaggaaggaagtccttgtcccgtggtttgcatcgtgagccaaagacctatctgttatcaaccttggtgaanttgggaaagaagggtggaaaatggatctgccctggtctgactgacctgaaaacccnnggggatggggggntcccaggagggcctcaaggaaaaagaaaaggtgtcacctttaaccagggggtggagggggttcccgaggtacgggaaaacactaccgggaggactttcnttaccaananagcggaanagggccaaagcttcccttatttaagggcaccc

SEQ ID NO: 22535 - DNA, 713 bp, Zea mays
  misc_feature: Ceres CLONE 1392321-F
  misc_feature: Encodes the peptide sequence at SEQ ID NO. 22536
  misc_feature (371)..(371): n is a, c, t, g, unknown, or other
  misc_feature (372)..(372): n is a, c, t, g, unknown, or other
  misc_feature (578)..(578): n is a, c, t, g, unknown, or other
  misc_feature (579)..(579): n is a, c, t, g, unknown, or other
aagctggagctccccgcggtggcggccgcgccagattaaagccacccccgggctgcaggaatttacacgagaccattacggagaacatcctaatcgaaaaacggtccaccgacgactcttcttcctcacctcctcccgctccagctccagctcgtctctctcctcgcctcgcgtagggtttcgcttcccgtctcgccgccgtcagcatgggggacaactacgatgacgaaggcgagccgatcgtgaacctcgacgaacgggaaccctcccctgagcatcagccgtacgaagacctcgatgacgacctcgacggcggcggcgattggacccgcgaccgctctccgacccccgtccacggcgactacggcgtnncagggtccgcgggaagccccgaaagcgccttctcaagaagggcggcggtggaggcatgcccggcgatgacgggctggatgactttgggttggaggacgaggacgcggacccttcggctgaggcgaggaagaggaagggctcgtcgtcgctgagggacctcgcgaggggcggggcgggcagggagaaaaaggctaaaaaatgggagnncaaggaccacgggaaggggagggacactgcgaatggtgagggataggccggggatcaggaggaaggggactcaggcggtagggatgaaccagggatgatgggggaggaggggagacccaaggagctcttgggaa

SEQ ID NO: 22536 - protein, 65 aa, Zea mays
  misc_feature: Ceres CLONE 1392321-F
  misc_feature (51)..(51): Xaa is any aa, unknown, or other
MPGDDGLDDFGLEDEDADPSAEARKRKGSSSLRDLARGGAGREKKAKKWEXKDHGKGRDTANGEG

SEQ ID NO: 22537 - DNA, 707 bp, Zea mays
  misc_feature: Ceres CLONE 1392322-F
  misc_feature: Encodes the peptide sequence at SEQ ID NO. 22538
  misc_feature (338)..(338): n is a, c, t, g, unknown, or other
  misc_feature (432)..(432): n is a, c, t, g, unknown, or other
  misc_feature (580)..(580): n is a, c, t, g, unknown, or other
  misc_feature (588)..(588): n is a, c, t, g, unknown, or other
aagctggagctccccgcggtggcggccgctctagaactagtggatcccccgggctgcaggaattcgcacgagaccattacctagaacatcctaatcgaaaaaatctgaagcaaaatgtaccgggaatgttgaagagcgggactcttaagcagtagtgagatgcggcggtggtggtcgccggcgttggcggctgtggagccgcggtccgtgcagctcctgctcctgggcgtcgctctcgtcgcagcttctttctacgccggcaccctcttcggctcctccgcgtcccctgcgctcgtactgcccccttcgcgcccccgatcgcccgattccttcagggncaaagatattccagtgtttaccaacagagtttctcgtacgtaccgggcaaaatcagtgacagttccagatcacggagttgatgtgtgtcctttnggatacaatgagtatgtcccctgccatgatggagcctatataagcagcttggagagcctggatacatctaggcatgaggatcttgaaagtatttgtcctccatgggagaagcggttgttttgttttgtgcccccctccaatgactacnagataccnataagatgggcaacaagccgagactacgtatggcgtagtaatggcaaccatcacatcttgctgaggtcaaaggaggacagaactgggtgcatgagaagggcaactttgggggtttcccg

SEQ ID NO: 22538 - protein, 182 aa, Zea mays
  misc_feature: Ceres CLONE 1392322-F
  misc_feature (60)..(60): Xaa is any aa, unknown, or other
  misc_feature (91)..(91): Xaa is any aa, unknown, or other
  misc_feature (141)..(141): Xaa is any aa, unknown, or other
MRRWWSPALAAVEPRSVQLLLLGVALVAASFYAGTLFGSSASPALVLPPSRPRSPDSFRXKDIPVFTNRVSRTYRAKSVTVPDHGVDVCPXGYNEYVPCHDGAYISSLESLDTSRHEDLESICPPWEKRLFCFVPPSNDYXIPIRWATSRDYVWRSNGNHHILLRSKEDRTGCMRRATLGVS

SEQ ID NO: 22539 - DNA, 695 bp, Zea mays
  misc_feature: Ceres CLONE 1392324-F
  misc_feature: Encodes the peptide sequence at SEQ ID NO. 22540
  misc_feature (448)..(448): n is a, c, t, g, unknown, or other
aaagctggagctccccgcggtggcggccgctctagaactagtggatcccccgggctgcaggaattcgcacgagaccattacctagaacatcctaatcgaaaaacgcctcccaacctcctctgctctcccccacctcccggtccggcagcagagagcgggggtgcagagagatcgagatccggaggccgcgactgggagcgccaccaccagcgactgcggcaatggcggccacggtgacggtcccggggtcgtcgaccccctccacgccgctgctcaaggacgagctcgacatcgtgatcccgacgatccgcaacctcgacttcctggagatgtggtgccccttcttccagccctaccacctcatcatcgtgcaggacggcgacccgaccaagaccatcaaggtgcccgagggcttcgactacgagctctacaaccgcaacgacatcantcgcatcctcggggcccaggactcctgcatctccttctaggactccgcctgctgctgcttcggctacatggtctccaaggaagagtacatctacaccatcgacgacgactgcttcgttggctgggacccatctggcaaggatatcaatgctcttgagcagcacatcaagaaccctctcagccagtcacccggtctctcacacctgacgaccctacgtgagggctgactggtggtgatacctcgcctc

SEQ ID NO: 22540 - protein, 88 aa, Zea mays
  misc_feature: Ceres CLONE 1392324-F
  misc_feature (76)..(76): Xaa is any aa, unknown, or other
MAATVTVPGSSTPSTPLLKDELDIVIPTIRNLDFLEMWCPFFQPYHLIIVQDGDPTKTIKVPEGFDYELYNRNDIXRILGAQDSCISF

SEQ ID NO: 22541 - DNA, 729 bp, Zea mays
  misc_feature: Ceres CLONE 1392326-F
  misc_feature: Encodes the peptide sequence at SEQ ID NO. 22542
  misc_feature (282)..(282): n is a, c, t, g, unknown, or other
  misc_feature (283)..(283): n is a, c, t, g, unknown, or other
  misc_feature (327)..(327): n is a, c, t, g, unknown, or other
  misc_feature (476)..(476): n is a, c, t, g, unknown, or other
aagctggagctccccgcggtggcggccgctctagaactagtggatcccccgggctgcaggaattcgcacgagaccattacctagaacatcctaatcgaaaactcgtgttcttgttcgtctccgcctcaggcaactccacacggtcacacctcgctcgctctcgctcccgtatcgcggtttccttttcgaagccttgctaggggttagctgggcctctgtctatccctgtcatggccccttagggcgctgtacttcagacttcagaggtgacgtgaggcgtgnngacgcgcgtagctggatgggtcgaggaggcggggatggacccgnacttctcggccggcgaggtggggccccgagctttggagtcggctttcactcggtcaacttctctgagcgggtgttgcaaatcgagatcgtcgctggggatgacgccctcggggccaagggcgccaccggcgaggggtgctcatctcttngcgactgggcgggcaacgcaagcgacgacgggaggagtccgaccccacaaagaatctagaaaatacttggcaaatccagcaaactgaaaagttaaaccttaagaatgggatgcctcacaagggaggcaaaggggccctgtacttattaaaaaaaaaacccccgcccgagatttgggcaaaatgggggaggatggaaaaaacccccgcctccatactgggggggtggaggggcacctccggtttttgaagataa

SEQ ID NO: 22542 - protein, 78 aa, Zea mays
  misc_feature: Ceres CLONE 1392326-F
  misc_feature (10)..(10): Xaa is any aa, unknown, or other
  misc_feature (60)..(60): Xaa is any aa, unknown, or other
MGRGGGDGPXLLGRRGGAPSFGVGFHSVNFSERVLQIEIVAGDDALGAKGATGEGCSSLXDWAGNASDDGRSPTPQRI

SEQ ID NO: 22543 - DNA, 655 bp, Zea mays
  misc_feature: Ceres CLONE 1392329-F
  misc_feature: Encodes the peptide sequence at SEQ ID NO. 22544
aaactggagctccccgcggtggcggccgctctagaactagtggatcccccgggctgcaggaattcgcacgagaccattacctagaacatcctaatcgaaaactacatcctcggtcagtgctcagtagtcatttgtgtccattgccgctctgctttgtgctcgctctgtttgtttgttgtcgactccattgacggccgctgatacttacatggttgatggttcagcgaacgagtgctgcgagaggctggcttactatggcatgagcaccaacctggtgaactacatgaagacccgacttggccaggtgaactccgttgcctccaacaacgtcaccaactggcaagggacgtgctacatcacgccgctcatcggcgccttcttcgccgacgcgtacatggggaggttctggaccatcgccatcttcatgatcatctacattttcggcctggcgctgctgacgatggcttcgtcggtgaaggggctggtgcctacgtcgtgcggcgacaaggatgtgtgccacccgacggacgcgcaggcggcggtggtgttcgtggcgctgtacctcatcgcgctgggcacgggcgggatcaagccgtgcgtgtcctccttcggcgccgaccagttcgacgagaacgacgagcgggagaagaagagc

SEQ ID NO: 22544 - protein, 149 aa, Zea mays
  misc_feature: Ceres CLONE 1392329-F
  misc_feature: Functional homolog of the protein sequence given in SEQ ID NO 96879
  misc_feature: Useful for making plants with altered carbon content
  misc_feature: Useful for making plants with altered nitrogen content
MVDGSANECCERLAYYGMSTNLVNYMKTRLGQVNSVASNNVTNWQGTCYITPLIGAFFADAYMGRFWTIAIFMIIYIFGLALLTMASSVKGLVPTSCGDKDVCHPTDAQAAVVFVALYLIALGTGGIKPCVSSFGADQFDENDEREKKS

SEQ ID NO: 22545 - DNA, 719 bp, Zea mays
  misc_feature: Ceres CLONE 1392334-F
  misc_feature: Encodes the peptide sequence at SEQ ID NO. 22546
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (24)..(24): n is a, c, t, g, unknown, or other
  misc_feature (26)..(26): n is a, c, t, g, unknown, or other
  misc_feature (28)..(28): n is a, c, t, g, unknown, or other
  misc_feature (31)..(31): n is a, c, t, g, unknown, or other
gtggggggggggccccccnnntcntntnttntcggtcctctcgtcccccgcgtttttaaaaaaatgcagctccccgcggtggcggccgctctagaactagtggatcccccgggctgcaggaattcgcacgagaccattacctagaacatcctaatcgaaaaagggccggacgacggggacagacagcggtgtcgcgggggcacctgcttcccaacgccgtccgcacctgctgccctgtcgtccgccctccttcccttctcctcccctccaactgtttcctcaacctcccgacccaaccacggccgtgcccgccaaggcgccaaccgcacagtatcgctgtctcttggacattgcagcagcagctggggtgctgacgtgctgtgggtggttctgttgtccatggcgcggaagcatcagcatgttgccatatttaccacagcgtgcttgccgtggatgactgggactgcgccaaacccactgtttcgggctgcataccttgccaagggtggagattgggaggtcacgctggtggtgccttggctgccccagggggatcaggagctcggttatccaaacaagatgaggttcagttttgccggcaggagcaggaaaactatgccgcggcggtcggtttgagggaacggactggggctggtggccgaaattttggacataaaagtttctatccctggggaaagtttttccaaactggaaaaaag

SEQ ID NO: 22546 - protein, 78 aa, Zea mays
  misc_feature: Ceres CLONE 1392334-F
  misc_feature: SWISSPROT Homolog: EC 2.4.1.241 Digalactosyldiacylglycerol synthase
MARKHQHVAIFTTACLPWMTGTAPNPLFRAAYLAKGGDWEVTLVVPWLPQGDQELGYPNKMRFSFAGRSRKTMPRRSV

SEQ ID NO: 22547 - DNA, 654 bp, Zea mays
  misc_feature: Ceres CLONE 1392336-F
  misc_feature: Encodes the peptide sequence at SEQ ID NO. 22548
  misc_feature (615)..(615): n is a, c, t, g, unknown, or other
ggagctcaccgcggtggcggccgctctataactagtggatcccccgggctgcaggaattcgcacgagaccattacctagaacatcctaaaaaaaatcttatttcactgccagccctctgaaaaaaaaattaaaaaatgaggtcccagttccacccacctagagagccaaaagagccggcggtggccggcagccaaaacccacgttggattttgccgccgccgcctggagctaggggacaaggcaacgccggccggtgcaacatttatgcgtgtaccaggcagaccagcccggcagccacgcgtacacttctgccgcaaagctaaacgcgccactccgcggcaagctgctctgctgctcccaccagccaccgcaccgagtgccaatggcgactgcagcgagttcgacgccggcggcgcggcagcctactctggtctgcgcgtcactgaccgcgcgggtgccccgggagatggcagcggaggttgccgccgctgcggcgctcggtgccgacgtggcggagctccaggtcggctgcctcgacagcttcgagccatgcagggacctgcccgtgcttctcgcccagccccgctcgctccccgtcatcgtcacctacaggnccgaattgggagggaggccagtacgcaggcgaagatgag

SEQ ID NO: 22548 - protein, 89 aa, Zea mays
  misc_feature: Ceres CLONE 1392336-F
  misc_feature (78)..(78): Xaa is any aa, unknown, or other
MATAASSTPAARQPTLVCASLTARVPREMAAEVAAAAALGADVAELQVGCLDSFEPCRDLPVLLAQPRSLPVIVTYRXELGGRPVRRRR

SEQ ID NO: 22549 - DNA, 573 bp, Zea mays
  misc_feature: Ceres CLONE 1392337-F
  misc_feature: Encodes the peptide sequence at SEQ ID NO. 22550
  misc_feature (546)..(546): n is a, c, t, g, unknown, or other
tccccgcggtggcggccgctctagaactagtggatcccccgggctgcaggaattcgcacgagaccattacctagaacatcctaatcgaaaacttctgccattccgccgaacaccttccccaatcgtgcgcctccggccatgggggaagcctccgacgcggcggtagccgtatctgcgcggctcctggagctggcggccgaagacgactctgcagcgctcggtgacctccttgcggcacacccgtcgcttgctgacgagcccgcgccgtggtactccccggcgcgcggcgcggagcctatgaccccgctcatggtcgcggcggcgtacgggtccgtggcctgcatcgatgtcctactctctccgccccaccagaccgaccccaaccgcgcctcaccgtcgtccctctccaccgcgcttcatcttgcaggcggcggcggcgcctccgctgcgcccgctgcggtatcccgtctcctagctgctggcgccgacccacgttggtcgaccacctcatcggcgaccgtccgacgtcgtcaccctccacccaantcgctcccggtcaggaaccacttctcc

SEQ ID NO: 22550 - protein, 145 aa, Zea mays
  misc_feature: Ceres CLONE 1392337-F
  misc_feature (136)..(136): Xaa is any aa, unknown, or other
MGEASDAAVAVSARLLELAAEDDSAALGDLLAAHPSLADEPAPWYSPARGAEPMTPLMVAAAYGSVACIDVLLSPPHQTDPNRASPSSLSTALHLAGGGGASAAPAAVSRLLAAGADPRWSTTSSATVRRRHPPPXSLPVRNHFS

SEQ ID NO: 22551 - DNA, 733 bp, Zea mays
  misc_feature: Ceres CLONE 1392353-F
  misc_feature: Encodes the peptide sequence at SEQ ID NO. 22552
  misc_feature (33)..(33): n is a, c, t, g, unknown, or other
  misc_feature (35)..(35): n is a, c, t, g, unknown, or other
  misc_feature (41)..(41): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (733)..(733): n is a, c, t, g, unknown, or other
ttttgtgggtttcccccccccccccccccaccntnccctanaagagaannncaaaattggagctcaccgcggtggcggccgctctagaactagtggatcccccgggctgcaggaattcgcacgagaccattacctagaacatcctaatcgaaaaataaagattactcatagattaaagtagggtttggacgtctgcctgtccatttcggcgtctgttcttagcggccgacaagcggaatctggatcaagtcccctgcttcaacccatcccctctcatcgattcattgccacaaggcagctgattgctcacagcgttggatgtgagaattggattcggacccaccgatcgatatgccgttcggccacacgcggctcgatgtccggcgtccgccgcagtcgtcctacctctgctgctccacaaccaccgtcgccgtattcgtcgcgctctgcctggtggctgtgtggatggcgtcgtccatgctcgtcacccctgccgagttccctccatttcagtccaaagtgcgtccactgaggcctcatgactctcctcctgccaccggaaacttaaccagtgctgaatcagggcgatggcatcacccacccatgatgatccaccacctggttacaccaacaattgccctcctgtaaacggaaagccatgggatgcgtgaaaaatccagccaaccaagaaactttttcccctacacagagcgggggggacccttgggtccan

SEQ ID NO: 22552 - protein, 98 aa, Zea mays
  misc_feature: Ceres CLONE 1392353-F
MPFGHTRLDVRRPPQSSYLCCSTTTVAVFVALCLVAVWMASSMLVTPAEFPPFQSKVRPLRPHDSPPATGNLTSAESGRWHHPPMMIHHLVTPTIALL

SEQ ID NO: 22553 - DNA, 637 bp, Zea mays
  misc_feature: Ceres CLONE 1392356-F
  misc_feature: Pfam Name: Spc97_Spc98 Pfam Description: Spc97 / Spc98 family
  misc_feature (637)..(637): n is a, c, t, g, unknown, or other
ggtggcggccgctctagaactagtggatcccccgggctgcaggaattcatcactccccttgacctggaatctcctaatcagataatctttatactgatttcaacctgtctcaatgaacgcgctctctgactacccgagtgcgactactcctcaaaattgcgtactgcaaattggacttcttgataacctcttctcatatgccctcgatccctcacatataagcacgagctccatattgatctatgctcctatgtaactgcatgcaaaacttcatgatgatatccagtatgctaaaaactgatcctacgaccctgatggatagctacatcagtgttgaccaaaattcttgatgatcattctatagctctgtataaccatgagtatcttgctcgtgtacactgtctgaccttccactgagtagtcttttacgtccacctgaaggcaaaaactgatgactctgcacactagaatgtgatattgtcccttactcgccacaaagacttagaccaatggcgacgcatgtatgctccacaaatatatttccgaaccttgatacaatcataaatatcatgatgatcgttatgcattacacctacccattatatctctgggtccattagggttctcttcaatcttn

SEQ ID NO: 22554 - DNA, 626 bp, Zea mays
  misc_feature: Ceres CLONE 1392358-F
  misc_feature: Encodes the peptide sequence at SEQ ID NO. 22555
  misc_feature (626)..(626): n is a, c, t, g, unknown, or other
gctctagaactagtggatcccccgggctgcaggaattcgcacgagaccattacctagaacatcctaatcgaaaaaaagcaccacgcacgatcgccttcgccaaccgcgccgctctctctctctttctctctcgcacgagccgcgccggcgccgccaccacgcgcgcgggagacagagaccacagccgcagccaccgacgggcggaataggaatggtggcgccggggggaggagcaggaggaggtccgttgcggtggccggcggcggaggagcttgacactgtacggaagaaggtggtggagattagtggaagggatgaacaagaggttatggttgctgcttgcccctacagaatttgccctttgggggctcatattgatcatcagggtggagtagtcacagctatgaccataaattatggagtactccttggtttcgttccctctaatggttctgagcaacctttatttttctttcaggttttacttcattctggtcagtttgaaggtgctataagattcagagttgatgacttgcaaaagcctattgataaacctgagaacataaactggggaagttatgcaaaaggtgctgttagtgcactgcagaatagtggatatgatctan

SEQ ID NO: 22555 - protein, 138 aa, Zea mays
  misc_feature: Ceres CLONE 1392358-F
  misc_feature: SWISSPROT Homolog: EC 2.7.1.6 Galactokinase
MVAPGGGAGGGPLRWPAAEELDTVRKKVVEISGRDEQEVMVAACPYRICPLGAHIDHQGGVVTAMTINYGVLLGFVPSNGSEQPLFFFQVLLHSGQFEGAIRFRVDDLQKPIDKPENINWGSYAKGAVSALQNSGYDL

SEQ ID NO: 22556 - DNA, 751 bp, Zea mays
  misc_feature: Ceres CLONE 1392359-F
  misc_feature: Encodes the peptide sequence at SEQ ID NO. 22557
  misc_feature (13)..(13): n is a, c, t, g, unknown, or other
  misc_feature (23)..(23): n is a, c, t, g, unknown, or other
  misc_feature (37)..(37): n is a, c, t, g, unknown, or other
  misc_feature (39)..(39): n is a, c, t, g, unknown, or other
  misc_feature (41)..(41): n is a, c, t, g, unknown, or other
  misc_feature (53)..(53): n is a, c, t, g, unknown, or other
  misc_feature (751)..(751): n is a, c, t, g, unknown, or other
ggggggggggggntccccccccncccgcccgccgggntngntggggcgacccncccacacatggagctccccgcggtggcggccgctctagaatagtggatcccccgggctgcaggaattcgcacgagaccattacctagaacatcctaatcgaaaactctttcccaccgccttcttccactactcttcaccctcccctcctccccatcgcgaactcacaagagaaccaagtagacgagggagaaggagatggcgaagaagaaggagaaggcggtgaacgtgtcgggcaagccgcggcactcgaacgacgtcaaccgccccaatgacaagaagggcgcgggcggcggcgccggtggcgggagccggtccgcggctaccgtgcggcggctcaagatgtacaagacgcggcccaagagggaccgcgccgggaaggtgctcaggaacgatttccagtctaaagagctccccaacacccgcatcgagcccgaccgccggtggttcggcaatactcgcgttgtgggccagccacagcttgaaatgttccgggaggaactccagagtccggctttccgacaacttcagtggtatccctgaaagaacggaaagctgcccacttatcgctccctgcaaagatccattcaaaaagccaagcggaaagggcacattcctggcttggaaagcttgggaacccttttcggaaggcatggcttttttgaaggccccaaaagggggccaaaaggaggcgaaaaan

SEQ ID NO: 22557 - protein, 114 aa, Zea mays
  misc_feature: Ceres CLONE 1392359-F
  misc_feature (49)..(113): Pfam Name: NGP1NT Pfam Description: NGP1NT (NUC091) domain
MAKKKEKAVNVSGKPRHSNDVNRPNDKKGAGGGAGGGSRSAATVRRLKMYKTRPKRDRAGKVLRNDFQSKELPNTRIEPDRRWFGNTRVVGQPQLEMFREELQSPAFRQLQWYP

SEQ ID NO: 22558 - DNA, 662 bp, Zea mays
  misc_feature: Ceres CLONE 1392365-F
  misc_feature: Encodes the peptide sequence at SEQ ID NO. 22559
  misc_feature (371)..(371): n is a, c, t, g, unknown, or other
  misc_feature (398)..(398): n is a, c, t, g, unknown, or other
  misc_feature (473)..(473): n is a, c, t, g, unknown, or other
aaagctggagctccccgcggtggcggccgctctagaactagtggatcccccgggctgcaggaattcgcacgagaccattacctagaacatcctaaaaaaaaaaaacccccgtcctcctcgccgctccgccgcgcggttgagcgccgacgagcgagcccaccgctgcctcgtccgccctatggatatggatgtccgccgcagggttccaccgccgcacgggagcgtccctaggcgccagcaggcgaccggggccgagtgggagcgggtgcgtgtgcaggcggatgatgcgctaccgctgccgatccggcacacgaacctcatcttctcggcgctgttcgccgcgtcgctggtgacttgaatgcgtcggtggncgggggaagatccgcgcctccacgccngctccacgtggtctccccccgccgagatcttcgccatctgcggcctcgtcgcgtcgctcatctacctcctcagcnttcttcgggatcgccttcgtgcaggccgtcgtctccagcagcgacgacgacgaggacttcatcgtcgactccgacacggggcgggcgcgggcgtcgccgacgcctgtttatacctcgtgggagttgctggggagccccgccgaccggacggaagaaatggcggaggcccatggaggaatgggtgccccc

SEQ ID NO: 22559 - protein, 59 aa, Zea mays
  misc_feature: Ceres CLONE 1392365-F
  misc_feature: SWISSPROT Homolog: EC 1.1.1.34 Hydroxymethylglutaryl-CoA reductase (NADPH)
MDMDVRRRVPPPHGSVPRRQQATGAEWERVRVQADDALPLPIRHTNLIFSALFAASLVT

SEQ ID NO: 22560 - DNA, 669 bp, Zea mays
  misc_feature: Ceres CLONE 1392366-F
  misc_feature: Encodes the peptide sequence at SEQ ID NO. 22561
  misc_feature (444)..(444): n is a, c, t, g, unknown, or other
  misc_feature (502)..(502): n is a, c, t, g, unknown, or other
  misc_feature (511)..(511): n is a, c, t, g, unknown, or other
  misc_feature (513)..(513): n is a, c, t, g, unknown, or other
  misc_feature (577)..(577): n is a, c, t, g, unknown, or other
  misc_feature (646)..(646): n is a, c, t, g, unknown, or other
tggagctccccgcggtggcggccgctctagaactagtggatcccccgggctgcaggaattcgcacgagaccattacctagaacatcctaatcgaaaaaaatcgaattcgccatgggcatggctgctccgcgcgcgccgctgcctctcccccaactgctgctcctcctcgttgccgcgctcctcgccgccgctcccctccctagggcggccagggcggacgagttcgacgtccgccgccacctctccaccgtcaccaggtatgatgtggccagggagtccagtagtgtcatctccatgccgtcaatcccagacgggtgccgtgtcattcacctcaatttagtggcaagacatgggactcgcgctcctaccaagaagcgcatcaaggagctggattagattggcagttcgactggaagcccttctgaaagaggcaaatcaggtccnttgatagtgattctctgaagaaaattccatcctggattaaaggctgggaatcacgctnggaagggangnactaaaaggtggtgagctggattagtggagggggaaagaggagctttacatttaagctacagangggggggggggaaggtttcaagattctattttgatgacgaatatccacccctgatgtatattcaatagnaagcaacccagggttctcgagca

SEQ ID NO: 22561 - protein, 94 aa, Zea mays
  misc_feature: Ceres CLONE 1392366-F
MGMAAPRAPLPLPQLLLLLVAALLAAAPLPRAARADEFDVRRHLSTVTRYDVARESSSVISMPSIPDGCRVIHLNLVARHGTRAPTKKRIKELD

SEQ ID NO: 22562 - DNA, 756 bp, Zea mays
  misc_feature: Ceres CLONE 1392367-F
  misc_feature: Encodes the peptide sequence at SEQ ID NO. 22563
  misc_feature (358)..(358): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (411)..(411): n is a, c, t, g, unknown, or other
  misc_feature (413)..(413): n is a, c, t, g, unknown, or other
  misc_feature (450)..(450): n is a, c, t, g, unknown, or other
  misc_feature (456)..(456): n is a, c, t, g, unknown, or other
  misc_feature (503)..(503): n is a, c, t, g, unknown, or other
  misc_feature (516)..(516): n is a, c, t, g, unknown, or other
  misc_feature (531)..(531): n is a, c, t, g, unknown, or other
  misc_feature (547)..(547): n is a, c, t, g, unknown, or other
  misc_feature (568)..(568): n is a, c, t, g, unknown, or other
  misc_feature (603)..(603): n is a, c, t, g, unknown, or other
  misc_feature (668)..(668): n is a, c, t, g, unknown, or other
  misc_feature (670)..(670): n is a, c, t, g, unknown, or other
  misc_feature (671)..(671): n is a, c, t, g, unknown, or other
aagctggagctccccgcggtggcggccgctctagaactagtggatcccccgggctgcaggaattcgcacgagaccattacctagaacatcctaatcgaaaaaaaataggaaacgagcaaaggtctggcgagctacctaccaataaactaccatctccacaaacaggctagcacgtagctatatgccagaactgacctagtagaggatcgatcgcagatggtgtttcctgccatcctccccaaggtggccgcacgagggctcttcacgttctaccgcgccgccagaaagctcaggcgccacgccttccagctctactaccgcaacacgccgcccaagcggttcgtccgccgtctcgagnaannnaagggcggggggccggcggccactggtcactggcccgccgccgccttncnaggacccggcgccgccatcccctggacggccggcggncccggnacccggttggtggtgccgacaatggcacgggcggcccttggggtgcngctccccaccgcnggctcttcccctacnttcatgctcggggggncccggggggaggggggcgggnaggccccccgcccgggggccaaggggggggtgggnactggcgccttccccccccacagacgggggccgcccccggagaaaccccccccgggggggccggnannacccggggggggaagggggaaccccccccacccagccggggggggaaccagggcccccagggggacgggggaacccccgggggcg

SEQ ID NO: 22563 - protein, 180 aa, Zea mays
  misc_feature: Ceres CLONE 1392367-F
  misc_feature (48)..(48): Xaa is any aa, unknown, or other
  misc_feature (49)..(49): Xaa is any aa, unknown, or other
  misc_feature (65)..(65): Xaa is any aa, unknown, or other
  misc_feature (66)..(66): Xaa is any aa, unknown, or other
  misc_feature (96)..(96): Xaa is any aa, unknown, or other
  misc_feature (111)..(111): Xaa is any aa, unknown, or other
  misc_feature (118)..(118): Xaa is any aa, unknown, or other
  misc_feature (151)..(151): Xaa is any aa, unknown, or other
  misc_feature (152)..(152): Xaa is any aa, unknown, or other
MVFPAILPKVAARGLFTFYRAARKLRRHAFQLYYRNTPPKRFVRRLEXXKGGGPAATGHWPAAAXXGPGAAIPWTAGGPGTRLVVPTMARAALGVXLPTAGSSPTFMLGGXRGEGGGXAPRPGAKGGVGTGAFPPHRRGPPPEKPPPGGPXXPGGGRGNPPHPAGGGTRAPRGTGEPPGA

SEQ ID NO: 22564 - DNA, 660 bp, Zea mays
  misc_feature: Ceres CLONE 1392371-F
  misc_feature (270)..(270): n is a, c, t, g, unknown, or other
  misc_feature (273)..(273): n is a, c, t, g, unknown, or other
  misc_feature (283)..(283): n is a, c, t, g, unknown, or other
  misc_feature (284)..(284): n is a, c, t, g, unknown, or other
  misc_feature (287)..(287): n is a, c, t, g, unknown, or other
  misc_feature (288)..(288): n is a, c, t, g, unknown, or other
  misc_feature (292)..(292): n is a, c, t, g, unknown, or other
  misc_feature (318)..(318): n is a, c, t, g, unknown, or other
  misc_feature (328)..(328): n is a, c, t, g, unknown, or other
  misc_feature (358)..(358): n is a, c, t, g, unknown, or other
  misc_feature (400)..(400): n is a, c, t, g, unknown, or other
tggagctccccgcggtggcggccgctctagaactagtggatcccccgggctgcaggaattcgcacgagaccattacctagaacatcctaatcgaaaaatctctctcgctttctctagccatgacgctggtgaggatgccttgccgcctctgctgcttcctgctcgtcgtcgccgcctccgccgtctccgggcggggggcggggtggtcaccaccctcccgggctacgagggccgcctccccttcacctcgaaacaggtaatgggggaggntgnaccgagacgnncgnngcgnagctcttctactacttcgtccggggncgaggtcggnggccgacgacagcgacacccccggttcgtnctccggaattcccgggggggcaaagcttggtccggcctttancggcctcccctaaaaaaataaggccccatcatggttgcgcgggggaagccctaaaaaagggaggtttggccgggcctgggcttaaaaacccaaattcggggggaaaaaggggggggaaattttcttttttgggggatccccaggtgggggggccgggggttttctctcttcccaagaaggccccaagggttacacgcggtgtgggggggtataacccccggtgggacttgggggaaagtccctcaaaagaggggggccag

SEQ ID NO: 22565 - DNA, 664 bp, Zea mays
  misc_feature: Ceres CLONE 1392375-F
  misc_feature: Encodes the peptide sequence at SEQ ID NO. 22566
  misc_feature (403)..(403): n is a, c, t, g, unknown, or other
  misc_feature (404)..(404): n is a, c, t, g, unknown, or other
  misc_feature (502)..(502): n is a, c, t, g, unknown, or other
  misc_feature (516)..(516): n is a, c, t, g, unknown, or other
  misc_feature (565)..(565): n is a, c, t, g, unknown, or other
aaagctggagctccccgcggtggcggccgctctagaactagtggatcccccgggctgcaggaattcgcacgagaccattacctagtacatcctaatcgaaaaacctgccacatctggccatctctcagtctcacacgcgctgccatggacggatccatgtggtgcgctgccaactacgtgcctctgacgccgctcagcttcctggagcgcgccgcggtcgtgtacggcgaccgcgcggccgtcgtttgcggcgataggcggttctcgtggcgcgagacgagggagcggtgcctcgccggggcagccgctctcgctcgtctcggcgttggccgccgcgacgtggtcgcggtcatcgcctcgaacgtaccggcgatgtacgagctccatttcagcgtgccgatgnnaccggcgccgtcctgtgcacgctcaacacccgccacgacgcgggccaatgggtggtccgtcctgctgaaacactcgggaagcccaggtccttcctcgnggggagtcgcaggntcccacgcccgtgggcccgcgggacgcgctcagggctccctcgccgacngccaaaggacagggcttcctccttcgtccatccacggggtttcttgacccctaacaagcagccagccacccgggcgggcgggctggcggccaagcaaaa

SEQ ID NO: 22566 - protein, 155 aa, Zea mays
  misc_feature: Ceres CLONE 1392375-F
  misc_feature (87)..(87): Xaa is any aa, unknown, or other
  misc_feature (120)..(120): Xaa is any aa, unknown, or other
  misc_feature (141)..(141): Xaa is any aa, unknown, or other
MDGSMWCAANYVPLTPLSFLERAAVVYGDRAAVVCGDRRFSWRETRERCLAGAAALARLGVGRRDVVAVIASNVPAMYELHFSVPMXPAPSCARSTPATTRANGWSVLLKHSGSPGPSSXGVAGSHARGPAGRAQGSLADXQRTGLPPSSIHGVS

SEQ ID NO: 22567 - DNA, 674 bp, Zea mays
  misc_feature: Ceres CLONE 1392380-F
  misc_feature: Translation starting site: 276
  misc_feature: Pfam Name: Cu-oxidase_3 Pfam Description: Multicopper oxidase
  misc_feature (383)..(383): n is a, c, t, g, unknown, or other
  misc_feature (415)..(415): n is a, c, t, g, unknown, or other
  misc_feature (420)..(420): n is a, c, t, g, unknown, or other
  misc_feature (421)..(421): n is a, c, t, g, unknown, or other
  misc_feature (484)..(484): n is a, c, t, g, unknown, or other
  misc_feature (485)..(485): n is a, c, t, g, unknown, or other
  misc_feature (494)..(494): n is a, c, t, g, unknown, or other
  misc_feature (589)..(589): n is a, c, t, g, unknown, or other
tggagctccccgcggtggcggccgctctagaactagtggatcccccgggctgcaggaattcgcacgagaccattacctagaacatcctaatcgaaaaaattcgaagccttcccggttaccccttcggcctccacctatcaccacccgggacgtcttccatggcctcctcgtagtagaatagctctatctcaccgcaacaactcctcattacatcctttatgagaggctgatcgattggtagatacgtactcgggtggagcagaacaacgagagacatggcgacgacgacgcgtgttgccgccaccgccgccggcgtgctgctggtcctgtcggcgttggcgaccctggcgcgggccgaggacccgtacctggtcttcgagtgnaaggtgacgtacgggaccaagtccctgctggncgtgnncccagaaggtcatcctcatcaacggggaagtccccggccccaggatcaactgctcctccaaannaaaatgggngggggatggtttcaaccgggtcggacatccgttcctttcacccgggaaagggggtgcacaagggaaaaatctccgggggtggacgggaggccggnccccccgggggccaaacctggccaaaccatttttcgggaaagggggggccccagggacaaaaagggggattttttaaatccccgc

SEQ ID NO: 22568 - DNA, 586 bp, Zea mays
  misc_feature: Ceres CLONE 1392383-F
  misc_feature (96)..(96): n is a, c, t, g, unknown, or other
  misc_feature (207)..(207): n is a, c, t, g, unknown, or other
  misc_feature (252)..(252): n is a, c, t, g, unknown, or other
  misc_feature (279)..(279): n is a, c, t, g, unknown, or other
tggagctccccgcggtggcggccgctctagaactagtggatcccccgggctgcaggaattcgcacgagaccattacctagaacatcctaatcgaanaaattacataacggatcggaaggtgatgatccatcgatggagctgtgagctgagctgagctgagctcaccacaccacacacggagaagctatagctagcatagcaggcagncagtcagcgactaacagcagctagctggcatggtggcgtcctccngtcccaacgggaaggccgcggcctccngggagcctcccccgggggccaaaacaagaaaatacgggccccgggggtgggccccttaaggaaccgggttaaaaattttggtgtccaagccggaaaaaattttttcgggaggggggggggggaaacccagaaacgggggtgtccacaaaaattccgcccccccttccttttttttgggggggggggaccccccgggggggccctctttggggagggcccccccccttacgggggttttttacccgaaaatgcggggggaaaggggggaaagctccctttggggccaaaaaagggggggggggggggt

SEQ ID NO: 22569 - DNA, 652 bp, Zea mays
  misc_feature: Ceres CLONE 1392385-F
  misc_feature: Encodes the peptide sequence at SEQ ID NO. 22570
  misc_feature (592)..(592): n is a, c, t, g, unknown, or other
  misc_feature (641)..(641): n is a, c, t, g, unknown, or other
aaagctggagctccccgcggtggcggccgctctagaactagtggatcccccgggctgcaggaattcgcacgagaccattacctagaacatcctaatcgaaaacccctcgtctcgtcgccgactactaaaatggttgcgctcgtgagactcctccgcaacagtcggagcagccatgcccacgtcctccccatctcccgggagctctccaccaccaccccgaccaccggggtcaccgatcccgttgccatcacgttgtcggacgccaagagacaactcctccgcgagtcgcgatccggaccgcgtggactccatcctcgacgccatcgacacggcgtccatctcctctgcttccacccggaatgcgctctccctcgccgcgagcagactttctcgctcccgccgcttcggtgacgcgtaggccctcctctcctcccatctcaccgcgtccaccaccgaagcccacctcgccgccgtactgtgctcctacgcctccgccaacctccccgagaaggccatcgacgcgtatcgctccgctgcgcacgtccttccatcccccaactctccgctccccttcaaggccctcctctcaccnttcatacgatgtcgcagctacagacgcgtccctgtcctcctcgctgagntcatccaggga

SEQ ID NO: 22570 - protein, 81 aa, Zea mays
  misc_feature: Ceres CLONE 1392385-F
MPTSSPSPGSSPPPPRPPGSPIPLPSRCRTPRDNSSASRDPDRVDSILDAIDTASISSASTRNALSLAASRLSRSRRFGDA

SEQ ID NO: 22571 - DNA, 653 bp, Zea mays
  misc_feature: Ceres CLONE 1392386-F
  misc_feature: Encodes the peptide sequence at SEQ ID NO. 22572
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
tccccgcggtggcggccgctctagaactagtggatcccccgggctgcaggaattcgcacgagaccattacctagaacatcctattgaaaaaaaccctaacaacgcatttcgctccccacagcggctcggccacaatccacagtcagacggtctcgagctggatctctaccgttcgtccgctccagcagacaggagtgggcgctctctctctccctcgtggagacgactgcgcgaccgctgccgctgaccttgtgccccggtctccgtcggaccgttcgacaggtctcctgcgcattctttgccgtcaacaagctccgacaggttgctgtgtgaagtccaagtgtgtcacatggattcatcacaagatttccaacccagcacatgctctataaagttgtgcgcaccagctgaaagcacacggatcatgcttgatgacaggatgacaaacaatgtgtccacagagaccattttctctcgcagatatcgccttttgtgaaagcaagaggctcatgataatgcaactacgatagatgaactctgctttgccttgactgaggagcatttcagagaggagcacagggnnngatggaacttctgctgtgcagctacatggaaaggaacgagtaatggtttgttggaacgttctgaaaaag

SEQ ID NO: 22572 - protein, 48 aa, Zea mays
  misc_feature: Ceres CLONE 1392386-F
MDSSQDFQPSTCSIKLCAPAESTRIMLDDRMTNNVSTETIFSRRYRLL

SEQ ID NO: 22573 - DNA, 651 bp, Zea mays
  misc_feature: Ceres CLONE 1392388-F
  misc_feature: Encodes the peptide sequence at SEQ ID NO. 22574
  misc_feature (651)..(651): n is a, c, t, g, unknown, or other
aaagctggagctccccgcggtggcggccgctctagaactagtggatcccccgggctgcaggaattcgcacgagaccattacctagaacatcctaatcgaaaaattcgtccatcccacctaccatggccaccgcctccggcactgacgccggtgcccagccgcgcgacgaccccagcctcctccccttcgcgtccttctcgctcggcctctccatccgcgcgccggccacccccacactcgcctccgtcccctccaccctccacctccccactcaaatctctacactcgccgtctgcctccacccctccgccgcgcagccctcctcccgccgcaccacccgcctcaattccgccacctcctccgtcatcgccccgctgccctcctcaacgcccggcctctccgctccttcccctttcgggcgcgcccgccgcagcagggcgccgcccgcacgctcgtctggttccgcgccgacctccgcctccacgaccatgagccgtttcacgccgcagggggggggcgtcgtcctcctcctcccccgttttcgtcttcgatcccgcgggacttcggcagtcccccccttcggggttcccaaccgggacggggcccgtaccgcgccaactcctgggtttcggattcggtcgcgacccctgn

SEQ ID NO: 22574 - protein, 176 aa, Zea mays
  misc_feature: Ceres CLONE 1392388-F
MATASGTDAGAQPRDDPSLLPFASFSLGLSIRAPATPTLASVPSTLHLPTQISTLAVCLHPSAAQPSSRRTTRLNSATSSVIAPLPSSTPGLSAPSPFGRARRSRAPPARSSGSAPTSASTTMSRFTPQGGGVVLLLPRFRLRSRGTSAVPPFGVPNRDGARTAPTPGFRIRSRPL

SEQ ID NO: 22575 - DNA, 647 bp, Zea mays
  misc_feature: Ceres CLONE 1392391-F
  misc_feature: Encodes the peptide sequence at SEQ ID NO. 22576
tcaccgcggtggcggccgctctagaactagtggatcccccgggctgcaggaattcgcacgagaccattacctagaacatcctaatcgaaaaagcaagaaggacaccactcatcttttgctctcccgtctcggtgccatcgccacgaacctcttctcctgtggacctcctccggtctactcctactccgatcgacatcgactcaactgaagctggcgccatgaacagcctcctgcctgccaaccgatgacgcggacccgatgccgcctccgtgcgaaagccgaaatcttccagtaggcgtcaccgtccgagtctcatctacgaggataacgagaccccgtcgtcagacgaatacacacaagcggctggtgatcgacgatatgctactgtactacgtgacgttgaaataggtagacgcttactactactgcctggtaatcatcgagacaagcatcgatccagtacgacgattcgaagctgcataaatcacactcactttggcgatcatatccgtcgcgtactctcctgagggatacatctcactaaagcatgtacgactgccttgatgatgtgctccgatacgcatcctcataggaaagagggttctcgaggtatccaatatcgcccacgggtcaaacccatgggaaag

SEQ ID NO: 22576 - protein, 49 aa, Zea mays
  misc_feature: Ceres CLONE 1392391-F
MPPPCESRNLPVGVTVRVSSTRITRPRRQTNTHKRLVIDDMLLYYVTLK

SEQ ID NO: 22577 - DNA, 653 bp, Zea mays
  misc_feature: Ceres CLONE 1392395-F
  misc_feature: Encodes the peptide sequence at SEQ ID NO. 22578
ggagctccccgcggtggcggccgctctagaactagtggatcccccgggctgcaggaattcgcacgagaccattacctagaacatcctaatcgaaaaatgttagagactacccacggcccgtctcctcgacctccacgaaaccccacttctcgtatcgagactagggttaggggtgcggcactcccgctccgattcgaactagtccgcctaggactgcggcgagtcatggacgccgtgtccattgtggaggacttctcctccatggtggccgccctctgctaccccaacctcgaatcactcctccgagactccgcctcgagtttcatctccgacgtctccgccgacccggcccccggcgccgccgacctcaccaacttccagcgcgtcttctcgcgtgtcgtcagcacctactcagacccgccgctcgaggtcgccggcttcttcgccgcgttctccttacacgaccggcctgatgatctccgttcactgctgccgctgcttctccgccttctccggttcctcgactggctttcgggaagaggctgggccttcttccccggcggcggtctccgagcttttgtcactcagaataagcccgcccaagggaagaccgcaggccgcccctcgaggggtggcccttcctctaccataaa

SEQ ID NO: 22578 - protein, 142 aa, Zea mays
  misc_feature: Ceres CLONE 1392395-F
MDAVSIVEDFSSMVAALCYPNLESLLRDSASSFISDVSADPAPGAADLTNFQRVFSRVVSTYSDPPLEVAGFFAAFSLHDRPDDLRSLLPLLLRLLRFLDWLSGRGWAFFPGGGLRAFVTQNKPAQGKTAGRPSRGGPSSTI

SEQ ID NO: 22579 - DNA, 645 bp, Zea mays
  misc_feature: Ceres CLONE 1392397-F
  misc_feature: Encodes the peptide sequence at SEQ ID NO. 22580
  misc_feature (152)..(152): n is a, c, t, g, unknown, or other
  misc_feature (252)..(252): n is a, c, t, g, unknown, or other
  misc_feature (273)..(273): n is a, c, t, g, unknown, or other
  misc_feature (274)..(274): n is a, c, t, g, unknown, or other
  misc_feature (280)..(280): n is a, c, t, g, unknown, or other
  misc_feature (322)..(322): n is a, c, t, g, unknown, or other
tggagctccccgcggtggcggccgctctagaactagtggatcccccgggctgcaggaattcgcacgagaccattacctagaacatcctaatcgaaaagatccgatggcccgcgccgccgctcgcctcctccccatcttcctcccatggcggngtcctcccccgccctgcctcctcccgcggggcttcctaaaccctagcagccccagaactccgcgcgcgtcgacaccctcgttctccctgaagacgagggnttgccttttccctcgccccanngctccngaaacaggtgcgtctgactacgggaggtggcggggaaggggngttccctcgaacatgggggcatcgtaacctcactcggggaagccctggagggggggggaacgtggggaaattccggcccaagtgcgggcccggccccaaacggtttttcccccaagcgggaaaagggaggggtcaaccccgggaaacacggcaacctttttggggagaagaatcccgctcaaggggggggggggtttttgggggggttttggggggaaatagtttcccccgggggccacagggggagggggtggtgggggttctgggggggggaaaaattttttgtttgcgggggggggtaaaattttttttaaagaaaacca

SEQ ID NO: 22580 - protein, 81 aa, Zea mays
  misc_feature: Ceres CLONE 1392397-F
  misc_feature (17)..(17): Xaa is any aa, unknown, or other
  misc_feature (50)..(50): Xaa is any aa, unknown, or other
  misc_feature (57)..(57): Xaa is any aa, unknown, or other
MARAAARLLPIFLPWRXPPPPCLLPRGFLNPSSPRTPRASTPSFSLKTRXCLFPRPXAPETGASDYGRWRGRGVPSNMGAS

SEQ ID NO: 22581 - DNA, 648 bp, Zea mays
  misc_feature: Ceres CLONE 1392398-F
  misc_feature: Encodes the peptide sequence at SEQ ID NO. 22582
  misc_feature (462)..(462): n is a, c, t, g, unknown, or other
  misc_feature (499)..(499): n is a, c, t, g, unknown, or other
  misc_feature (518)..(518): n is a, c, t, g, unknown, or other
  misc_feature (568)..(568): n is a, c, t, g, unknown, or other
  misc_feature (594)..(594): n is a, c, t, g, unknown, or other
  misc_feature (598)..(598): n is a, c, t, g, unknown, or other
tccccgcggtggcggccgctctagaactagtggatcccccgggctgcaggaattcgcacgagaccattacctagaacatcctaatcgaaaaattatccccagctttttctccaagcgtccgttcaggaagctgtccggcaacgagccgctcggcactgggcggtggccgtgcaagagcgatcgggaccgcatcgctcgtctgctcctccaggcctccgcctccctcatcatcactgcagcggcgagaagaacaagggacggtccggcggtggtctccactgacatcgcctaccatggctaccatgctgcgccggtgcatgcggaatctgcgcccgctgcggtctctcgcgagggtcccagaccgatcttcttcgagagtccacatttcttagatgtagaagcaactcaacaaaggcatctccaaaagagtctacacagaatgctgcccccagtccctcaggnacaccttctcagtcgggaagtaatgtttcaaagcttngctctggaaactcttgtgntcggtgcagcagctataggtgcacatcaacttggttatatagatcttcantttaagggacagacattgccctttancttnaagaggaagatgtccgaaaggtggtatatgaagatcctgagatcccttcg

SEQ ID NO: 22582 - protein, 54 aa, Zea mays
  misc_feature: Ceres CLONE 1392398-F
  misc_feature (5)..(5): Xaa is any aa, unknown, or other
  misc_feature (12)..(12): Xaa is any aa, unknown, or other
  misc_feature (28)..(28): Xaa is any aa, unknown, or other
  misc_feature (37)..(37): Xaa is any aa, unknown, or other
  misc_feature (38)..(38): Xaa is any aa, unknown, or other
MFQSXALETLVXGAAAIGAHQLGYIDLXFKGQTLPFXXKRKMSERWYMKILRSL

SEQ ID NO: 22583 - DNA, 649 bp, Zea mays
  misc_feature: Ceres CLONE 1392403-F
  misc_feature: Encodes the peptide sequence at SEQ ID NO. 22584
  misc_feature (385)..(385): n is a, c, t, g, unknown, or other
  misc_feature (386)..(386): n is a, c, t, g, unknown, or other
tggagctccccgcggtggcggccgctctagaactagtggatcccccgggctgcaggaattcgcacgagaccattacctagaacatcctaatcgaaaaactctgcaaagcgcgcgaccggacggcccggttcgttctcgacctctcgtctcgctcatccgcccgcccccgaggaagtaaccctagcctagccttgctccgaccggtcgccgcggcgactgcgacgatgatggactgcgctggaggcgagaccccgtggaggattcctcctcggcggcgccggcgccggcgacgacggagatctcgtcgccgtcttctgcgacgacggaggacttgggattgagggtatccatggagatgcttgtggatttgagcggtctaatttgnngaaaaggggtagagatgaaccatgttcatctggcccaacatccaaagcttgccgtgaaaaaatgaggagggacaagctgaatgacaggttcctggaattaagttcaattatgaatcctggtaaggaagcaaagttagataaagcaaatatattgagtgatgcagcccgtatggtgccacaacttaaaggtgaggcagaaaagcttaaggaatcaaatgagaaggtgcgggagaatatcagggatctgaaggaggaaaaaaact

SEQ ID NO: 22584 - protein, 67 aa, Zea mays
  misc_feature: Ceres CLONE 1392403-F
  misc_feature: The sequence is a functional homolog of SEQ ID NO 1203 in the 11/479,226 US patent application
  misc_feature: The sequence is a functional homolog of SEQ ID NO 2422 in the 10/374,780 US patent application
  misc_feature: The sequence is a functional homolog of SEQ ID NO 542 in the 10/412,699 US patent application
  misc_feature: The sequence is a functional homolog of SEQ ID NO 814 in the 10/225,066 US patent application
  misc_feature: The sequence is a functional homolog of SEQ ID NO 917 in the 11/479,226 US patent application
  misc_feature: The sequence is a functional homolog of SEQ ID NO 1275 in the 10/666,642 US patent application
  misc_feature: The sequence is a functional homolog of SEQ ID NO 1704 in the 10/374,780 US patent application
MRRDKLNDRFLELSSIMNPGKEAKLDKANILSDAARMVPQLKGEAEKLKESNEKVRENIRDLKEEKN

SEQ ID NO: 22585 - DNA, 651 bp, Zea mays
  misc_feature: Ceres CLONE 1392408-F
  misc_feature: Translation starting site: 253
  misc_feature (373)..(373): n is a, c, t, g, unknown, or other
tccccgcggtggcggccgctctagaactagtggatcccccgggctgcaggaattcgcacgagaccattacctagaacatcctaatcaaaagaagcagactccacccggcgcgtcctcgtctcgtctcgtctcgcacgcacccctcactttccttgtcaatcgactcgcgatcgaatccgccccgagtcgattccgccgcggaccgaccggttcacttcccttttctcccgagatctcgactctcgagcaagtatgggtgaggcgaaggacaacgaggtgtacgaggaggacctagtcgactatgaggaggaggtggagaatgtcattgatggcgcccccaccaacggctcctcagatgtcgtcaagaaggggntacgtagggatccccagctcggggttcagagacttcctgctcaagccagagcttcttcgcgccatttcaggattgcgggtttgagcatccttctgaagtgcaacatgagtgcatccctcaagctattcttgggaatggatgtcatctgtcaagcaaaatctggaatggggtagacttgcagttttttgtcctgtcaactcttcagcagattgatcctgttgctggccagtagctggcacttggtgttgtgccacacagagaattagcttacagatttg

SEQ ID NO: 22586 - DNA, 689 bp, Zea mays
  misc_feature: Ceres CLONE 1392412-F
  misc_feature: Translation starting site: 414
  misc_feature (390)..(390): n is a, c, t, g, unknown, or other
  misc_feature (392)..(392): n is a, c, t, g, unknown, or other
  misc_feature (425)..(425): n is a, c, t, g, unknown, or other
  misc_feature (445)..(445): n is a, c, t, g, unknown, or other
  misc_feature (461)..(461): n is a, c, t, g, unknown, or other
  misc_feature (468)..(468): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (496)..(496): n is a, c, t, g, unknown, or other
  misc_feature (515)..(515): n is a, c, t, g, unknown, or other
  misc_feature (516)..(516): n is a, c, t, g, unknown, or other
  misc_feature (523)..(523): n is a, c, t, g, unknown, or other
  misc_feature (527)..(527): n is a, c, t, g, unknown, or other
  misc_feature (529)..(529): n is a, c, t, g, unknown, or other
  misc_feature (542)..(542): n is a, c, t, g, unknown, or other
  misc_feature (549)..(549): n is a, c, t, g, unknown, or other
  misc_feature (553)..(553): n is a, c, t, g, unknown, or other
  misc_feature (559)..(559): n is a, c, t, g, unknown, or other
  misc_feature (560)..(560): n is a, c, t, g, unknown, or other
  misc_feature (562)..(562): n is a, c, t, g, unknown, or other
  misc_feature (573)..(573): n is a, c, t, g, unknown, or other
  misc_feature (575)..(575): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (598)..(598): n is a, c, t, g, unknown, or other
  misc_feature (599)..(599): n is a, c, t, g, unknown, or other
  misc_feature (610)..(610): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (649)..(649): n is a, c, t, g, unknown, or other
  misc_feature (651)..(651): n is a, c, t, g, unknown, or other
  misc_feature (656)..(656): n is a, c, t, g, unknown, or other
  misc_feature (657)..(657): n is a, c, t, g, unknown, or other
  misc_feature (659)..(659): n is a, c, t, g, unknown, or other
  misc_feature (660)..(660): n is a, c, t, g, unknown, or other
  misc_feature (677)..(677): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
tggagctccccgcggtggcggccgctctagaactagtggatcccccgggctgcaggaattcgcacgagaccattacctagaacatcctaatcgaaaaaccgctctcccatcccacccaaatcgccgaccgataggagagaactcgagctgaggagagagagagcagcaggcggcggcgcggagtaacacgcgaaggggaatgcgcagcccgtgtgagcctctcgcccccgcgaaaccccaccgattctgattccgccggcgaaatcgggcgcctcgcggctcggccggctaagcggtggacggcggcgcccgaggggttcgttcgatacgggtgagggtagaggccggtgaggagcagcagccacggcgagggggggagggatgtttgantngatctccaagtcccttttggaatgctacagggnaaggggaagtggatgggggnagtggcgaggccggcnggggagnaccggggggggggnnnggggctttcggngggagggggccggggcccnnggcgtgngggnangggggcggcgtgngtgaggnggcncgcggnngnggggcgcgggngnggnnngccctgcgcggggggggnnggggggggccngcgnnnngccgcgtnnnngggnnnnggggggggggcggngnccgcnncnnggggggggcccgcggtngggggnnncccg

SEQ ID NO: 22587 - DNA, 640 bp, Zea mays
  misc_feature: Ceres CLONE 1392414-F
  misc_feature: Encodes the peptide sequence at SEQ ID NO. 22588
  misc_feature (396)..(396): n is a, c, t, g, unknown, or other
  misc_feature (577)..(577): n is a, c, t, g, unknown, or other
tggagctccccgcggtggcggccgctctagaactagtggatcccccgggctgcaggaattcgcacgagaccattacctagaacatcctaatcgaaaagtttgttattttcttctcccgttcacttctctttggcccgaaaccgagagctagtgcttgattcggtcgtttttgggcaccgaacacgttcttgggaccgccgccgccgccctacttccagtcccagctgctcaggtctccatcggcctcgagccctttgccggcgacgagcactcacaacaccagttttgtaagaggggatctgtaccagtcaggctgagcagcagcagcagtggtgtgttctggcttgtgtgggacctagaggaacttaccaacagggaagagtatttgtgttaggntgtaacaatgtcttcttcaatggaatcgtcataccttcctgctacaactgagtcattagcccaagctcaaaaggctaaggaatgcttcagagtccatttcaatcctttacggtgtcattcaggacccatcttcttctgctgatgcactgagaaacaaagaagttgcaattacaaatcttancaactacctcactaagaaaacagagctggagagctgcgtaatcttttgacccagtcagaccat

SEQ ID NO: 22588 - protein, 44 aa, Zea mays
  misc_feature: Ceres CLONE 1392414-F
MSSSMESSYLPATTESLAQAQKAKECFRVHFNPLRCHSGPIFFC

SEQ ID NO: 22589 - DNA, 647 bp, Zea mays
  misc_feature: Ceres CLONE 1392417-F
  misc_feature: Translation starting site: 145
  misc_feature: Pfam Name: PAL Pfam Description: Phenylalanine and histidine ammonia-lyase
  misc_feature: SWISSPROT Homolog: EC 4.3.1.5 Phenylalanine ammonia-lyase
  misc_feature (371)..(371): n is a, c, t, g, unknown, or other
  misc_feature (372)..(372): n is a, c, t, g, unknown, or other
  misc_feature (387)..(387): n is a, c, t, g, unknown, or other
  misc_feature (389)..(389): n is a, c, t, g, unknown, or other
  misc_feature (390)..(390): n is a, c, t, g, unknown, or other
  misc_feature (396)..(396): n is a, c, t, g, unknown, or other
  misc_feature (422)..(422): n is a, c, t, g, unknown, or other
  misc_feature (523)..(523): n is a, c, t, g, unknown, or other
tggagctccccgcggtggcggccgctctagaactagtggatcccccgggctgcaggaattcgcacgagaccattacctagaacatcctaatcgaaaattccgtccgcgcgcgctcatctgcgcacgcacgtgtccccgtccgcaatggagtccgaggccggcctgcttgtccgctcctccctgaacggcgagggcctgtgcatgccggcgccgcgcgccgacccgctgaactggggcaaggccgcggagggcctgtccgggagccacctggacgaggtgaagcggatgggtggcggagttccgcgaccctgctggtgaagatccagggcgccagcctgaggcgtcgcgcaggtgggccgccgtgcccgtgnngcgccgtggggcgananntcctcntggagcatgcacgagtccgctcgcgnagcgcgtcaggcccagcagcgactggggtcatgggcagcatgatgaacggcaccgacagctacggcgtcaccacgggcttcggcgctacctcccaccgcgnaccaaggagggggcgcgctccagagggagctcatcgatccctcaatgccggcgccttcggaccggcgccgacgccaagtgctgccggggaagccaccccgcggggagctcgggcgctcaccccg

SEQ ID NO: 22590 - DNA, 658 bp, Zea mays
  misc_feature: Ceres CLONE 1392418-F
  misc_feature: Encodes the peptide sequence at SEQ ID NO. 22591
  misc_feature (283)..(283): n is a, c, t, g, unknown, or other
  misc_feature (366)..(366): n is a, c, t, g, unknown, or other
  misc_feature (367)..(367): n is a, c, t, g, unknown, or other
  misc_feature (399)..(399): n is a, c, t, g, unknown, or other
  misc_feature (404)..(404): n is a, c, t, g, unknown, or other
  misc_feature (447)..(447): n is a, c, t, g, unknown, or other
  misc_feature (572)..(572): n is a, c, t, g, unknown, or other
  misc_feature (573)..(573): n is a, c, t, g, unknown, or other
tggagctccccgcggtggcggccgctctagaactagtggatcccccgggctgcaggaattcgcacgagaccattacctagaacatcctaatcgaaaacctccccatcgcgtctgtccgctacccctccccgaccagatcgctacgagacgccgcgcgatccgacccaggccgacgccgacgacccctctcgccgccggcggccatggcgtacggcgaccgcgtcaccaccttcgaggactccgagaatgagagcgagtacggctatgtccgcaaggctctggnacctgtggttgtggctgatggaaatgggtggtgctgccatggtatgaacttggttcgtgtcggacatgataacctcattgggnnaattatccggtcttgagggcgattcagctacnatccnaagtttatgaggaaacagctgggactggatggttaatgacccntgtattgagaacaagaaggcctctttcaggtggattgggacctggaattcttggaaacattttttgacggtatccagcgacctctaaaaacatcgctataaggtcaggagagtgatattcctcgnngggggtttagttcctgcccttgacaaggatgatttgtggaatttcagcaccaagctagggggtggagaagcctccccgggtggag

SEQ ID NO: 22591 - protein, 59 aa, Zea mays
  misc_feature: Ceres CLONE 1392418-F
  misc_feature: SWISSPROT Homolog: EC 3.6.3.14 H(+)-transporting two-sector ATPase
  misc_feature (27)..(27): Xaa is any aa, unknown, or other
  misc_feature (55)..(55): Xaa is any aa, unknown, or other
MAYGDRVTTFEDSENESEYGYVRKALXPVVVADGNGWCCHGMNLVRVGHDNLIGXIIRS

SEQ ID NO: 22592 - DNA, 626 bp, Zea mays
  misc_feature: Ceres CLONE 1392425-F
  misc_feature: Encodes the peptide sequence at SEQ ID NO. 22593
  misc_feature (101)..(101): n is a, c, t, g, unknown, or other
  misc_feature (175)..(175): n is a, c, t, g, unknown, or other
  misc_feature (176)..(176): n is a, c, t, g, unknown, or other
  misc_feature (245)..(245): n is a, c, t, g, unknown, or other
aaagctggagctccccgcggtggcggccgctctagaactagtggatcccccgggctgcaggaattcgcacgagaccattacctagaacatcctaatcgaanaacaaccacaacacctcgcctcgtcagatcgaccgggaagaagggagcagaagcccaccggctcgtccgcccgnntgctgtcgtcgctatggccgccgtggaagtgtgcgttaagggccgccgcgggaaccccgacacgctcgncgattgcccgttctcgcagagggtgctgctccagctggaggaaaaaaaggtcccgaccagggggaagtcttctcggccgggagggcatcttccccggataaccctcgagaaaaaatccccccgacccgacgaaaaaagtacacccccccacaccgttttttttttccaaaaaacccttgtggtttctccgaccctttttttggccaaaaaggaagccttctccgtgggtgggggccccccaaaagggcccttgggggtttttgggggaaaaaaatagggggttttcttggggggccggctcccaaaaggggggcttttggtttttctggggcccacagaattttggcggccccaggggttttttttttccaagggaaaggg

SEQ ID NO: 22593 - protein, 110 aa, Zea mays
  misc_feature: Ceres CLONE 1392425-F
  misc_feature (19)..(19): Xaa is any aa, unknown, or other
MAAVEVCVKGRRGNPDTLXDCPFSQRVLLQLEEKKVPTRGKSSRPGGHLPRITLEKKSPRPDEKSTPPHTVFFFQKTLVVSPTLFLAKKEAFSVGGGPPKGPLGVFGGKK

SEQ ID NO: 22594 - DNA, 657 bp, Zea mays
  misc_feature: Ceres CLONE 1392426-F
  misc_feature: Pfam Name: ArfGap Pfam Description: Putative GTPase activating protein for Arf
  misc_feature (371)..(371): n is a, c, t, g, unknown, or other
  misc_feature (397)..(397): n is a, c, t, g, unknown, or other
  misc_feature (402)..(402): n is a, c, t, g, unknown, or other
  misc_feature (433)..(433): n is a, c, t, g, unknown, or other
tggagctccccgcggtggcggccgctctagaactagtggatcccccgggctgcaggaattcgcacgagaccattacctagaacatcctaatcaaaaaagcaccgtccacctccaccatctttcctcttcctcctcgcctccaccccttcccttccatctcctcccacccggcgactcctcttcctctctgccgcgccgatcgattggcccacccatcgatcgagcacggggaagaagattccagtccggagtggtttcaattcggtcgggttcgttgcccgtgtgggtgggcgctatggcggcgatggatgcctcggcagataagaacgccgtcttccgcaagcttcgcgccaaatcggacaacaagatgntgctttgattgcaacgccaagaaccngacgntgggcgtccgatcacctacggcgtcttcctnctgcatcgactggctcggcggcgcacgaaagccctcggcgtcccacgtctccttcgtcaggtcaacaaattttggattcatggactccagaacaatggaaaatgatgggtctatggcggaaataaccgtgcgcaagctttctttagcaagcatgggtggacagatgggtggaaaaattgaagcaaagtatactttcagagctgctgacttgtaccgacagttgt

SEQ ID NO: 22595 - DNA, 662 bp, Zea mays
  misc_feature: Ceres CLONE 1392432-F
  misc_feature: Translation starting site: 173
  misc_feature: SWISSPROT Homolog: EC 4.1.2.10 Mandelonitrile lyase
  misc_feature (354)..(354): n is a, c, t, g, unknown, or other
  misc_feature (491)..(491): n is a, c, t, g, unknown, or other
  misc_feature (514)..(514): n is a, c, t, g, unknown, or other
  misc_feature (522)..(522): n is a, c, t, g, unknown, or other
tggagctccccgcggtggcggccgctctagaactagtggatcccccgggctgcaggaattcgcacgagaccattacctagaacatcctaatcgaaaacacataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactaacatcatcgtgggcggcggcacggccgggtgcccgctggccgccacgctgtcggagngcttccgcgtgctgctgctggagcgcggcgcctcgccctacgacgagacccgcatcggggacatggcccgcttcgcggacacgctgtcggacacctccccgggctcgccgcgcagcgctttcgtgtcggaaggacgncgtcatcactcgcgccccgcggntgcttggncggcggcagctgcatcaacgccggcttctacacgcgggccagcgacgaatacgtgcggggccgtcgggtggaaacctgggccccgccggggcggcctaccgttgggtggaagaatttgttggcgatcacccgaaacttgc

SEQ ID NO: 22596 - DNA, 663 bp, Zea mays
  misc_feature: Ceres CLONE 1392437-F
  misc_feature: Encodes the peptide sequence at SEQ ID NO. 22597
  misc_feature (393)..(393): n is a, c, t, g, unknown, or other
  misc_feature (472)..(472): n is a, c, t, g, unknown, or other
  misc_feature (556)..(556): n is a, c, t, g, unknown, or other
  misc_feature (557)..(557): n is a, c, t, g, unknown, or other
  misc_feature (582)..(582): n is a, c, t, g, unknown, or other
  misc_feature (587)..(587): n is a, c, t, g, unknown, or other
tggagctccccgcggtggcggccgctctagaactagtggatcccccgggctgcaggaattcgcacgagaccattacctagaacatcctaatcgaaaacccccacagaaccgtctccccagcccggcgcctcacggtcgcaatttattgcttgcgcaccgcctcgccgctttggcgtggggcgtttgcctgtgtggcgctgggcatgtgccgtgcccgtggcttgcttcgtcgtgctcactagtcacgagagagggaggaggctctgcttctgctgccgcttcttcttctcctgctgctcttccggagataagcagggggccgggacagctgactagctgagaggcatggggatggacgccggcggcggcaagctgccgtacagctacgccggncagcaggacggcgggaagctggtgaagagcgtcagccgcgtgaagccgcgcaggttcggcctgggccctcgtggcggcntttcctcgtcgtcacctgcgcctacttctccaccgccaagttcgacgccatccagatcgccatgaccagccgacccgtctccannaaatgcggctgggcgtcggagtccnctccncttgggagtgggccgccgccgccgcccgacacctccaggggctcaagggagggaattagatttgggcggccatgag

SEQ ID NO: 22597 - protein, 63 aa, Zea mays
  misc_feature: Ceres CLONE 1392437-F
  misc_feature (43)..(43): Xaa is any aa, unknown, or other
MGMDAGGGKLPYSYAGQQDGGKLVKSVSRVKPRRFGLGPRGGXSSSSPAPTSPPPSSTPSRSP

SEQ ID NO: 22598 - DNA, 673 bp, Zea mays
  misc_feature: Ceres CLONE 1392438-F
  misc_feature: Translation starting site: 350
  misc_feature: Pfam Name: V-ATPase_C Pfam Description: V-ATPase subunit C
  misc_feature: SWISSPROT Homolog: EC 3.6.3.14 H(+)-transporting two-sector ATPase
  misc_feature (295)..(295): n is a, c, t, g, unknown, or other
  misc_feature (358)..(358): n is a, c, t, g, unknown, or other
  misc_feature (432)..(432): n is a, c, t, g, unknown, or other
  misc_feature (533)..(533): n is a, c, t, g, unknown, or other
  misc_feature (543)..(543): n is a, c, t, g, unknown, or other
  misc_feature (553)..(553): n is a, c, t, g, unknown, or other
  misc_feature (570)..(570): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (670)..(670): n is a, c, t, g, unknown, or other
  misc_feature (671)..(671): n is a, c, t, g, unknown, or other
aaagctggagctccccgcggtggcggccgctctagaactagtggatcccccgggctgcaggaattcgcacgagatcattacctagaacatcctaatcgaaaaaaaccaccgcctcctcccccgaccggagaggagcctcaccgccggcgcccatggcgacacgctacttgatcgtgtcgctgcccgtgcagtcgcccggcgccaccgccagctccctgtggtcgcgcctccaggactccatctcccgccactccttcgacaccccgctctaccgcttcaacgtcccggatctccngcgtcggcaccctcgactcgctcctcgcgctcagtgacgacctcgtcaagtccaatgtcttcngtggagggcgtgtcacacaagatccggaggcagatcgaggacctcgagcgcgcccggaggggtcgagaccgganctccaccggtcgaacggcgtccccgtcgacactaccctcactaatggttcccgggggggaattgaggggcaagtacccccacaatgtcccttctccagggnagatcgtcgncagcatacangtcacaggtttgccagnaatcgagannnnnnactgtgaaagggttccaagcatcggaaatataaataattggtagggaggccaggcttagttgcgatcaacaggaaaccaagtgggnnca

SEQ ID NO: 22599 - DNA, 692 bp, Zea mays
  misc_feature: Ceres CLONE 1392439-F
  misc_feature: Encodes the peptide sequence at SEQ ID NO. 22600
  misc_feature (310)..(310): n is a, c, t, g, unknown, or other
  misc_feature (328)..(328): n is a, c, t, g, unknown, or other
  misc_feature (386)..(386): n is a, c, t, g, unknown, or other
  misc_feature (393)..(393): n is a, c, t, g, unknown, or other
  misc_feature (394)..(394): n is a, c, t, g, unknown, or other
  misc_feature (401)..(401): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (480)..(480): n is a, c, t, g, unknown, or other
  misc_feature (538)..(538): n is a, c, t, g, unknown, or other
  misc_feature (584)..(584): n is a, c, t, g, unknown, or other
tggagctccccgcggtggcggccgctctagaactagtggatcccccgggctgcaggaattcgcacgagaccattacctagaacatcctaatcgaaaacacacaacccaaagcagccacagcagcctccttcctcctctcactctcgctcgcgctgcgctcgctacctcgcttcgcattccattcgaaaagaggggaggaaaggcaagatgttcatcgagagcttccgcgtcgagagcccccacgtgcggtacggcccgatggagatcgagtcggagtaccggtacgacacgacggagctggtacacgagnggcaaggacggcgcctcnacgctgggtcgtcccgccccaagtccgtcaagtacaacttccggacccagaaccgccngtcccannagctcgnggtggatgctttgtgggnnntgggggaggcaaacaacgggtccacgctggacgggctgggggtcattgccaacaggggnagggggatcctcatggggcgaccaagggacaagggtggcagcaagccaaactactacnggctccctcacccaggcctccacccatcagagtcggcagctaccanggggggaaggagattctatgccgccgttcaagagcctcccttcccatagtgaacccagaccgactttggtggtccggaggctgggacattagcaacaggaaactgggc

SEQ ID NO: 22600 - protein, 141 aa, Zea mays
  misc_feature: Ceres CLONE 1392439-F
  misc_feature: SWISSPROT Homolog: EC 5.5.1.4 Inositol-3-phosphate synthase
  misc_feature (35)..(35): Xaa is any aa, unknown, or other
  misc_feature (41)..(41): Xaa is any aa, unknown, or other
  misc_feature (60)..(60): Xaa is any aa, unknown, or other
  misc_feature (62)..(62): Xaa is any aa, unknown, or other
  misc_feature (63)..(63): Xaa is any aa, unknown, or other
  misc_feature (65)..(65): Xaa is any aa, unknown, or other
  misc_feature (71)..(71): Xaa is any aa, unknown, or other
  misc_feature (72)..(72): Xaa is any aa, unknown, or other
  misc_feature (111)..(111): Xaa is any aa, unknown, or other
  misc_feature (126)..(126): Xaa is any aa, unknown, or other
MFIESFRVESPHVRYGPMEIESEYRYDTTELVHEXQGRRLXAGSSRPKSVKYNFRTQNRXSXXLXVDALWXXGEANNGSTLDGLGVIANRGRGILMGRPRDKGGSKPNYYXLPHPGLHPSESAATXGGRRFYAAVQEPPFP

SEQ ID NO: 22601 - DNA, 663 bp, Zea mays
  misc_feature: Ceres CLONE 1392439-R
caattgggtaccgggccccccctcgaggtcgacggtatcgataagcttttttttttttttttttgaatcagaagcatcaaagttcagaacttgtatccaatatggctgaaatcacatgagcagattaatctggaataaaatttgtgctgcgtttttattctataagccctatcaccttttgttcgtttccccaccattttttggagtttaactgatgtgaaggtagaagtagcacagtgcatcatgctgcgtgcctcctcttgatcctaaccctcatcccgttcttggtgagaagcaccactgagttctgtggctcaacgatatggccgtcgatgagctccacccgaaagttgtataaaattgccgccgcggcaatcgtgatgttgctgaccccaggttcttcccgaggcagcttctgggtccgcagttgaacacggcgaacttgtggctgggctcgtgccggactctgccaatatcggacagccacggctccggtcggaactcgtggcaatcgctaccccataggcccttccatccagcccatggggtaaatgccaaaaatgaccctggggtcctttgggcccatggggggcccgccaggcaccacaatccttgcgaaaatggccccttttgccttaaaagggggcccacgggaaatcgccc

SEQ ID NO: 22602 - DNA, 607 bp, Zea mays
  misc_feature: Ceres CLONE 1392442-F
  misc_feature: Encodes the peptide sequence at SEQ ID NO. 22603
  misc_feature (358)..(358): n is a, c, t, g, unknown, or other
  misc_feature (359)..(359): n is a, c, t, g, unknown, or other
  misc_feature (380)..(380): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (416)..(416): n is a, c, t, g, unknown, or other
  misc_feature (423)..(423): n is a, c, t, g, unknown, or other
  misc_feature (428)..(428): n is a, c, t, g, unknown, or other
  misc_feature (571)..(571): n is a, c, t, g, unknown, or other
tggagctccccgcggtggcggccgctctagaactagtggatcccccgggctgcaggaattcgcacgagaccattacctagaacatcctaatcgaaaagacttcctccgctccgctccgctcccctccgctcccgaacggtcgatctttgcatggcagcagcagctggctccaaggggcgggcgatcgctggaagcttcgtcagccgcgtcctcgccggcaaggccgcctcgccgaggagggccgtgcacgcctcggcgtacgacaagaacctggaggaccaggtgcgcccggcgttcgtgccggacgatgtgatcggcagcgcccggagccccgaacagtactggagcccccaccccnnagacggcgtcttcggccgggngnnngtgaccccagctgggcgctggtggcgcgccgnacgccgncgcgnatgctgcaggaagcacggtgctggaccagaagggggggttccgcccgctccaagacgtcaagaagccgcccccccgcgcgtgagccgggcggcgcttgctaggccaacccaaaactggtgctcgctctaaaaaagggcggggnaaaaaccctggaaggggcaagcactctggtccgggc

SEQ ID NO: 22603 - protein, 135 aa, Zea mays
  misc_feature: Ceres CLONE 1392442-F
  misc_feature (70)..(70): Xaa is any aa, unknown, or other
  misc_feature (77)..(77): Xaa is any aa, unknown, or other
  misc_feature (78)..(78): Xaa is any aa, unknown, or other
  misc_feature (89)..(89): Xaa is any aa, unknown, or other
  misc_feature (93)..(93): Xaa is any aa, unknown, or other
MAAAAGSKGRAIAGSFVSRVLAGKAASPRRAVHASAYDKNLEDQVRPAFVPDDVIGSARSPEQYWSPHPXDGVFGRXXVTPAGRWWRAXRRRXCCRKHGAGPEGGVPPAPRRQEAAPPRVSRAALARPTQNWCSL

SEQ ID NO: 22604 - DNA, 658 bp, Zea mays
  misc_feature: Ceres CLONE 1392449-F
  misc_feature: Encodes the peptide sequence at SEQ ID NO. 22605
  misc_feature (397)..(397): n is a, c, t, g, unknown, or other
  misc_feature (421)..(421): n is a, c, t, g, unknown, or other
  misc_feature (575)..(575): n is a, c, t, g, unknown, or other
  misc_feature (598)..(598): n is a, c, t, g, unknown, or other
  misc_feature (616)..(616): n is a, c, t, g, unknown, or other
aaagctggagctccccgcggtggcggccgctctagaactagtggatcccccgggctgcaggaattcgcacgagaccattacctagaacatcctaatcgaaaaatttatggcggcccgcgccagcggcttctggttcctcacctcctggtcagaccaagcggcacgcacaagcgcacagccacggtgagcagagaagaaacgcatccacagaagggacaaacgtccggagcggattccacattccagtctcggtctcggtccatgggcgcggaaaagggaggagacggcggcgaggcggcgcccgaagccgcgcagcccgtcgtgctgaagatgaaactgcattgcgccggctgcgcgcacaaggtcaagaaggccatcaagcgcgttcccggtgtgnactccatcgtcacagacgtcgcgncgaacacggtcgtcgtggtggggacggccgacgcgggcgcgctcaaggcgcggctcgagggcagaccaccagcccgtggagatcgtctccgccggcggcgcccccaagaagctccccgcgcggagcccaagcaggacgccggcgcccgcgtcgntgaaaaaaaggggtcaaagcgcnccccccaacgaggaaganaaagagaagggaagaaccaccgggcgggagaaaaaaaaaaag

SEQ ID NO: 22605 - protein, 132 aa, Zea mays
  misc_feature: Ceres CLONE 1392449-F
  misc_feature (20)..(81): Pfam Name: HMA Pfam Description: Heavy-metal-associated domain
  misc_feature (46)..(46): Xaa is any aa, unknown, or other
  misc_feature (54)..(54): Xaa is any aa, unknown, or other
  misc_feature (105)..(105): Xaa is any aa, unknown, or other
  misc_feature (113)..(113): Xaa is any aa, unknown, or other
  misc_feature (119)..(119): Xaa is any aa, unknown, or other
MGAEKGGDGGEAAPEAAQPVVLKMKLHCAGCAHKVKKAIKRVPGVXSIVTDVAXNTVVVVGTADAGALKARLEGRPPARGDRLRRRRPQEAPRAEPKQDAGARVXEKKGSKRXPQRGRXREGKNHRAGEKKK

SEQ ID NO: 22606 - DNA, 676 bp, Zea mays
  misc_feature: Ceres CLONE 1392453-F
  misc_feature (462)..(462): n is a, c, t, g, unknown, or other
  misc_feature (529)..(529): n is a, c, t, g, unknown, or other
  misc_feature (543)..(543): n is a, c, t, g, unknown, or other
  misc_feature (615)..(615): n is a, c, t, g, unknown, or other
  misc_feature (625)..(625): n is a, c, t, g, unknown, or other
  misc_feature (629)..(629): n is a, c, t, g, unknown, or other
  misc_feature (642)..(642): n is a, c, t, g, unknown, or other
  misc_feature (647)..(647): n is a, c, t, g, unknown, or other
aaagctggagctccccgcggtggcggccgctctagaactagtggatcccccgggctgcaggaattcgcacgagaccattacctagaacatcctaatcgaaaaaaggcccaactccactcatcgccactgcgccgaaacccaaagcggggaggaggagcggaaaagaaaaggaaaatgggaggagcggaagcaagtccgagcaagtcagaggatccgccggcctatctccgcctataaaatgccgtcccaccccccaccttcctagcagctgctctccaccaagagctgctggcaccaccaaaccaatcgctggatttgtccagagtatttccggtttcaccgccctagatctgacccgagacgccgcgtcttcgctgagatggcgattactgtgaggcggtcgacgatggtgcgcccggcgcgggagacgccgcggcagcggctgtggaactccaacctcgnacctcgtggtgccgcgcttccacacgcccagtgtctacttctaccgccgcgacggccccgtgcggantggggggaaggggnttcttcgacggcgagcgggatgcggcgcgcgctggcagaggcgcctcgtgccgttctaatccaatggcgggncggctcgcgncggnacgagggacaggnaaggnctcgagatcgactgcaatgggggcaaggg

SEQ ID NO: 22607 - DNA, 633 bp, Zea mays
  misc_feature: Ceres CLONE 1392457-F
  misc_feature (287)..(287): n is a, c, t, g, unknown, or other
  misc_feature (306)..(306): n is a, c, t, g, unknown, or other
  misc_feature (329)..(329): n is a, c, t, g, unknown, or other
  misc_feature (340)..(340): n is a, c, t, g, unknown, or other
  misc_feature (341)..(341): n is a, c, t, g, unknown, or other
  misc_feature (345)..(345): n is a, c, t, g, unknown, or other
aaagctggagctccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatgatgtgaacgacgtgctgctagtggtgctggcggcgggctggctgcatgtggtgncgtcgtgctcaagaacggnggtgtcgacggctccccgcgggncctcgggtggnncggngtggggacctgtttcagtgatcctgcagggaggccctcatgtacgtggggcgacctccgggaaaggacgggccctctccacaggcggtggggcagggaccccatcggggccccctgggggagtatcccgaaggggtgggaaacaaggccccatgtcccgaggcgcccaagaaacccccccccgcccttttagggggggggaggggacgtaattggggcccaaggcccccgggggggtgttggggccaattttcttcgaggagagtgtcccccccccgggaggggtctt

SEQ ID NO: 22608 - DNA, 665 bp, Zea mays
  misc_feature: Ceres CLONE 1392459-F
  misc_feature (610)..(610): n is a, c, t, g, unknown, or other
  misc_feature (665)..(665): n is a, c, t, g, unknown, or other
aagctggagctccccgcggtggcggccgctctagaactagtggatcccccgggctgcaggaattcgcacgagaccattacctagaacatcctaatcgaaaagtccctccactcctcccgtcgagcacttggcactgccaatggcggcagccgcccacaccccttcgatgcgcgcaagccgcctcctttcctcctgagatcgacgcacctcctcctctcgtactccattcccgctccaagttcgtttcttcggcaccgagccatcgcacggccgcccccgcatctcgtcctgctctcaggtccttggcctccgccgttcttcgacaggggcgcgccccggtgcccactccgcgaaatccgagtcccttgtgcagctccgtagggtggaagagatccatcaggcggtgagcggtaggaggcgcccgtacaactgaggggacgggcaatggcgggccgtggcaggcccactctgcacgtggctcgtcgccgcgtgcttgtctgcggcttgcgacgcagaagagtacaagcagaagcattgctgccccggcggaagcggcgcttggggggcggcgtcattgctccggcctgcgccgccgcctcggcgcgccggngtcgcggcttggcgcgctctgaatgggcctatggctgttgccttacaagctgaan

SEQ ID NO: 22609 - DNA, 822 bp, Zea mays
  misc_feature: Ceres CLONE 1392463-F
  misc_feature (37)..(37): n is a, c, t, g, unknown, or other
  misc_feature (38)..(38): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (48)..(48): n is a, c, t, g, unknown, or other
  misc_feature (49)..(49): n is a, c, t, g, unknown, or other
  misc_feature (51)..(51): n is a, c, t, g, unknown, or other
  misc_feature (780)..(780): n is a, c, t, g, unknown, or other
gggtggcccccccccccccgccggggccccgccccannannnnccccnncnccaaagctggagctccccgcggtggcggccgctctagaactagtggatcccccgggctgcaggaattcgcacgagaccattacctagaacatcctaatcgaaaaaagccatgtctctcgcgcgcgaggcagaccctcggcccggggtcatctcacgtcgcaagcacgcaagcagccgttctggaggccctcccctgccgtcccgccgctgatgcggcgcctcgggtctgccagcggcggaggcggccccgccccggtgctgaccaccgtcgctgttgagaagggccgccgatcgcgcgggcgctcagaaccgcggcttctccgttgtgaacataccatataggtgcgacggacgaacaggtcttggagattctgcgaggacgccagccggaacgggatcccgcttcattggtcgacccggacaagggagaccgggggaggacaagaaggttatcggtcttcttggcgacctacgagggaaggagggaaacctggcgtttaagggggacggaccggaagagttttgggccgctcgaccgaagaataaaattgggtcggaacaaaggggcacagggacgaatttttcgcatggaaagggtgtggcggggaaaccccttggaaaaaaacaccccccacaagaaaggggctcctcggggggccaccccaagggaaagcgccttgctttagggggcctgcggaaacggcacacaaacgggaggccgccctgggnggacgtttctggccttcgttgccaacagaaaaacaaacactc

SEQ ID NO: 22610 - DNA, 653 bp, Zea mays
  misc_feature: Ceres CLONE 1392465-F
  misc_feature: Encodes the peptide sequence at SEQ ID NO. 22611
  misc_feature (308)..(308): n is a, c, t, g, unknown, or other
  misc_feature (309)..(309): n is a, c, t, g, unknown, or other
  misc_feature (321)..(321): n is a, c, t, g, unknown, or other
  misc_feature (357)..(357): n is a, c, t, g, unknown, or other
  misc_feature (375)..(375): n is a, c, t, g, unknown, or other
  misc_feature (397)..(397): n is a, c, t, g, unknown, or other
  misc_feature (476)..(476): n is a, c, t, g, unknown, or other
  misc_feature (551)..(551): n is a, c, t, g, unknown, or other
  misc_feature (552)..(552): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
aagctggagctccccgcggtggcggccgctctagaatagtggatcccccgggctgcaggaattcgcacgagaccattacctagaacatcctaatcaaaaatatccaggaataaactgctcgtctcatcgaccgatggtggtgcccggcgtagtcatgggagagaagagcctcggaccgtggaggattagcaccgttgccgtctcggtcgctctagagaaagcagcggacgtgtgcctccatattcatagccgccgtgcatggattacgagtgacgcgatggtctcacaactgggcaatttcttaccgnnatttgagcgtgnacgcattgccgctgcactgcatggcgagcgatttancaacttcaaactctggtncagagcaggtaccacaggatgnagcgcatggaggatgctgtgatgagttcgtgagtggtctaggccgtcgtctcccagtcaactttgggttgctggaccgntgtctccttataatgtaattatttatttattttgaatagaactcctattatataggtaaaagttgtgacatttcnncnnnnnnnnnnnnnnnnnnnnnnnnnnnnnnnnnnnnnnnnnnnnnnnnnnnnannnnnnaaaaaagttatcgatcccgcccaaccctcgaggggggggcc

SEQ ID NO: 22611 - protein, 94 aa, Zea mays
  misc_feature: Ceres CLONE 1392465-F
  misc_feature (59)..(59): Xaa is any aa, unknown, or other
  misc_feature (63)..(63): Xaa is any aa, unknown, or other
  misc_feature (75)..(75): Xaa is any aa, unknown, or other
  misc_feature (81)..(81): Xaa is any aa, unknown, or other
  misc_feature (88)..(88): Xaa is any aa, unknown, or other
MVVPGVVMGEKSLGPWRISTVAVSVALEKAADVCLHIHSRRAWITSDAMVSQLGNFLPXFERXRIAAALHGERFXNFKLWXRAGTTGXSAWRML

SEQ ID NO: 22612 - DNA, 665 bp, Zea mays
  misc_feature: Ceres CLONE 1392469-F
  misc_feature: Translation starting site: 182
  misc_feature: SWISSPROT Homolog: EC 2.1.1.68 Caffeate O-methyltransferase
  misc_feature (319)..(319): n is a, c, t, g, unknown, or other
  misc_feature (338)..(338): n is a, c, t, g, unknown, or other
  misc_feature (366)..(366): n is a, c, t, g, unknown, or other
  misc_feature (371)..(371): n is a, c, t, g, unknown, or other
  misc_feature (393)..(393): n is a, c, t, g, unknown, or other
aaagctggagctccccgcggtggcggccgctctagaactagtggatcccccgggctgcaggaattcgcacgagaccattacctagaacatcctaatcgaaaagtcgcatcgcacgccatcagcagctagcgcgctcctcgagcccagcagagaaaggccggcagcgctaatcgtaatagccatgggctccaccgccggcgacgtggccgcggtggtggacgaggaggcgtgcatgtacgcgatgcagctggcgtcgtcgtccatcctgcccatgacgctgaagaacgccatcgagctgggcctgctggaggtgctgcanaaagggaggccggcggcgncaaggcggcgctggcgcccgaagaggtngttgncgcggatgcccgcggcgcccancgaccccgccgccgccgcggccatggtggaccgcatgctccgcctgctcgcctcctacgacgtcgtccggtgccagatggagggaccgggacggccggtacgagcgccgctactccgccgcgcccgtctgcaagtggctcacccccaccgaggacggcgtgtccatggccgccctcgcgctcatgaacccagacaagtcctcatgggagagctggactatctccaaggacgcgttgctggacggcggcatccgttcaacaaggcgtacgggg

SEQ ID NO: 22613 - DNA, 662 bp, Zea mays
  misc_feature: Ceres CLONE 1392472-F
  misc_feature: Encodes the peptide sequence at SEQ ID NO. 22614
  misc_feature (297)..(297): n is a, c, t, g, unknown, or other
  misc_feature (381)..(381): n is a, c, t, g, unknown, or other
  misc_feature (504)..(504): n is a, c, t, g, unknown, or other
aaagctggagctccccgcggtggcggccgctctagaactagtggatcccccgggctgcaggaattcgcacgagaccattacctagaacatcctaatcgaaaaaccgagccggcaagcaggctgtttacctgtttctgctagcaagccgagatgtggcgaaatttagaaagcctgaggtgtcggccgttcacgattacctttatgttcacgttcttctgcgtgcaaacgttccattcattggcgcaataaatgggcggcattcttgggacgcctctcttccatctttctttacatgcntgagtgtctgtcaatggactcaaaagctgggcggagaccgtcctcgaccgcattgaccccgccgtggcacgccctcgaggccgncgacgacgcaggcgcgaggcgccggagggtccgcccatgacgtcgtccgtgcgggagtggtggcgccgcgcccgcgctgcgctcaaggacagggaggagctgctcctgggcggctgcgccccngcgggccgggtcgtcgtcgtggcaccaccgggagctggaggcggccgtgatccgcgcgacgagccacgaggaccggtggatggactaccggagcgccgcgcgggttgttccccgtgggccccctcttcccccacttcatccgcccgcattgggggggg

SEQ ID NO: 22614 - protein, 81 aa, Zea mays
  misc_feature: Ceres CLONE 1392472-F
MTSSVREWWRRARAALKDREELLLGGCAPAGRVVVVAPPGAGGGRDPRDEPRGPVDGLPERRAGCSPWAPSSPTSSARIGG

SEQ ID NO: 22615 - DNA, 661 bp, Zea mays
  misc_feature: Ceres CLONE 1392475-F
  misc_feature: Encodes the peptide sequence at SEQ ID NO. 22616
  misc_feature (436)..(436): n is a, c, t, g, unknown, or other
aaagctggagctccccgcggtggcggccgctctagaactagtggatcccccgggctgcaggaattcgcacgagaccattacctagaacacctaatcgaaaagatttcttctcttaactctcgcgtctcgcgtccttttcccttcctcccctccgttgcgtccgtcgtctgcgttgcgtccctccgtccgtccgtccgttggcccgtccgtcgtcaccagcctcctccctcgcgcccaccgccgggatccggccctcctcgtctgcgcccgcctcggtctagatttctgagaaaatggcgagaagtgcgggaactaggaggcgtgtggctcgccagctcaagtccacacatcccattccttcataccgatggaagtcaaagcccatgaaaaagccgatgaaaaaatccacccgaaagcaagtgttgccaaccttgcnaaagatggactgggaagatgccaattgctctgtgtgcatggaataccaacataatgctgtgctcatcctttgtctcccatggataaagggttgtcgtcctttatatgtgtgggactagctacccgcactctaatggcttggatcagttcaagaagctacaccaaggggcatgggctttgaggaagtcctgcaaaatagggtggctctaatctggaatcggcggca

SEQ ID NO: 22616 - protein, 86 aa, Zea mays
  misc_feature: Ceres CLONE 1392475-F
  misc_feature (48)..(48): Xaa is any aa, unknown, or other
MARSAGTRRRVARQLKSTHPIPSYRWKSKPMKKPMKKSTRKQVLPTLXKMDWEDANCSVCMEYQHNAVLILCLPWIKGCRPLYVWD

SEQ ID NO: 22617 - DNA, 792 bp, Zea mays
  misc_feature: Ceres CLONE 1392486-F
  misc_feature (9)..(9): n is a, c, t, g, unknown, or other
  misc_feature (13)..(13): n is a, c, t, g, unknown, or other
  misc_feature (20)..(20): n is a, c, t, g, unknown, or other
  misc_feature (70)..(70): n is a, c, t, g, unknown, or other
  misc_feature (84)..(84): n is a, c, t, g, unknown, or other
  misc_feature (792)..(792): n is a, c, t, g, unknown, or other
ttttttttntttnttttttnttttgtttgccccccgcccttcgccgatgtggcccgccacgcgcgagaantggcaagggcgccngttaaaagtggagctccccgcggtggcggccgctctatactagaggatcccccgggctgcaggaattcgcacgagaccattacctagaacatcctaatcgaaaaatgccaagaagagccggcctacccattccttctcccagccgtcgagctgcccaacccagagcaccagcagcccgcatcttcctcctctcggacggaccttcagacgagacagctcggcgaggagccgccgccgggctcgttctggacgaacgcacaagcagattgcatctgtggatgctctaagggagaccaaaggtgacgacaaccccaggcgtagccagcgagctccactggccgaagcaccccttgcctacacgatcgaggacgctcccccagccggcggaatcgggaagttccagaactgctgctcacccccactgcgcccgccagcccacccggaatcgccccgaatgccagtccgcggcacgagtagagatcgcccctccccgcaatccctcattgcgggcggggagtctctcccgctgggctcctggcctcgcatccctccgggttccccggacatcgccaaccttggcccccggcccaagcccctccttcgttcctattgcccgatcccctcaatttttacttggcataccccggatcacatccaaggggcccggcacggtcactcccactccacagaacctctggaagacccccn

SEQ ID NO: 22618 - DNA, 623 bp, Zea mays
  misc_feature: Ceres CLONE 1392489-F
aagctggagctccccgcggtggcggccgctctagaactagtggatcccccgggctgcaggaattcgcacgagaccattacctagaacatcctaatcgaaaaatcttgctctgaacgcattcctcccatctcccaagacctcctcagacccgagaagcgcatctgcggccatgggacgccaccggtactggagctggagggaaggcgaagaagggagcggccggtcgcaagggcggcgggccgaggaagaagtcggtgacgaggtccgtgaaggccgggctccagttccccgtcggacgcatcgggcgctacctcaagaagggccgctacgcgcagcgcgtcggcagcggtgcccccgtctacctcgcggccggcctggagtactctcgccgctgaggtcctggagctcgccggaaacgctgccaaggacaacaagaagacgcgcatcgtcccgcgccacgtgctgctggcgatccgcaacgacgaggagctcgggaagctgctgaccggcgtgaccatcgcccacggaggcgtgttgcccaacatcaacccggtcctgctgcccaagaagacggcggagaaggtgtccagcgtggggagcaaggaggtcaagtcgcccaagag

SEQ ID NO: 22619 - DNA, 646 bp, Zea mays
  misc_feature: Ceres CLONE 1392501-F
  misc_feature: Encodes the peptide sequence at SEQ ID NO. 22620
  misc_feature (248)..(248): n is a, c, t, g, unknown, or other
  misc_feature (249)..(249): n is a, c, t, g, unknown, or other
  misc_feature (373)..(373): n is a, c, t, g, unknown, or other
  misc_feature (428)..(428): n is a, c, t, g, unknown, or other
  misc_feature (458)..(458): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (475)..(475): n is a, c, t, g, unknown, or other
  misc_feature (476)..(476): n is a, c, t, g, unknown, or other
aaagctggagctccccgcggtggcggccgctctagaactagtggatcccccgggctgcaggaattcgcacgagaccattacctagaacatcctaatcgaaaaccggaatggtatcgtgcgacctgtagtcgtcgccagccacctcgctccctcctagacgacacccagctagtgctcccttccacacccaggaaccagccacctaaccccgcccgccatgccgggcctcgccgcctccgacaactcgnnccccggcgccggcgccgccgccgcgccggctctcgtcgccgctaccccgtcgcgcgccgtcgtccccgtcgccgtccgcctcctcgcgcgccaagcctcggaagccctcgccctctcccgcggncttccccaccgacgccgacgactcgctcgacaacccggatctggggccctttctncctcagcaggcgcgcgacgccatggtgtcnagnnnagggcggtggcnnccccgcgcgcactcgagttccgcgagcgcgccgccatggcgttcgagcgacccgggggaggggcgccagctcgagctcgcagggacccccacggtcgccgcggcaatcaatggggggctgggccgccagggtgagggcatccccgccttgaggggggcggtctaaaattc

SEQ ID NO: 22620 - protein, 63 aa, Zea mays
  misc_feature: Ceres CLONE 1392501-F
  misc_feature (4)..(4): Xaa is any aa, unknown, or other
  misc_feature (5)..(5): Xaa is any aa, unknown, or other
  misc_feature (9)..(9): Xaa is any aa, unknown, or other
MVSXXGRWXPRAHSSSASAPPWRSSDPGEGRQLELAGTPTVAAAINGGLGRQGEGIPALRGAV

SEQ ID NO: 22621 - DNA, 776 bp, Zea mays
  misc_feature: Ceres CLONE 1392509-F
  misc_feature: Pfam Name: Syntaxin-6_N Pfam Description: Syntaxin 6, N-terminal
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
cccgcccttgccgcgcccgcggtgggaggcggggggggccagcctcccccgcgggggctgggtgcgcggatctgggcgcccccggatnnnnacaaagctggggactccctcgccggggggcgggcgcctctagaactacgtggatcccccgggcctgcaggaattcgcacgagaccattacctaaaatcttattcgaaaaatccccaccacgtccagcaccaggcaaggatatagcggtgcagctagagctggccggaaagaagaggaaagccaggcacgccgctcacccaccgcgccaccaaccgcagatcctaaatccgatctctctctccctccctccctccctcccgctcgaggttttggcgatcgatccggtgagcgggcgagatcttcatggtcgacgctccctcgaccgctggcacgaaggaccccttcttcctcgccgacgaggaggtccaggaatccgccgatcggcgacggcaatcggtccatcggctatgggtgcacgagaggagcgggggcgatttccaggcgggcaaggcgacacttcgcccaggcccctaccaggtgcgcagctttcccccgggagctggcacaactggaggatttgggaccggtcaaggggcactgttgagggactggcgcggggacgtaggatcccaaccccctggggtatggcaagcccgcaacccaccccaagggttacgcctgcatcaccttggataaaggcattcggtcattcgcacacttatcaggtcctacgaattacttggaa

SEQ ID NO: 22622 - DNA, 631 bp, Zea mays
  misc_feature: Ceres CLONE 1392515-F
  misc_feature: Encodes the peptide sequence at SEQ ID NO. 22623
aaagctggagctccccgcggtggcggccgctctagaactagtggatcccccgggctgcaggaattcgcacgagaccattacctagaacatcctaatcgaaaagaatacaccacccctcgtctccccacggaggccgtcctctcctctcctctgcgtccgccactgcccaccgctcgcccgcgcgcgctccattacctcggcgggcgatggccgacctatccaacaccggctccacctaacacgagcagcgcccccgcctaggcggcagctggctggtcggtcgtcgagcagctagcggcggcagcgcccggagggaggccgtctcactctcctcgtcggggcggcaggagatggaggccatcgtgggcgtccgcgcgccgccgcgtggccgtgcctgggccggcctcgagaagccgccgcgcgccgcttgccgcgccagagtcccgacggcgaggctcgcggtcgcggcggacaggccgcggaggctggtgctgctgggcgccgatacgcggagggccgcggatcctgccctccgttgcgccgcgcaatctgcaggtggaacaggaaaggtccactactctgctgatgacgctctcatactacaggttaggaaaatatgcaccaccccacc

SEQ ID NO: 22623 - protein, 93 aa, Zea mays
  misc_feature: Ceres CLONE 1392515-F
MEAIVGVRAPPRGRAWAGLEKPPRAACRARVPTARLAVAADRPRRLVLLGADTRRAADPALRCAAQSAGGTGKVHYSADDALILQVRKICTTP

SEQ ID NO: 22624 - DNA, 752 bp, Zea mays
  misc_feature: Ceres CLONE 1392522-F
  misc_feature: Encodes the peptide sequence at SEQ ID NO. 22625
  misc_feature (62)..(62): n is a, c, t, g, unknown, or other
tttttttctttttttgcctctttcccctcgatggcgaccgctggccccgctcccccgggagnattttagcccgccccttcaaagctggactccccgcggtggcggccgctctataatagtggatcccccgggctgcaggaattcgcacgagaccattacctagaacatcctaatcaaaaagtaaattcttataatagcttacagggaaaagactcttcaatctgaagcaaaatgtaccgggaatgctgaagagcgggactcttaagcagtagtgagatgcggcggtggtggtcgccggcgttggcggctgtggagccgcggtccgtgcagctcctgctcctgggcgtcgctctcgtcgcagtttctttctacgccggcaccctcttcggctcctccgcgtcccctgcgctcgtactgcccccttcgcgcccccgatcgcccgattccttcatggccaaagttacagatgttccagtgtttaccaaacagagtttctcgcacgtaccgggccaaaataagtgacaggtccagatcacggaagatgatgtggggccccttggaaaaacaatgaggatggcccccctgcccatgatggcagccctatataaccaagcttggaaaaaccccgggatacctcccaggccatggcggctccccggaaaagtaatttgccccccccatgggcaaaaaagcgggacggttttcgcttggggggccccccctcccaactggactacccacgaacaccccat

SEQ ID NO: 22625 - protein, 81 aa, Zea mays
  misc_feature: Ceres CLONE 1392522-F
MRRWWSPALAAVEPRSVQLLLLGVALVAVSFYAGTLFGSSASPALVLPPSRPRSPDSFMAKVTDVPVFTKQSFSHVPGQNK

SEQ ID NO: 22626 - DNA, 663 bp, Zea mays
  misc_feature: Ceres CLONE 1392525-F
  misc_feature: Encodes the peptide sequence at SEQ ID NO. 22627
tccccgcggtggcggccgctctagaactagtggatcccccgggctgcaggaattcgcacgagaccattacctagaacatcctaatcgaaaaataggaaaaacgactccacacggtccacggcgtcgtctccggcgaaccttcgcgagccctcggctcccctctaccaccgctgccgcgaccccgcctacggagcatcctcgggtagcgctctggcttcccgtgccggcggacgtcctgcaggaggcggcggcctccgtggcatgttgatgagggccgccgctgccctccctcgccgatcgtcgcggccctcggagccgggggcctcctcctcccgggttctagccttggagcctctgtccagtcggacatccggccgccctattaccgtacgaacctttgatgcatttgctggcacgacacttgcgggttgaactgctaccacaacttgtgctaggaagccttgctgcctactctcagcaacagcagattcttccattcaaccaagtggctgcattgaactctgctgcttatttgcaacaacaactaccattcagtcagctagctgctgcctacccccagcaatttcttccattcaaccaactggcagcattgaactctgctgcttatttacaacagcaacagctaccaccattcagccagct

SEQ ID NO: 22627 - protein, 87 aa, Zea mays
  misc_feature: Ceres CLONE 1392525-F
MHLLARHLRVELLPQLVLGSLAAYSQQQQILPFNQVAALNSAAYLQQQLPFSQLAAAYPQQFLPFNQLAALNSAAYLQQQQLPPFSQ

SEQ ID NO: 22628 - DNA, 631 bp, Zea mays
  misc_feature: Ceres CLONE 1392528-F
  misc_feature: Encodes the peptide sequence at SEQ ID NO. 22629
  misc_feature (368)..(368): n is a, c, t, g, unknown, or other
  misc_feature (377)..(377): n is a, c, t, g, unknown, or other
  misc_feature (416)..(416): n is a, c, t, g, unknown, or other
ggcggccgctcttcaatagtggatcccccgggctgcaggaattcgcacgagaccattacctagaacatcctaatcgaaaaaccgaggccaaaggccaccaccattccttccccaactctgcaggctgctcgtcgccctccctccacgccggacgcgccccgatccagatccaggggcgtaacatggcatcaaaacgtatcctcaaggaattaaaggacctgcaaaaggaccctccaacgtcatgcagtgcaggtcctgctggtgaggatatgttccactggcaggcaaccatcatgggtcctcctgatagtccatatgctggaggtgttttcttagtgaacattcatttccccccggactaccctttncagcctccnaaggtatcttttaagacgaaggtcttcccatcaaacatncatagtaatggaagcatatgtctcgacattcttaaggagcagtggagccctgctttgacaatctctaaaggtttgctttctatctactcgctgcttactgatcccacccagacgatcctcttgtccctgaaattgctcacatgtacaagacgaatcggccttagacgagggaaacagccggagctggacccaaaaattgccatggaatgaaaagg

SEQ ID NO: 22629 - protein, 147 aa, Zea mays
  misc_feature: Ceres CLONE 1392528-F
  misc_feature (5)..(121): Pfam Name: UQ_con Pfam Description: Ubiquitin-conjugating enzyme
  misc_feature: SWISSPROT Homolog: EC 6.3.2.19 Ubiquitin--protein ligase
  misc_feature (62)..(62): Xaa is any aa, unknown, or other
  misc_feature (78)..(78): Xaa is any aa, unknown, or other
MASKRILKELKDLQKDPPTSCSAGPAGEDMFHWQATIMGPPDSPYAGGVFLVNIHFPPDYPXQPPKVSFKTKVFPSNXHSNGSICLDILKEQWSPALTISKGLLSIYSLLTDPTQTILLSLKLLTCTRRIGLRRGKQPELDPKIAME

SEQ ID NO: 22630 - DNA, 714 bp, Zea mays
  misc_feature: Ceres CLONE 1392534-F
  misc_feature: Encodes the peptide sequence at SEQ ID NO. 22631
  misc_feature (508)..(508): n is a, c, t, g, unknown, or other
tccccgcggtggcggccgctctagaactagtggatcccccgggctgcaggaattcgcacgagaccattacctagaacatcctaatcgaaaactcctgcctcgtacgtcctctgcgcggtacccggggggcggggagtcctcttgtccgcaccatcgcctccgctccgattcgccgaatcggcgctggcgggcgagacgtggatctcgacggaggagactccgaccatcgctccatggaggccgcggactctgaatccgtcatctccaccttcacctgtccgcactgtcagcgggaggttccatcttcaaacattgcattgcacagcgcgcactgcgctcggaaccttcagaagtgcgaacattgcggagatatggttgccaggaagcttatggatgaacactacgatgaaaaccatgcttcgatgaattgctcactttgcaaacacacagtagaaacgcgagctatgggatcttcatacaggcatacaatgcccacaaaggatgctcngcgtgcaaatactgtcagtttgaactgccctgcagtttgatctttttgaacatcagggatctgtggtggaaatcgggacagaaaattgccaaaggtggcagaagtataatcaaacttcgcggagggatgggacttgaactcccgttccataccaatttggaaggtgcctccaaaccttcaagtggcccgactcgggcaccacatac

SEQ ID NO: 22631 - protein, 104 aa, Zea mays
  misc_feature: Ceres CLONE 1392534-F
  misc_feature (92)..(92): Xaa is any aa, unknown, or other
MEAADSESVISTFTCPHCQREVPSSNIALHSAHCARNLQKCEHCGDMVARKLMDEHYDENHASMNCSLCKHTVETRAMGSSYRHTMPTKDAXRANTVSLNCPAV

SEQ ID NO: 22632 - DNA, 718 bp, Zea mays
  misc_feature: Ceres CLONE 1392535-F
  misc_feature: Translation starting site: 219
  misc_feature (346)..(346): n is a, c, t, g, unknown, or other
  misc_feature (377)..(377): n is a, c, t, g, unknown, or other
  misc_feature (378)..(378): n is a, c, t, g, unknown, or other
  misc_feature (393)..(393): n is a, c, t, g, unknown, or other
tccccgcggtggcggccgctctagaactagtggatcccccgggctgcaggaattcgcacgagaccattacctagaacatcctaatcgaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcggtgtcgacggcctcccgccggggcctccgggttggccggtggtggngaacctgttccaggtgatcctgcagcgacgnnccttcatgtacgtgntgcgcgacctcccgggagaagaacgcccccctcttccccatgcggatggggcaacgcaccctctttggggtcaccctcgggaacctcactcccgaagctcttgctaaacaaggcccccctgttcccacacccgcccggaaaaagccccacccggttcctcttacagggattgaaaggccaccccactttcggagaccatagcaccccgggggtggggcgccgccccccacacctctcactcacaaatatcgacccgcctcctgagccaggcgttccaatgtgcaccaggataaattgttctctcctccgttcgtcccttctctgc

SEQ ID NO: 22633 - DNA, 706 bp, Zea mays
  misc_feature: Ceres CLONE 1392538-F
  misc_feature: Encodes the peptide sequence at SEQ ID NO. 22634
ttttttgctcccctttcccctcttctccccaaccccccccaccccaaaacacaaaactgcaactccccgcggtggcggccgcttttcaatagtggatcccccgggctgcagtaattcgcacgagaccattacctagaacatcctaatcgaaaagtaccatgttcaaaacgaaaagtctgatctgaagccagcagacgtgaaaccgacagcacgtacgtacgtacgtgtgagggctgctcggcggccatgggagaatggtgcttcaagaaacgcgcagctctggtgattattgtggccattattagctcgctgcagctgctcctaataactgctcaagaagctggaggagaccacgaggtgtggtcgtcgtcatcctcgccggccggtggtcgtggtggcggcgcccgtcgtcgtcccgacggcgcggatggggccggaaggttcgcattcctgttccggcccagaagccctgttgtcgaccaaagcaacgcccaccctctggccagggaatccccggcttaaccggggaaataataaagaccgggggaaaaggggggaaccggggaccaatggtccgccttcccggcgggagaaaatattcccccaaagaagaacctcacgaaacccggggcaaattttcccgggaggggctccctctttctgccatatattggacgctctcgcaaagaggggggcgggcagcccg

SEQ ID NO: 22634 - protein, 91 aa, Zea mays
  misc_feature: Ceres CLONE 1392538-F
MGEWCFKKRAALVIIVAIISSLQLLLITAQEAGGDHEVWSSSSSPAGGRGGGARRRPDGADGAGRFAFLFRPRSPVVDQSNAHPLARESPA

SEQ ID NO: 22635 - DNA, 700 bp, Zea mays
  misc_feature: Ceres CLONE 1392542-F
  misc_feature: Encodes the peptide sequence at SEQ ID NO. 22636
  misc_feature (597)..(597): n is a, c, t, g, unknown, or other
  misc_feature (700)..(700): n is a, c, t, g, unknown, or other
gctctagaactagtggatcccccgggctgcaggaattcgcacgagaccattacctagaacatcctaatctaaaaaaaaccctcttcgtcgatcggtgtccctagcctccccctgcccggctgtcctcctcgatttcgcaagctcctggttacggcggcatctatcgttccgccgcaagggccgcatcgtctctctcgcgacgctgccccagaccgccgagataatggctggccaccgaaacagtcatggaaagcgccagtctgattttactgaaaatggaggcagtaagagaagaaatcctggcgatgatacatatgcacctggtcctgatgacactgtgtatcgctacctctgtgcctctagaaaaattgggagtatcattggcaggggtggagaaattgcaaagcagttgaggactgagacccaagctaagatcaggattggcgagagtgtccctggatgtgatgagcgagttgttaccatatttagcacaagcaggaaaactaataccatcgatggtgctgaagatgaggtttgccctgctcaggatgccctctttagagttcatgacaggcttgccagtgatgaggctcttgngcactaataccgcgagtaatttccactacagtaactgttccctcgcttgggccatcaacccaaatgcttgctttattgcaaaggtggtcaaacatcccagaan

SEQ ID NO: 22636 - protein, 126 aa, Zea mays
  misc_feature: Ceres CLONE 1392542-F
  misc_feature (39)..(104): Pfam Name: KH_1 Pfam Description: KH domain
  misc_feature (125)..(125): Xaa is any aa, unknown, or other
MAGHRNSHGKRQSDFTENGGSKRRNPGDDTYAPGPDDTVYRYLCASRKIGSIIGRGGEIAKQLRTETQAKIRIGESVPGCDERVVTIFSTSRKTNTIDGAEDEVCPAQDALFRVHDRLASDEALXH

SEQ ID NO: 22637 - DNA, 712 bp, Zea mays
  misc_feature: Ceres CLONE 1392544-F
  misc_feature (712)..(712): n is a, c, t, g, unknown, or other
tcaccgcggtggcggccgctctagaactagtggatcccccgggctgcaggaattcgcacgagaccattacctagaacatcctaatcgaaaaatgtgaggagaccgcggtgggttgctttgatgcttgtcaattaacgcacgctatgggcacttccgctgccgtcgtgcggcgcgcctgcaactgcaacgctaccacctcgactcgcccctgctagcagcatccgggaagctgccctgccactgccaggctgccacaccgaggtgctcccttgactccctctcctctcctcttctcgcgcacgtggtctgtgcccgtacgcggcggcgctgccgctcaccagaccggccgccgccacgtctgcttccgcgcctccccgcctcctcaccgtccgcccccttttacctgcctgatcattttattataaatggtggggcgagagaactcatcataagcactggcatcaaggtcatgttacctcggggaattccaacaacaaaaagcatgataagcggcagccaaaatttataccagacaattatagctccgtcgatgaggttactactgctctgcgagaagctggcctcgaatcgtcaatctaatcctcgggattgattccccaaaagcaaggagtgggcaggcaggatttcctttaaaagaaatctctgcatgccattaaggcaccccaaatcctatgaacaagctatctctatn

SEQ ID NO: 22638 - DNA, 737 bp, Zea mays
  misc_feature: Ceres CLONE 1392545-F
  misc_feature: Encodes the peptide sequence at SEQ ID NO. 22639
  misc_feature (555)..(555): n is a, c, t, g, unknown, or other
  misc_feature (613)..(613): n is a, c, t, g, unknown, or other
  misc_feature (635)..(635): n is a, c, t, g, unknown, or other
  misc_feature (642)..(642): n is a, c, t, g, unknown, or other
tccccgcggtggcggccgctctataactagtggatcccccgggctgcaggaattcgcacgagaccattacctagaacatcctaatcaaaaactttccccgcctccatcaccaattcacgatctcctttcccgcaccgcgccccggatcgccggctcgcaattccggagttaaattcccctccaccgcaaccgtcatgggcggctcccacagccgcgaggacgtcgatctcacctcctccgacgaagaggaggaattcgaggacgactatgacgcccgatcccatcgcggaggccgcagcgagcgcggggcagcgcgacgacgacctcctccgcaccgccacaccttcctcgcttgaggccatcgacgccaagctcaggtcgctggatctcaagtaccagagacctaccgccgccaagctctacctccacgtcggcggggcctcgccttccgcgcgctgggtgcccgccgagcgccgcgcgacctacgcattcgtcgaccagtcgagcgacgacgcctcctccccccaggggttccctagaggtttgggccggggnccgcgggtctccgcgcccgtggactcggcgctccagctgaagacgatccccgcgcagncgccgggcggacttcgccgcgnagggggncccgaatgggctctgcgactacccacccgacgcgaaattgcgccgggttaaggggggaataacaagcgctgtccttttcaagaaaaagcacagag

SEQ ID NO: 22639 - protein, 141 aa, Zea mays
  misc_feature: Ceres CLONE 1392545-F
  misc_feature (116)..(116): Xaa is any aa, unknown, or other
  misc_feature (123)..(123): Xaa is any aa, unknown, or other
MTPDPIAEAAASAGQRDDDLLRTATPSSLEAIDAKLRSLDLKYQRPTAAKLYLHVGGASPSARWVPAERRATYAFVDQSSDDASSPQGFPRGLGRGPRVSAPVDSALQLKTIPAQXPGGLRRXGGPEWALRLPTRREIAPG

SEQ ID NO: 22640 - DNA, 681 bp, Zea mays
  misc_feature: Ceres CLONE 1392546-F
  misc_feature: Encodes the peptide sequence at SEQ ID NO. 22641
  misc_feature (634)..(634): n is a, c, t, g, unknown, or other
aagctggagctccccgcggtggcggccgctcttcaatagtggatcccccgggctgcaggaattcgcacgagaccattacctagaacatcctaatcgaaaaacttctacctggcctcgcaggcttcgcaaggcggccacacgccgatacctcctccttcacccgctccgtcgtcccccccagccggccacgccaccatgctgccaccggccgcgcgccttgcggcccgccgcctcctcggcctcgcctccgcatctgcgtcggaagccgccggccgccgggtagcttcctctccgatcgcttccgcaggctactccgccgccgcgtccaggggctccgtctccagcaccaggcccttctccacggctcttaactaccaccttgactcgccggagaacaagccggacatgaaatgggagttctcacaggcgaatatgaagaaggtcaatgagattctgtctcactatccaagcaactacaagcaatctggtattattccgctgcttgatcttgcacagcagcagcatgggtggatgggtgccagttgcagcaatggatgctattgctaaaaattgtcgaagttgcaccaatcaggggtctatgaagttgcaaccttctatacaatgtttaacaggnactaaggttggtaaaaccaccctttttggtgtgtggaactacacctg

SEQ ID NO: 22641 - protein, 123 aa, Zea mays
  misc_feature: Ceres CLONE 1392546-F
  misc_feature: SWISSPROT Homolog: EC 1.6.99.5 NADH dehydrogenase (quinone)
MLPPAARLAARRLLGLASASASEAAGRRVASSPIASAGYSAAASRGSVSSTRPFSTALNYHLDSPENKPDMKWEFSQANMKKVNEILSHYPSNYKQSGIIPLLDLAQQQHGWMGASCSNGCYC

SEQ ID NO: 22642 - DNA, 738 bp, Zea mays
  misc_feature: Ceres CLONE 1392550-F
  misc_feature: Translation starting site: 235
  misc_feature (367)..(367): n is a, c, t, g, unknown, or other
  misc_feature (412)..(412): n is a, c, t, g, unknown, or other
  misc_feature (513)..(513): n is a, c, t, g, unknown, or other
aagctggagctcaccgcggtggcggccgctctattactagtggatcccccgggctgcaggaattcgcacgagaccattacctagaacatcctaatcgaaaaacaacatctgtcaccgtgaaatctcggctacctccttctgacttctggtacctcgccgccggggacccaactccgatccccaccccaccataccaaagccaccgcggctgcggctgcggcttccgcatcatcaatggtgctgatcactctcgtccgcgactacatcgaccgcatgctccacgacatccctggcatgaaggtcctcgtcctcgacccccaaaccgttgggatggtgagcgtggtgtacagccagtcggatctgctgncggaaggaggtcttcctcgtcgagaccatggacaacgcctccagnctccagggagtccatggcgcaccctcaaggccgtctacttcctccgaccctccgctaacaacgtccagaaaagctccgcaggcacctcgccatgcggcgcnttcgccgagtaccacctattcttctccgggaatatatggaagggccccgcagattcaaatacttgcttgactcgatgggaaaaagggagggttgcggcgcaagggtccaggaggtcctatgggggatttttggggccattgaccccataccattttccctctccaccatacaaaaaaaaccaacatggattatgctcccccaacagggggtccgacccctccatg

SEQ ID NO: 22643 - DNA, 726 bp, Zea mays
  misc_feature: Ceres CLONE 1392551-F
  misc_feature: Encodes the peptide sequence at SEQ ID NO. 22644
  misc_feature (441)..(441): n is a, c, t, g, unknown, or other
tccccgcggtggcggccgctctatacctagtggatcccccgggctgcaggaattcgcacgagaccattacctagaacatcctaatcgaaaacttccagttccagatcccataattgcacgcgacactacaccgcccccttccgcaagtcagagggacattgcattggggaactacagaaaagggtccgaatcgaatccgtggtgcactgccccttcctcccccacaagccgccgccgccgccgtgaggactccggcgaatggcgtcccgcgtcgcctcgggcctcctccgccgccgcgccggcgccacactaggcctcctaaggagttatgcacatgtcagaagctacaacagtcaactttcagctttggtttctgctacatctgaatgctcaaatctgccgagaagatgctattacttacctaatccctctcccataccnagtttggagtaggtcatttgcttcagacaacgaaaacagttttgagcttgttgggcccttcatgggtgaacctggaaatgatgaaaaccctggttaactccttaaaaaaacctggaaaaagaagccaaggctgatgaaccaattgggcaaaatggaaactggaaaaggcccctataaatgggccaaaggccctggagggggtggtaattgaaaaagctcttgggcttggaaaagggaacaaatttctccccggagaaaaaggggggaacaaattccagagggggg

SEQ ID NO: 22644 - protein, 64 aa, Zea mays
  misc_feature: Ceres CLONE 1392551-F
MASRVASGLLRRRAGATLGLLRSYAHVRSYNSQLSALVSATSECSNLPRRCYYLPNPSPIPSLE

SEQ ID NO: 22645 - DNA, 728 bp, Zea mays
  misc_feature: Ceres CLONE 1392554-F
  misc_feature: Translation starting site: 404
  misc_feature: SWISSPROT Homolog: EC 2.6.1.2 Alanine transaminase
  misc_feature (529)..(529): n is a, c, t, g, unknown, or other
  misc_feature (590)..(590): n is a, c, t, g, unknown, or other
tccccgcggtggcggccgctctagaactagtggatcccccgggctgcaggaattcgcacgagaccattacctagaacatcctaatcgaaaacactcgctttccggcgggcgactggcctaaaatcgcctcttgtttgtttgcttccgtcgtcccctctccacgtagagcacgcccccggaccaccttttataagcaccaaccatctggccttgccgcgccgattcgccacgaagccgcactgtgagagagggacgcggcctgttgtcccggcttttagacgcaacttccatcgctgcgaagctatccattcgtgttcgtcatggccgccagcgtcaccgtggaaaacctcaaccccaaggtcttaaaatgtgagtatgcagtccgtgggggagattgtcatccatgctcagcgcctgcagcaacaactacaaacacaaccagggtctctttccttttgatgagatcctctattgcaacattgggaatccccaatctcttggtcagcaacctgtgacatcctttcagggnaggttcttggctctttgtgatcatccgtgcctcttggaaaaagaggaaccaatccattggntcagtgctgatgcaatttctcgagcaaagcagattcttgcaataatttcctggaagggcaacaggtgcatatagtcacagtcagggtatcaaaggactgcgtgatgcaattgctgctggaatcatgtcacgtgatgga

SEQ ID NO: 22646 - DNA, 754 bp, Zea mays
  misc_feature: Ceres CLONE 1392559-F
  misc_feature: Encodes the peptide sequence at SEQ ID NO. 22647
  misc_feature (15)..(15): n is a, c, t, g, unknown, or other
tttcccccccccccnccccccaaaaaacccctcccccaagtaataagaattcaaaatgtggctccccgcgggggcggacgcttttcccatagtggatcccccgggctgcaggtttccgcacgagaccattacctagaacatcctaatcgaaaagaactatcagattgtcacaagctggtgaaggagcttctttctgagcatgaatatggattcaacatcggaattttcaaacgccgtttttcccaggagtatggatacgagcttgaacaccggaagctcgggtatctggaccttgaaacgctgctgcatattatgcctgatgtaagggtgaaattcccaagggtcatgcgctcagaacacgggaacggtcaggctggcagcaagggagacggaaaccgaagcagcggcgatgacttgatctgggaggagcttggtcctgtatctgccacaactgaaaccgccgccgccgccgctgatgcaggggccgacaaggaaacatgctatcgtcctcgcactccttcagacgacgagttctcggacagcgacagcataaaagaccggcagcccagaaggaacgccgagcagcagagctcgcttctccagatcattggaagcttggaacagcagcaaggggtggccgacgttctctaacaacaagcctcaaggacatccgaccgggatggggggaactgtttccgagaaagcaaccccggggccaggtgcttggccaccagccgcagctttccgggaaaaa

SEQ ID NO: 22647 - protein, 216 aa, Zea mays
  misc_feature: Ceres CLONE 1392559-F
FPPPPPPKKPLPQVIRIQNVAPRGGGRFSHSGSPGLQVSARDHYLEHPNRKELSDCHKLVKELLSEHEYGFNIGIFKRRFSQEYGYELEHRKLGYLDLETLLHIMPDVRVKFPRVMRSEHGNGQAGSKGDGNRSSGDDLIWEELGPVSATTETAAAAADAGADKETCYRPRTPSDDEFSDSDSIKDRQPRRNAEQQSSLLQIIGSLEQQQGVADVL

SEQ ID NO: 22648 - DNA, 741 bp, Zea mays
  misc_feature: Ceres CLONE 1392563-F
  misc_feature (741)..(741): n is a, c, t, g, unknown, or other
ggagctccccgcggtggcggccgctctacaactagtggatcccccgggctgcaggaattcgcacgagaccattacctagaacatcctaatcaaaaaacggtgacggccaccccgcccacagccgcgacaaactcttcctcagacccacgccacgcacgatgcctctctccccttcccctccgaccaacgccggcgccggcggcgacctacccctcctcctgctgttcgtctgagccagaagcagtggcgcgaagccgctgccgtcgtcacagggcaaggcgcccctcaggctgagccgtctgtatgactacccggcgccagaccatccttcgcgtgatcgaggataagcatgatatggacgtccgagccgaccctgcaagcagcttgctgaccccgaccaaccccccgacttgacaaagtgtttagagatggttgaactccacaatcccctcgctcaacacgtgcgaaccctactgatatgagagatacccgtgcccgaaatactgataccatactggataatcaccccccccggcccgtcgaaaggcggaagccaccccccttgcgccaaacctcccgtgtacccttgtctcaccccccacctccaccccctctcctcccttcaaaaccaccaagcgccgacacacaaccccgcaccactgcacttcttcgatcaaacactacaccacccgtcctaaatcgccgaaactccacccccacacactcccgcccggctctccn

SEQ ID NO: 22649 - DNA, 842 bp, Zea mays
  misc_feature: Ceres CLONE 1392568-F
  misc_feature: Encodes the peptide sequence at SEQ ID NO. 22650
  misc_feature (46)..(46): n is a, c, t, g, unknown, or other
  misc_feature (47)..(47): n is a, c, t, g, unknown, or other
  misc_feature (842)..(842): n is a, c, t, g, unknown, or other
ccgatggagccccacccccccccttctacgatcgcccgcgccccgnngggggcaaaactgggactccccgcggtggcggccgctctagaatagtggatcccccggggtgcaggaattcgcacgagaccattacctagaacatcctaatcgaaaagatggtctcggactcttgtcacggtccttcctgactgcccccacttctcctccggcggagcggcggaggattacctcccaacagcccgaccatggaagccgacgtcgctttcaggtatgacatctcccggaccgcccagttcctccgcgacggcgcctacaccagggtcgcgctccagttccccggcgagatgctgaaggatgctgctgccgtagccaagagcagtacaggacgagagcttgactccggcagctgccgacagggggagttcaggggcgtcagtgatggcacaacacgggggtacaaactcctgcgtggagaggacagaaggtgggcggcgatccaacaatcaaatagcggcgagagacggccgagcgacgtaaaggaccacagccatgccatgaaaggcccaaacaatcaaaaaagttaggacaagaatatacttaaagaatattaggaaaaaaaccacaccccgatggatggtgcaaccgctaatattcggcggcgaaaaataagaggagaaaaggggctcaaacggaaaggaggacaacgaagcgcgaccattactcgacggttttataaatgagtaacgaaatagagtaaccaagatgaaggcctttcagggaataaactccagaagaggacacacacgtatgagcatagggagtgcacaacaggcaaaccgaan

SEQ ID NO: 22650 - protein, 112 aa, Zea mays
  misc_feature: Ceres CLONE 1392568-F
MEADVAFRYDISRTAQFLRDGAYTRVALQFPGEMLKDAAAVAKSSTGRELDSGSCRQGEFRGVSDGTTRGYKLLRGEDRRWAAIQQSNSGERRPSDVKDHSHAMKGPNNQKS

SEQ ID NO: 22651 - DNA, 733 bp, Zea mays
  misc_feature: Ceres CLONE 1392569-F
  misc_feature: Encodes the peptide sequence at SEQ ID NO. 22652
  misc_feature (430)..(430): n is a, c, t, g, unknown, or other
  misc_feature (464)..(464): n is a, c, t, g, unknown, or other
tccccgcggtggcggccgctctagaactagtggatcccccgggctgcaggaattcgcacgagaccattacctagaacatcctaatcaaaactttctgctgcccagccgccgtccgtccgcgcttcactatccttcattccctcccctgtcagcgacgactgggtaggctaccgccgccgccctacgctaggtgcccatctcttcgccggcgaagagcgcccaccaagctccggccaagggcgtgatggcggctgtaggcagcttgaagccggggatggagactcttcatgtgcaggactacaaggacgcgcctccggccaaggccgcggtagagagcctccagccggcgatggagagtctgcatgtgcaggattacaaggacgcgcctccggccaagggcgtggccgccgccgccgtagggagcttgcangccggggcggagaacctgcaggtgcaggactacnaggacggtaacatgtattatggtgcttacccggcttatgcttatggaggctatggggggttgggggaatacccaatcctggagcttggagggggaacaaaacccactggtggtaccaaggctggaatggactaggggtatgctccaatggcggggtaacccatgggcatgggggtcaaaatttatggatcacaaaaatcccaatacctacctcattccccacgcaataaaaactccgggccaagtcgtcctcaggggcaaacgggtaaa

SEQ ID NO: 22652 - protein, 117 aa, Zea mays
  misc_feature: Ceres CLONE 1392569-F
  misc_feature (62)..(62): Xaa is any aa, unknown, or other
  misc_feature (74)..(74): Xaa is any aa, unknown, or other
MAAVGSLKPGMETLHVQDYKDAPPAKAAVESLQPAMESLHVQDYKDAPPAKGVAAAAVGSLXAGAENLQVQDYXDGNMYYGAYPAYAYGGYGGLGEYPILELGGGTKPTGGTKAGMD

SEQ ID NO: 22653 - DNA, 715 bp, Zea mays
  misc_feature: Ceres CLONE 1392573-F
  misc_feature (605)..(605): n is a, c, t, g, unknown, or other
  misc_feature (681)..(681): n is a, c, t, g, unknown, or other
  misc_feature (712)..(712): n is a, c, t, g, unknown, or other
cgcggtggcggccgctctataactagtggatcccccggctggaggaattcccacgagaacattacctaaaacatcctaatcgaaaactctcattccagaggactccgtgtcgtcagggccgcttcgcgtgcgaggccggcatatatggtttcgccggagccgtggatggtacccaccccccgtgagacccgatcgctgggggcccagtcagggctctggcgtcgggccctccggcctccgccgatatggcctcaatttctccgcctccaggctcctccaggtccccatcgcggccctccttgagtactccggtgtagtccagtccggccctgccctggcggcgcaacaaccgtcagcggggccctcgttgccgttgtcgacgctggagtgcgactgccttcctgtacgttggcggcctctcccacaacgaccgcgccgtcgatggcgccaggaagtcatgcctgaagtttcttgatcctgagaagcttcgaaatttggaacttccagaaattcctgaaacaaatttgtcgatgaaggaagatctgtacggatgaaggctgccccatatctaaatgatacaccaccacgtacagaaaaattccggnttaactttgtcacaaggctaccggaaacttcctgtaagagaatataatctttagattagataaaatttttactctnactgctacgctttacgatgaatttctatttntcg

SEQ ID NO: 22654 - DNA, 671 bp, Zea mays
  misc_feature: Ceres CLONE 1392575-F
  misc_feature: Encodes the peptide sequence at SEQ ID NO. 22655
tccccgcggtggcggccgctcttcaactagtggatcccccgggctgcaggaattcgcacgagaccattacctagaacatcctaatcgaaaaaaatcctccgaaccccgccgtcgacgagcgagctatggagctggggcggcggatgctccgccttactccctacctcggcacggtctcgctcccaccccccaactcgcatctcctgcggaatcggacctagtatctctgacatgcgccgctctgccttcgtcgaccgattgttccgttccgtacggtccgagatcgccttcctcgataactccgccccggcaccgacaccaccggctcctagagcattcagcattgagggacgcccggaagagcagagagcccgcctgcgccgcgtgttccctgcaggacgagggggatgcttgggaagagaggcttccaacaatgaacgacaggtggagacgtgataccttagaccatgtggtcgggagtggctgctactgcctccaagcgaccgacagtgatgacgcagagctgttgattcgcatggcggtagagcgagatgacgttggctgatccacgacgccttagggcgccgatgtgactcgttgcgctcccatctcgatcggagagatggactgacctcggaagaacgcgctaagtaaaaatactatgcgcgagg

SEQ ID NO: 22655 - protein, 74 aa, Zea mays
  misc_feature: Ceres CLONE 1392575-F
MRRSAFVDRLFRSVRSEIAFLDNSAPAPTPPAPRAFSIEGRPEEQRARLRRVFPAGRGGCLGREASNNERQVET

SEQ ID NO: 22656 - DNA, 665 bp, Zea mays
  misc_feature: Ceres CLONE 1392578-R
  misc_feature: SWISSPROT Homolog: EC 2.7.11.1 Non-specific serine/threonine protein kinase
ccgattgggtaccgggccccccctcgaggtcgacggtatcgataagcttttttttttttttttttcatttttttttttttttttttttttttttttttttttttttttttttttttttttggttcacagggctgatccttgggcttctcttggggaaaggaacaggagttccttgcccaacaatttttgctaccagaaaaaaactgggaaaagatgatcccaaagagcccttcagcctggtggtcagtcaaacaagggccttgctcttttagaaagggaaaaaaaaaaaaaggatggattgtaattgcctctccaaaaaggctgcccttaaataacaatccaataaaagggggaaaccctttggataaagtgctggaaacgggctaaaaagatggcttctattatgatggctgaacccctgaaggaaccctgttctcctcaaaacggctgctcccgcaaatgtccctgaatgaaagtcttaagcccttgctgcaaaacatctcatactccagcgtggcgcctggcaacttcttcacctcaacgacatgaaaagccggtgtcacctccaaaaactcggcgtccatcgcgagctgccccttcctcccttggttggacccctgcagattcaccagcccgtcctgttttttcaccatgaaaccctctgt

SEQ ID NO: 22657 - DNA, 685 bp, Zea mays
  misc_feature: Ceres CLONE 1392579-F
  misc_feature: Encodes the peptide sequence at SEQ ID NO. 22658
  misc_feature (342)..(342): n is a, c, t, g, unknown, or other
  misc_feature (402)..(402): n is a, c, t, g, unknown, or other
  misc_feature (408)..(408): n is a, c, t, g, unknown, or other
  misc_feature (413)..(413): n is a, c, t, g, unknown, or other
  misc_feature (417)..(417): n is a, c, t, g, unknown, or other
  misc_feature (431)..(431): n is a, c, t, g, unknown, or other
  misc_feature (460)..(460): n is a, c, t, g, unknown, or other
  misc_feature (488)..(488): n is a, c, t, g, unknown, or other
cgcggtggcggccgctctataactagtggatcccccgggctgcaggaattcgcacgagaccattacctagaacatcctaatcgaaaaatcccaagaagagccgccctacctattccttctccccgccgtcgagctgcccaacccagagcaccagcagccctcacctccttcctctcggccggtccttccaacgagcccgctggtcttggagccgccaccgttctcgttctggacgaacgttcaaggagattgcatttgtggatgctctaatggagtcgaaaggtggcaagaagtctagtagtagtagtagtaatttcatgtacgaagctccccttggctacnagatcgaggacgttcgcccagccggaggaaatcagaaagttcagactgctgcttattccnactgcngtcgncagncatcctgatatcgnctcacatgcaattcgcggtagagtaggantttaattcagtttcctccttgggggcgnagttttccgttggttcgggctgccttcctccggtttggaaattccaacttgcctgggccaactctcctttttccctcccaaccccccctttctggaaaggcatccaggggggatggcctccaaaaaaatttgggggccctcccccgggcccccccaattgggctttgagggcgggaaaaaaacccccaaaaaccccc

SEQ ID NO: 22658 - protein, 51 aa, Zea mays
  misc_feature: Ceres CLONE 1392579-F
  misc_feature (1)..(51): Pfam Name: AdoMetDC_leader Pfam Description: S-adenosyl-l-methionine decarboxylase leader peptide
  misc_feature (25)..(25): Xaa is any aa, unknown, or other
  misc_feature (45)..(45): Xaa is any aa, unknown, or other
  misc_feature (47)..(47): Xaa is any aa, unknown, or other
  misc_feature (50)..(50): Xaa is any aa, unknown, or other
MESKGGKKSSSSSSNFMYEAPLGYXIEDVRPAGGNQKVQTAAYSXCXRQXS

SEQ ID NO: 22659 - DNA, 687 bp, Zea mays
  misc_feature: Ceres CLONE 1392580-F
  misc_feature: Encodes the peptide sequence at SEQ ID NO. 22660
gctctagatctagtggatcccccgggctgcaggaattcgcacgagaccattacctagaacatcctaatcaaaagatttcgtagtaagtcctcgaccatccctgcaaattaccgcgatggctcccaagatcctagtcatccttgtgttcctcgccgtggcctcaccggcggctctggccgccttcgatgtgatagagatgctggccgacaagcccacgtactccacgttcctgaagctcctgcaggacaccaaggtcgcgggcgaggcgaatcagctccggtcggcgacgctactggtcgtccccgacaaacttgccaagcctctggcgtcgctgcccgccgataaggtgcggccggcggtggagaaccacgtccttctcagttacttcgaccccatcaagctggacgagatgaagacacgcaccgccatcctccccacgctgctctccgtcaccgacaagaaactcggcgtcctcaactacaccagggccgacgacgggcagatgtacttcggcgctcccggcgccccctgcgtggccaagctcgtgaaggtcgtcgcagcgcggccgtactctgtgtccatcatggagatcagcgagcccatttggtcgggcgcgtttgccctccccgtcgtggctcccggccctcgttgtcagggtgacaaacgatatttcataccacctgtccc

SEQ ID NO: 22660 - protein, 190 aa, Zea mays
  misc_feature: Ceres CLONE 1392580-F
MAPKILVILVFLAVASPAALAAFDVIEMLADKPTYSTFLKLLQDTKVAGEANQLRSATLLVVPDKLAKPLASLPADKVRPAVENHVLLSYFDPIKLDEMKTRTAILPTLLSVTDKKLGVLNYTRADDGQMYFGAPGAPCVAKLVKVVAARPYSVSIMEISEPIWSGAFALPVVAPGPRCQGDKRYFIPPV

SEQ ID NO: 22661 - DNA, 771 bp, Zea mays
  misc_feature: Ceres CLONE 1392582-F
  misc_feature: Encodes the peptide sequence at SEQ ID NO. 22662
  misc_feature (388)..(388): n is a, c, t, g, unknown, or other
  misc_feature (401)..(401): n is a, c, t, g, unknown, or other
  misc_feature (607)..(607): n is a, c, t, g, unknown, or other
  misc_feature (633)..(633): n is a, c, t, g, unknown, or other
  misc_feature (660)..(660): n is a, c, t, g, unknown, or other
ggagctccccgcggtggcggccgctctataactagtggatcccccgggctgcaggaattcgcacgagaccattacctagaacatcctaatcgaaaatctgggccccatgtgctaactgcctgtaaaccctaatcccgaatccctcccggcctcctccgtctcgcgctcgattcgaatccgagctccctatcctgctcctgctgttcccgctgcaatggaggacaacgcggtcgaagagcccgagttgagcggtgcggcggagttcgcgccggcgctcgtcgccgcccacccacacggcaactccgtcgccgtcgccatcgggcccgagctccgcgtgtttgatctcaggtctggtcatccagtttcattgtcagatgattggtggtgncattctcattcanacgcaataagagctatctgcttcacggtggagtgaagcttttgttggcttcaggtggggaagacaaacttgtggaggtttggaaaaatgaatccggggggttgcacccacactataattttcgggaaaaaggggtgggcgccccttattttaaacacaaggaccgtggtgggtttttttggaaaacaaataatgggggtgcctggncaaaccctgtgtggggaagacgattncgtacgcgcgctttgagaacacacaanacgacccccctcacttctgccgatttcacggaatacggagcaccgcgcgtgcgttggcattatggcgctggaacttattttgttacgggcgtgatatttgtatcgtccaat

SEQ ID NO: 22662 - protein, 73 aa, Zea mays
  misc_feature: Ceres CLONE 1392582-F
  misc_feature (58)..(58): Xaa is any aa, unknown, or other
  misc_feature (63)..(63): Xaa is any aa, unknown, or other
MEDNAVEEPELSGAAEFAPALVAAHPHGNSVAVAIGPELRVFDLRSGHPVSLSDDWWXHSHSXAIRAICFTVE

SEQ ID NO: 22663 - DNA, 725 bp, Zea mays
  misc_feature: Ceres CLONE 1392587-F
  misc_feature: Encodes the peptide sequence at SEQ ID NO. 22664
  misc_feature (334)..(334): n is a, c, t, g, unknown, or other
  misc_feature (381)..(381): n is a, c, t, g, unknown, or other
tccccgcggtggcggccgctctagaactagtggatcccccgggctgcaggaattcgcacgagaccattacctagaacatcctaatcgaaaagttaaaatgcagtaagtaattcacgacccccggcgcccccgtctccgctcctttattaatatcgccgcggcctcgcacctccatctgttctatatcgccccattgctcgctcgccaagagttcttcttgttaggcaaggcaaaagcagaagcaaaaaaagaaaggtcttgttgccgatggggagctcagggttctcgtggacgcttccggaccaccccaagctccccaaggggaaaccggtgnctgtcgtcgtgctggacggatggggcgaggccaacccccgacagtancactgcatccatgtcgctcagactcctgtcatggactcgctaaaagatggcgctcctggagaatggagactagtgaaggctcatggaacagctgggggtctccctctgatgatgactgggcaacagggagttggcccaatggcttgggggtggcccaattttcccccagggggctaagtttgccaaaaaggtcttgcccccgaaaaaatttaagggggaagggtcccaaaaccacaaaaatcctttggaaggggacccctccccttttggggggggggagggagggggggccccccccctttagtataaggaaaatttcttaaaggggtgtccaagaagggtaa

SEQ ID NO: 22664 - protein, 96 aa, Zea mays
  misc_feature: Ceres CLONE 1392587-F
  misc_feature: SWISSPROT Homolog: EC 5.4.2.1 Phosphoglycerate mutase
  misc_feature (23)..(23): Xaa is any aa, unknown, or other
  misc_feature (38)..(38): Xaa is any aa, unknown, or other
MGSSGFSWTLPDHPKLPKGKPVXVVVLDGWGEANPRQXHCIHVAQTPVMDSLKDGAPGEWRLVKAHGTAGGLPLMMTGQQGVGPMAWGWPNFPPGG

SEQ ID NO: 22665 - DNA, 714 bp, Zea mays
  misc_feature: Ceres CLONE 1392589-F
  misc_feature: Encodes the peptide sequence at SEQ ID NO. 22666
gctctagaactagtggatcccccgggctgcaggaattcgcacgagaccattacctagaacatcctaatcgaaaaaaaatagcaatttttccccctgggagcccgagacgcagcgcgaggtgcggccccgtcccctcgccaccggaggagcaggacgacgaggtggcgtcggcgcgaggtagtcgcgcgcctggaagagcggcggcatcggagtcgcaggcggaggcgaggaagtgaggggagagccctatagccaccgccgcggggcgtcgtgctcgctgcacgcactcccaccattttgtcccaactcgaagctcagactcgtgctgtcgtgctgtgcacgacccctcccctagcatcccaagctcctaactgagaaaacaggagatgggaagagacggggaacagactaggcgccggagccgcaagagatcccgcgacgcctccccctcctcgtcggattccgattccttcgactccccatctctccgagcagtagccctgagcgacggagccgcaccagtaacgggaatagatcatcctcattggaccggcccggcgaaaaaaaaggaccggccggggaaataccccgacgaagaccccccgtcggtgtaaaaaaaatggcccagaaaaaaaacggccacggggggggatgttgtggagttccctcccaacctacaatcgttgttgtattgttattcgtctccctactcct

SEQ ID NO: 22666 - protein, 75 aa, Zea mays
  misc_feature: Ceres CLONE 1392589-F
MGRDGEQTRRRSRKRSRDASPSSSDSDSFDSPSLRAVALSDGAAPVTGIDHPHWTGPAKKKDRPGKYPDEDPPSV

SEQ ID NO: 22667 - DNA, 735 bp, Zea mays
  misc_feature: Ceres CLONE 1392591-F
  misc_feature: Encodes the peptide sequence at SEQ ID NO. 22668
  misc_feature (384)..(384): n is a, c, t, g, unknown, or other
  misc_feature (475)..(475): n is a, c, t, g, unknown, or other
  misc_feature (484)..(484): n is a, c, t, g, unknown, or other
  misc_feature (491)..(491): n is a, c, t, g, unknown, or other
  misc_feature (492)..(492): n is a, c, t, g, unknown, or other
  misc_feature (539)..(539): n is a, c, t, g, unknown, or other
  misc_feature (717)..(717): n is a, c, t, g, unknown, or other
  misc_feature (720)..(720): n is a, c, t, g, unknown, or other
tggagctccccgcggtggcggccgctctagaactagtggatcccccgggctgcaggaattcgcacgagaccattacctagaacatcctaatcgaaaaatcatcacactcgaaacccaacagcttccttcctggcgatccaattaacggcttctcttctgagctcagcacgaacaatggccaccatcctcaccgtcgcaagcttcttcgcacttgtgtgcatctctcaacaagcgcgggctgcgaactacacgttcatgaaggacgcggtgcacgcgccgcggacgggcttctacgactacatcatagtcggcggcggcacggcgggctgcccgctggcggccaccctgtcggcccgcgcgcgggtgctgctgctggagcgcggnggctctccgtacgaggacgcgcgcgtcctgaacatggcccacttctcggacgtgctggcggacacgtcggcgtcgtccccgtcgcagcggntcgtgtcgnaggacgnngtggatctctcccgcccgcgcggggtgggcgggggctgctggctccnccgccggtttcttcacgcggggcgtgtggggctacgtcgggtccgccggctgctcccccgccgccgccccgcctccggcgcccggtgcgcgcctgtctgcgtccccctcccgcccgctctccgcgcggggggcgtggcggcgtcccctggccgccgttcgtgcccccgtttccctccnccntcggctttctttctt

SEQ ID NO: 22668 - protein, 187 aa, Zea mays
  misc_feature: Ceres CLONE 1392591-F
  misc_feature: SWISSPROT Homolog: EC 4.1.2.10 Mandelonitrile lyase
  misc_feature (101)..(101): Xaa is any aa, unknown, or other
  misc_feature (104)..(104): Xaa is any aa, unknown, or other
  misc_feature (106)..(106): Xaa is any aa, unknown, or other
  misc_feature (122)..(122): Xaa is any aa, unknown, or other
MATILTVASFFALVCISQQARAANYTFMKDAVHAPRTGFYDYIIVGGGTAGCPLAATLSARARVLLLERGGSPYEDARVLNMAHFSDVLADTSASSPSQRXVSXDXVDLSRPRGVGGGCWLXRRFLHAGRVGLRRVRRLLPRRRPASGARCAPVCVPLPPALRAGGVAASPGRRSCPRFPPPSAFFL

SEQ ID NO: 22669 - DNA, 697 bp, Zea mays
  misc_feature: Ceres CLONE 1392592-F
gcggtggcggccgctctataatagtggatcccccgggctgcaggaattcgcacgagaccattacctagaacatcctaatcgaaaaaaaaataaaatccaattttctcagtctcgagcgcccgcgtccctcgccccgtcgcgactcgcgacttcgcgagtcgccccgtcccagcctcccagccgtcccggctccccgcgaccccgccctccggcagtccggcgcgggggctcctctccgatccggtgagccgaacgaggatcccaactccccgaagaaagcggccacagccagagccagggtggctcggctctcctctcacagactgcgccgcagcgcctagcgctcggctggcagccgctccggccggtcggccccgcgcccccgcccctgctgcctacatccgcctgcagccagaagatctgcctccagcgaccgccctgcctgccccttgtggcttctgtggttctgcacaccagcacacgcacttgtccccaaacaacggcggcggcgatgagtatctcagaagagcttcccggcgaaggatctgacggtgagggaggaggtcttcatcaacgaggaggacatcatccacgagataaccatcgacgaagaagatctccccgaccgcgacgacgaagatgacgacgtcgtcaacgggattggtgaatccgcaaaaactcgttgcatctaacttcc

SEQ ID NO: 22670 - DNA, 696 bp, Zea mays
  misc_feature: Ceres CLONE 1392593-F
gctcttgaactagtggatcccccgggctgcaggaattcgcacgagaccattacctagaacatcctaatcgaaaactctctttcggttctcacggcgacgactgggcgagcgccgcctcccctccctcgctccgtgaggtcctcgccggcgacgagtgccgccgcccgtttccatgttttttccgccgattagtgtccaccagatctagtgaaggctggtaacttgacgcaaggtgttcaagaaatttaagccacacactcttcatcataggcccaggcaatatttgtgttaatctcagggacctccagtagattgctgagagttatccttgatacaggggaatatagacacagaattttttgaacattgatctgtagccagtgctgcaatggctacaaagcttgtggttctcggtatcccctgggatgttgacactgaagggttacgagagtacatggccaagtttggacccctagatgattgtgtcgtcatgaaggaacggccttctgggcgatctcgtgggcttggctatgtacctttcgcatcagacgacgatgctcaaaatgtatttgattgcgcacaggtgagtgggagtcggaccttaataatgcagacacctacccccccctccaaatttgctctcacacgcccccgtactggtgcaactaattgtcccaccccgattctctgccacaa

SEQ ID NO: 22671 - DNA, 668 bp, Zea mays
  misc_feature: Ceres CLONE 1392596-F
  misc_feature: Encodes the peptide sequence at SEQ ID NO. 22672
  misc_feature (471)..(471): n is a, c, t, g, unknown, or other
  misc_feature (479)..(479): n is a, c, t, g, unknown, or other
  misc_feature (638)..(638): n is a, c, t, g, unknown, or other
aagctggagctccccgcggtggcggccgctctagaactagtggatcccccgggctgcaggaattcgcacgagaccattacctagaacatcctaatcgaaaaagaaaccttcctcgatctccccttccccttccctcgctgtaattccatctccgtctccatctcgttcccaccacgccgctccctgtcgcggtgtcgccattgccccggcttccaagcaaaatcccgcttgcctcgccccaagcattcctgctttcacccggccgccactcttccccagtccccgccactcaaggaaggcggaggattttatctagtcttgcagcgcggccgtctccgtcccgccttctgcgcctcctgtggcgtttggagcatcttccaattttaagctgacactacttgaacttaatgcggctctacgcacctgcgctctgtctgctgcgatcaagcacacatccccaccctaatcagntccgtgcnagattcacgcagagcatggcctcctggaagtgctcgcactcgccgtcaagcccgtaccttgcgaagtcgggtttagtcgattcttctcttaaacaggatggaaagcttctcagccacaagtataaaatactttgtcagcttatggggcagcagttccgntgcggattgtcaccaaggagggtaggctaa

SEQ ID NO: 22672 - protein, 57 aa, Zea mays
  misc_feature: Ceres CLONE 1392596-F
MASWKCSHSPSSPYLAKSGLVDSSLKQDGKLLSHKYKILCQLMGQQFRCGLSPRRVG

SEQ ID NO: 22673 - DNA, 663 bp, Zea mays
  misc_feature: Ceres CLONE 1392597-F
  misc_feature: Encodes the peptide sequence at SEQ ID NO. 22674
tggagctccccgcggtggcggccgctctagaactagtggatcccccgggctgcaggaattcgcacgagaccattacctagaacatcctaatcaaaaaacatccgctccccgccttccgcttccctaccccccgcatcacctaccaacgccgacaccatgggggccttcgcgaaggaggagcaccagttcctcgccgagctcggcctcgcgcagcgcaacccgggcgcgttcgcatgcggtgcgtggggcggctcaggtcccaccgtcacctccacgagcccgaccaacaatcaggtcatcgcagaggtcgtggaggcgtccgtgcacgactacgaggagggcatgcgcgcctgcttcgacgccgctaagacatggatggcgattcctgctccaaagcgaggagagatcgttaggcaaatcggtgatgcactgagagcaaagctccatcaccttggcaggcttgtgtcacttgagatgcggaaaattcttcctgaagggatcggtgaggttcaggaaatcattgacatgtgtgattatgctgtgggactaagtcgccaactaaatgatccattataccatctgaacgaccaaccatatgatgatggaggtgcggaaacccctggaagttgggggtggtataagggtattaattttccttggggg

SEQ ID NO: 22674 - protein, 169 aa, Zea mays
  misc_feature: Ceres CLONE 1392597-F
  misc_feature: SWISSPROT Homolog: EC 1.2.1.3 Aldehyde dehydrogenase (NAD(+))
MGAFAKEEHQFLAELGLAQRNPGAFACGAWGGSGPTVTSTSPTNNQVIAEVVEASVHDYEEGMRACFDAAKTWMAIPAPKRGEIVRQIGDALRAKLHHLGRLVSLEMRKILPEGIGEVQEIIDMCDYAVGLSRQLNDPLYHLNDQPYDDGGAETPGSWGWYKGINFPWG

SEQ ID NO: 22675 - DNA, 661 bp, Zea mays
  misc_feature: Ceres CLONE 1392598-F
  misc_feature: Encodes the peptide sequence at SEQ ID NO. 22676
  misc_feature (537)..(537): n is a, c, t, g, unknown, or other
  misc_feature (546)..(546): n is a, c, t, g, unknown, or other
  misc_feature (568)..(568): n is a, c, t, g, unknown, or other
  misc_feature (641)..(641): n is a, c, t, g, unknown, or other
tccccgcggtggcggccgctctagaactagtggatcccccgggctgcaggaattcgcacgagaccattacctagaacatcctaatcaaaaaacaacgcacatgcggaagcggagacgctgacgcacctctgagcctggcggcgatttttctatataaccagcgccgctaattccgggtgcttcgctgtagagatgcggtaaaagcgaaagaagaatccgatccgcttctccacgccgaacccggtaaggccgccgccgcttctcgaatggcctcaacctcctcctcctcgcctcagccgccgccggcggcggcggcagcgtcgcccggggcagcttcctcgcccgaggatcgccgcgcaggtggaggccgcggcggcccgcccccggtcccgccctatgtcaagggcggcggcgggtccctgggcggcgtcatggaggcgtgctgcctgcagccgatcgacgtcgtcaagacgcggctgcagctcgaccgcacgggggcctaccggggcatcgcgcactgcggcgccacgtggcccngcgcgaggncgtgcgcgcgctctggaagggntcacgccctttcgcacgcactcacgctcaagtacgcgctgcggcttcgctcaaacggcgtgctgcagtctgcngtcaaggaccccaccacggc

SEQ ID NO: 22676 - protein, 76 aa, Zea mays
  misc_feature: Ceres CLONE 1392598-F
  misc_feature (36)..(36): Xaa is any aa, unknown, or other
  misc_feature (39)..(39): Xaa is any aa, unknown, or other
  misc_feature (46)..(46): Xaa is any aa, unknown, or other
MEACCLQPIDVVKTRLQLDRTGAYRGIAHCGATWPXARXCARSGRXHALSHALTLKYALRLRSNGVLQSAVKDPTT

SEQ ID NO: 22677 - DNA, 666 bp, Zea mays
  misc_feature: Ceres CLONE 1392599-F
  misc_feature: Encodes the peptide sequence at SEQ ID NO. 22678
  misc_feature (504)..(504): n is a, c, t, g, unknown, or other
  misc_feature (596)..(596): n is a, c, t, g, unknown, or other
aaagctggagctccccgcggtggcggccgctctataactagtggatcccccgggctgcaggaattcgcacgagaccattacctagaacatcctaatcgaaaaaatttccagacggcagtccactggtttttgcttgcatatcctttgtttaggccagagttgagttgtgttccaacttccaagtcttgggttgcggaatcgccggcctcgctcaatcgatggaaaaccataatccattacattctcagattgctgaagtgaaaatggacatctcagcatcagcttctgttgcatcagggaacaaattctgcaagggtggtgcctgtgatttctctgattccagtaactcctcgaaagatgccaaggagagatccacgtccatgaggaagcttataatcgcagtgatcctttgcatcatattcatgacggtggaagtggtcgggggcatcaaagcaacagtcttgcccatcttaactgatgcgccgcaccttctttctgatgtgncagcatttgcatatcgttattctctctctggcctgctgaatgggaagcacaccgcagcagtcatatgggttcttcggattgagattcttggngccttgtctccattcagctcatatggctacttgctggatactgaatatgaggtaatggaaggctcataag

SEQ ID NO: 22678 - protein, 148 aa, Zea mays
  misc_feature: Ceres CLONE 1392599-F
  misc_feature (96)..(96): Xaa is any aa, unknown, or other
MENHNPLHSQIAEVKMDISASASVASGNKFCKGGACDFSDSSNSSKDAKERSTSMRKLIIAVILCIIFMTVEVVGGIKATVLPILTDAPHLLSDVXAFAYRYSLSGLLNGKHTAAVIWVLRIEILGALSPFSSYGYLLDTEYEVMEGS

SEQ ID NO: 22679 - DNA, 807 bp, Zea mays
  misc_feature: Ceres CLONE 1392600-F
  misc_feature (19)..(19): n is a, c, t, g, unknown, or other
  misc_feature (20)..(20): n is a, c, t, g, unknown, or other
  misc_feature (24)..(24): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (807)..(807): n is a, c, t, g, unknown, or other
tttcctccctccccccccnncccntcttttttttatttttggagctcnnncccacagctggggctccccgcggtggcggccgctctagaactagtggatcccccgggctgcaggaattcgcacgagaccattacctagaacatcctaatcgaaaactctctctctctctctctctccccttcctctcgagttcgagtctcgatatcggcaaagcaggggacctacctattgtgcggctgcggcgcccgtcgttgattcatccgctggctcgcgctcgccggtggcgccggggaacagccagctcgagctcgctttcgcttcgcatcatgggagccgctgggttctgagctgcgcggccggcctgtttcagctgagatgaacctggaaaagaatcaaaagtctggcatcacctgcccacttcgaattttagaggggaatagcaattggccttggggtcttggatcagggaaccctggaagcagaaagaaacgaggggaaacatggcaaagaaacaaataccttgaaaaccttgggggccctccggctcaaaattccggttaatgggagggaggaccaaagcccggggacctttggggaacagaaaaagggatttttgggttgaatggcgaaaaggaaggaggtttggaagttaaccctcccacaaaggcgggagggttttccctctaagaagagggatatacccctatggttttggccccccctgggaaagaaattccaacttttgggggcgccattggtggtgtaactaaaataaccgggcggcaggggtatttgggcccaacagan

SEQ ID NO: 22680 - DNA, 764 bp, Zea mays
  misc_feature: Ceres CLONE 1392601-F
  misc_feature: Encodes the peptide sequence at SEQ ID NO. 22681
  misc_feature (6)..(6): n is a, c, t, g, unknown, or other
  misc_feature (7)..(7): n is a, c, t, g, unknown, or other
  misc_feature (16)..(16): n is a, c, t, g, unknown, or other
  misc_feature (17)..(17): n is a, c, t, g, unknown, or other
  misc_feature (20)..(20): n is a, c, t, g, unknown, or other
  misc_feature (28)..(28): n is a, c, t, g, unknown, or other
  misc_feature (35)..(35): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
ttcttnnttttctttnnttnttctcccngccccgncccccacttnnnnnaacactggcgctccccgcggtggcggccgctctagaactagtggatcccccgggctgcaggaattcgcacgagaccattacctagaacatcctaatcaaaaaacgagcgctccagctccactcctcgcacccgaatcagccgctcagatccccaggcccgcctctccctccggcggcagttcctcgccggggtcctgcccgcccctcccttcatcccctcctcacctcagaacttatggatggacaggtggagaactttgtgggagatgaggaaggcgggtcgcctcaagttccttacgatggggagcagcaaatgctgtatgatagtgtcgcgaagcagtacagtgaagagctaggtgaccagtacaacgagcagcctcgtgcccaatatgatgaaggggctgggaatccgtataatgattatgaagagcaagcaaacctgtacagcgaggaaactggggatcagtacaacggaggacccagcagattcttaccaggaagagcatgagaatgcatttcagtggggggcataaaccaacagggccaacttggcaggtcaaaaatgttggacgataacataatggccctggatggcctgggagaaaagggtttttcccgaatactccgttccaagcttcagaaaggtttgggagttatcaattgggccggcaaagggggaagttccatcaaagaagaaggtgccgaggaagaccta

SEQ ID NO: 22681 - protein, 90 aa, Zea mays
  misc_feature: Ceres CLONE 1392601-F
MDGQVENFVGDEEGGSPQVPYDGEQQMLYDSVAKQYSEELGDQYNEQPRAQYDEGAGNPYNDYEEQANLYSEETGDQYNGGPSRFLPGRA

SEQ ID NO: 22682 - DNA, 676 bp, Zea mays
  misc_feature: Ceres CLONE 1392602-F
  misc_feature: Pfam Name: Xan_ur_permease Pfam Description: Permease family
  misc_feature (375)..(375): n is a, c, t, g, unknown, or other
  misc_feature (416)..(416): n is a, c, t, g, unknown, or other
  misc_feature (504)..(504): n is a, c, t, g, unknown, or other
  misc_feature (505)..(505): n is a, c, t, g, unknown, or other
  misc_feature (550)..(550): n is a, c, t, g, unknown, or other
  misc_feature (607)..(607): n is a, c, t, g, unknown, or other
aaagctggagctccccgcggtggcggccgctctagaactagtggatcccccgggctgcaggaattcgcacgagaccattacctagaacatcctaatcgaaaaacttctcgttctcgccgatccagtgccactacactacaatactgctgcgcgctagcggtagcgctcgcgctcccactcgcaccacagcacgccaccgctgctgccggctcctccccgcgctcgcattgcgatttgcgacctagcgcgagggtaccgggggtggtgcgcgtgctccgtgatccgggaagcgccgcgagatggcccggggcggaaggcggcggtgccgcgccgaagcacgacgacttcacgccgcaccccgtcaaggaccagctnccctggggtctcctactgcatcaccagccctcccccgtggnctgaagccgttctttctggggtccaacattatctggtcatgcttggtaccactgtgatcataccaactgcacttgttccacaaatggnnaggaaaacatgaggacaaagcagtggttatcagaactttgctggntcggtggcaggatcaacaccctcctgcagaagttcttttgtaccatgtttgccgcantgatccgcgggtcaaacaccctttgttctgctaaccattcgatcatccctggctggacgtaaggctaaa

SEQ ID NO: 22683 - DNA, 885 bp, Zea mays
  misc_feature: Ceres CLONE 1392604-F
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (885)..(885): n is a, c, t, g, unknown, or other
ttcccccccccnnntatnnnttcccctcctccgccgcgccaacccccccccaagctggggctccccgcggtggcggccgctctatcaatagtggatcccccgggctgcaggtaattcgcacgagaccattacctagaacatcctaatcgaaaacttgcaagcaagcagctgctctcgtgtgacatctagtcgtcgccagtcagtcacctctccagcctccagcaccaaccatccaccaccgagctagcagctgtctgctcgcctcccccacctaggctaggactaggagccaccaaactctgccccgccatgccgggcctcgccgcctcaggcaactccgcccccggcgggcgttccattcagagaagccagtctctaggtacctcctagcttgacgcgcaccctccacaaccgagtgaccacgcgcgccaccccccccccacctgaaccaactacacccccggacctaccgcgctcacccccacattacctgccagtccgctcggtttctctgggcggacacctgtacatacgactacgacgcgcggagtccaacggaaattcacaccgccccaaaggtagcatgtaccgccccccccctgcatccctgctcccccccccctccccctctccctcctctccccctgcgcacctcccccctccctcctcacccctacgagccccgggccggtgccgccacctaccctgctctgctcccgccacgccacgggaggacgtaaacacgaaccacatcactaagaaaccgaaaggtaaacacaaaacccgcccgacacccacaactccatcgacacaaccctcacacacccccaccgcccaccctccctcttccctgcccccccccacccattctcacatccctccccn

SEQ ID NO: 22684 - DNA, 646 bp, Zea mays
  misc_feature: Ceres CLONE 1392606-F
  misc_feature: Encodes the peptide sequence at SEQ ID NO. 22685
  misc_feature (185)..(185): n is a, c, t, g, unknown, or other
  misc_feature (216)..(216): n is a, c, t, g, unknown, or other
  misc_feature (257)..(257): n is a, c, t, g, unknown, or other
  misc_feature (258)..(258): n is a, c, t, g, unknown, or other
  misc_feature (300)..(300): n is a, c, t, g, unknown, or other
  misc_feature (301)..(301): n is a, c, t, g, unknown, or other
  misc_feature (310)..(310): n is a, c, t, g, unknown, or other
aagctggagctccccgcggtggcggccgctctagaactagtggatcccccgggctgcaggaattcgcacgagaccattacctagaacatcctaatcgaaaaatgtaaaccacactccactccagcactgaacacttgattgattcagtaggtagctagctagctgaatcacaatggatcctaccnagttccgtcccgtcagtagccacgacacgancgtgacgacgacgaacgctggcgctcctgtgtggaacgacnnacgagcgctgactgtgggggctcgcggtcccatcctgctggnnagactacanctgatcgaagaaggggcgcactttcggggggagcggaatccggaacccgggggggacacgccgggggggccccccccaggggttcttttagaggggccccccaaaggggggtccctttaagggggccaatatttggggggggcccgggggggggaaccccccgggaatgggctttttccgagggggacacaaaagggggggggcccccggaaaaaaaacccgcccccccggggggtttccccggggaaattaccaccccccccggggaaaagggggacccctttgggaaaaaaaatcccccgcttttttttttcgggggggggagatatttccccc

SEQ ID NO: 22685 - protein, 85 aa, Zea mays
  misc_feature: Ceres CLONE 1392606-F
  misc_feature: SWISSPROT Homolog: EC 1.11.1.6 Catalase
  misc_feature (5)..(5): Xaa is any aa, unknown, or other
  misc_feature (15)..(15): Xaa is any aa, unknown, or other
  misc_feature (29)..(29): Xaa is any aa, unknown, or other
  misc_feature (43)..(43): Xaa is any aa, unknown, or other
  misc_feature (46)..(46): Xaa is any aa, unknown, or other
MDPTXFRPVSSHDTXVTTTNAGAPVWNDXRALTVGARGPILLXRLXLIEEGAHFRGERNPEPGGDTPGGPPPGVLLEGPPKGGSL

SEQ ID NO: 22686 - DNA, 677 bp, Zea mays
  misc_feature: Ceres CLONE 1392608-F
  misc_feature: Encodes the peptide sequence at SEQ ID NO. 22687
  misc_feature (325)..(325): n is a, c, t, g, unknown, or other
  misc_feature (352)..(352): n is a, c, t, g, unknown, or other
  misc_feature (353)..(353): n is a, c, t, g, unknown, or other
  misc_feature (372)..(372): n is a, c, t, g, unknown, or other
  misc_feature (375)..(375): n is a, c, t, g, unknown, or other
  misc_feature (376)..(376): n is a, c, t, g, unknown, or other
  misc_feature (396)..(396): n is a, c, t, g, unknown, or other
  misc_feature (420)..(420): n is a, c, t, g, unknown, or other
tccccgcggtggcggccgctctagaactagtggatcccccgggctgcaggaattcgcacgagaccattacctagaacatcctaatcgaaaaacctattggggagcgctcctgattcgcgggagccagcgggcgagacaaagagaatcccccgctcctgcgccgccgcggaccagcgccgtcgccgatcggaggctctcgcttcccccggcgggcggcgcgcgccgggagatggacggcggcgcgggcgcgggcgccgtccggaggaacgtctcatcgtcctccggatccaggagggaggtcctgcccgccgagaacgggcacggncatgacgccccgccgccctccaggggnntctcgtctccttctgccgnggnncactcacgtcactgaccggncgagaggaccgtgaaaaggctgangctggtcaaggcgctgacgataccggatcacccaacgggcacgaggtttgccggaaggatggggtcacccagggttgaaccccgggttgctgactgactccaagcgttggctcggggggaatcctcccgaaaagggcataaaccaaaggggggattggcccgggattaaaaaaagaaaaaaaacccggttccaagggggtggccccaaaccctttgttttttttcccgggaacccttttggagcaaggggtgtaaaa

SEQ ID NO: 22687 - protein, 53 aa, Zea mays
  misc_feature: Ceres CLONE 1392608-F
  misc_feature (42)..(42): Xaa is any aa, unknown, or other
  misc_feature (48)..(48): Xaa is any aa, unknown, or other
  misc_feature (49)..(49): Xaa is any aa, unknown, or other
MDGGAGAGAVRRNVSSSSGSRREVLPAENGHGHDAPPPSRGXSSPSAXXHSRH

SEQ ID NO: 22688 - DNA, 698 bp, Zea mays
  misc_feature: Ceres CLONE 1392615-F
  misc_feature: Encodes the peptide sequence at SEQ ID NO. 22689
ccccgcggtggcggccgctctataactagtggatcccccgggctgcaggaattcgcacgagaccattacctagaacatcctaatcgaaaaatccctcctcctaactccaaactacccactggttcgactcgcgttcgcatcgcaagcagcagcgttccatcgaggcaatggcggtgatggccgaagtagtgtcgaccaccggcgcggcgctccggagcccggcctcgcagcagccggcggcggcgggcgcggcgaagggcaccgacgctgagaagctccagttcatcgaggacatgacctccaacgtggacgccgtgcaggagcgcgtgcctgggggagatcctcgcccgcaacgcggacaccgagtacctcgccggcaggtgcgggcctcgccggggctacggaccgcgccaacttccggcgccagggtggccgatggcgaacgtacgaggaacctgcaagccgtacatccgggcgcattcgccgaaaggggaaacgttcgccccatcctgttcggggcacccggttcttccgagtttcctcaccagcttccggaacgttcggggggggagggggaaagctcctggcccccatcggggggggggttttaccgcccccccagttggtggaaaagcccccaaattgcccggtaatgaaaccctgaagggggctggggaaaggaacaaggcgaaaaagcg

SEQ ID NO: 22689 - protein, 161 aa, Zea mays
  misc_feature: Ceres CLONE 1392615-F
MAVMAEVVSTTGAALRSPASQQPAAAGAAKGTDAEKLQFIEDMTSNVDAVQERVPGGDPRPQRGHRVPRRQVRASPGLRTAPTSGARVADGERTRNLQAVHPGAFAERGNVRPILFGAPGSSEFPHQLPERSGGEGESSWPPSGGGFYRPPSWWKSPQIAR

SEQ ID NO: 22690 - DNA, 682 bp, Zea mays
  misc_feature: Ceres CLONE 1392616-F
  misc_feature: Translation starting site: 227
  misc_feature (19)..(19): n is a, c, t, g, unknown, or other
  misc_feature (20)..(20): n is a, c, t, g, unknown, or other
  misc_feature (41)..(41): n is a, c, t, g, unknown, or other
  misc_feature (42)..(42): n is a, c, t, g, unknown, or other
aatttgcccccacccaccnncttgggggagcacctacctgnngcacgacccccaacatagctgggactccccgcagtggcggccgctctttcactagtggatcccccgggctggaggatttcgcacgagaccattacctagaacatcctaatcgaaaacagtcgatccggaaacctctcaaaccctagccgcctcctgcaagtttcagagctcaggaatctgcgccatggcgagtgagacggagaccttcgcatttcaggctgagatcaaccagctgctctcactcatcatcacaccttctactccacaaggagacttcctccgcgagttatctccactcttccatgcgctggaaagataggttcgagagctcactgaaagagcaagctcgatgcgcagcctgagcttttcatcaccttgtcccagacaaggccacgaacacgctctccatcatcgacagcggcatcggcatgacaaagtccgaccttgtcaaacaacctcggtaacatcgccagggtcggggaccaaggagtttctggaagccccttgctgccgggcgctgatggggccatgattgggccagttcggggggcgggttttcaaatctggccaactcccggcgcggaaagaaggttgtccgggcccccccaagcaccaaaggttggcaaaacaaaaacagggg

SEQ ID NO: 22691 - DNA, 614 bp, Zea mays
  misc_feature: Ceres CLONE 1392616-R
  misc_feature (614)..(614): n is a, c, t, g, unknown, or other
tcgaggtcgacggtatcgataagcttttttttttttttttttcttttttttttttttttttttttttttttttttttttttttttttaccattacgaataataacgacaagatgttataaaagagtaaacataacaaataaaccagacttttagcctggccagcaggacaaccgataacgtgccaaaaacctcgaacaatagtgaaaattaagctatcacaggtagcttaactagggataagataaacggcaagcatgcgatgcgacacttagtcgacctcctccatcttgctttcaccagcgtcgtcctcaagctgaggcatctcggcctctgcctcaacaggctcgtcctcatcgatgctcagaccgagtttgagcatgcggtggatccggttgcccaaggtgttggggtcatccaggctgaaaccggaggtcaagagagcagtctcgaacagcaacatcacgagatccttgactgacttgtcattcttgtcagcctccgcacgcttgcggagctcatcccagaatagggtttctccgggttgaaccccatttggctttttgctcaacatgtaacccccccattgtccaagccccccaggggttggtgcccn

SEQ ID NO: 22692 - DNA, 660 bp, Zea mays
  misc_feature: Ceres CLONE 1392617-F
  misc_feature (527)..(527): n is a, c, t, g, unknown, or other
  misc_feature (528)..(528): n is a, c, t, g, unknown, or other
tcaccgcggtggcggccgctctataactagtggatcccccgggctgcaggaattcgcacgagaccattacctagaacatcctaatcgaaaaagaacttgagctttccgcttcctccgaccgagacgaggcagaaaccttcctcgatctccccttccccttccctcgctgtaattccatctccgtctccatctcgttcccaccacgccgctccctgtcgcggtgtcgccattgccccggctccaagcaaaatcccgcttgcctcgccccaagcattcctgctttcacccggccgccactcttccccagtccccgccactcaaggaaggcggaggattttatctagtcttgcagcgcggccatttccgtcccgccgtctgcgcctcctgtggcgtttgggacatcttccaattccaagctgacactacttgaacttaatgcggctctacgcacctgcgctctgtctgctgcgatcaagcacgcatccccaccctaatcagttccgtgcaggattcactcagagcatggnncttctggaagtgctcgcactcgccgtcaagcccgtaccttgcgaagtcggttttagtcgattcttctcttaacaggaatgtaaagtcttctcagccacaaagtataaagtactttgtcagcttagtgggcca

SEQ ID NO: 22693 - DNA, 841 bp, Zea mays
  misc_feature: Ceres CLONE 1392620-F
  misc_feature: Encodes the peptide sequence at SEQ ID NO. 22694
  misc_feature (28)..(28): n is a, c, t, g, unknown, or other
  misc_feature (29)..(29): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
ttccccccctcccccccgcttttttttnnccnnnnggggtgccnnnnacaaagtggagctccccgcggtggcggccgctcttccatagtggatcccccgggctgcaggaattcgcacgagaccattacctagaacatcctaatcgaaaagaaaaggaccagaagaaaccagaggcgactccaggttcgtgggcgatgctgcgcgcgggagctaggcagctccttgccccggggctccggcggctcggtctgggcaccggcgccgccggtcaggtgggcccggccgccgcggcggcgtggatgagggcgcaccacgagcgggtggtggaccactacaacaacccgcggaacgccggttccttcgacaaggaggaccccaacgctcggtactggccctgctcggtgcgccggtcctgcgccgcccgccaggaggggggcggatcccgcgatcaacaaggactccgaaaccaatcgtccgaccgcctgctttcaagaccttttgggcttgcgcgttccgcccacaggcgtccctccgcccgtacgaacacatgaatcgggcggacagggaaataccccaagggccccccccctctccgcacacctccaagacatccctgacgatccggtacggccccctcggcccccctttcccaccagcaataacgctgcccttcgccccacaatgtttatgccaccacggtatgtccctctctaagacctcgcctcgtgtactaagcccccacccaaggccccatacatagggcccgcaaatagtggcgtcgccaccaacacaggcggcaccaacccaccctccactctgattgacgaaacgcgccccccct

SEQ ID NO: 22694 - protein, 118 aa, Zea mays
  misc_feature: Ceres CLONE 1392620-F
MLRAGARQLLAPGLRRLGLGTGAAGQVGPAAAAAWMRAHHERVVDHYNNPRNAGSFDKEDPNARYWPCSVRRSCAARQEGGGSRDQQGLRNQSSDRLLSRPFGLARSAHRRPSARTNT

SEQ ID NO: 22695 - DNA, 587 bp, Zea mays
  misc_feature: Ceres CLONE 1392622-F
  misc_feature (346)..(346): n is a, c, t, g, unknown, or other
cgctcttaactagtggatcccccgggctgcaggaattcgcacgagaccattacctagaacatcctaatcgaaaaaaactagctgttagcctacctttcccctcccagccgtgggacgcaccaccctcagcctcccagctgccgcacacgtggaggctccacgcgaccacgcggcagcggcacgccggcacgcgcgccgcccggcgcccctcagcctcgcgccctcgccggccacgcgcctcagtcttgcgctctcgccgcgttaagccggtcagccttgcgggttgcggtctcgccgccgacgccgggcgccgggattgccggctgcccgccttttgcgagacggnagacggcatgtccctgctgctcctgcccctctgtcgaaactccggggaccgggccgtttccctggttgtcggaaggacgtcgggaaggaatcccctccgccggtcacccgttaaaaacggccccccggggggggcccccctccccaaggtttcccccgggtttggggttcccaaaattttttaagggggccccccggggggggggaaaaaaacccccgggccccagggggtaagaaaaaaa

SEQ ID NO: 22696 - DNA, 789 bp, Zea mays
  misc_feature: Ceres CLONE 1392623-F
  misc_feature: Encodes the peptide sequence at SEQ ID NO. 22697
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (35)..(35): n is a, c, t, g, unknown, or other
nnnnnnnnnnnnnnnnnnnnnnnaaatactcactncttttcccaccccccaacctgcatctccccgcggaggcggccgctctacaactagtgcatcccccgggctgcaggaattcgcacgagaccattacctagaacatcctaatcgaaaatccaaagtttcgtccaccatttggctcccgcaagcaccgatttgtttactgctctctccgacgcgcggcggcggagctccctacgacaactgaaccatgtgcggcggcgcgatccttgccaaccttcgcgagccggcgccgcgccggctcacagagcgggacatctggcagcagaagaagaacctcaagagggccgccggcggcgccaggcgctcgttcgcggcggaggacgatggaggacttcgaggccgaactttgaggtcttcgaggcagactcctgtgattcagatttggagctccagggagggcacttgacgacgacgttcgccgagaacaagcccttcccctgccaagagggattttcctcccaggggatggtttaagcaccactgactaagtggtggtagtaaaggccttcccaaaatggatgaacaagcaattctttaccggggcttatcctcccaagaagccctttgcggccaaagtggtacctgcttgaacaaactaaaccccccccaaaagggggcggccccgcgcgtacgccttctggtaccctcctcacaacccccctcgaggtaactctcgtctacacgccttaacagttggcagagagaaggggccaaggaaattaggggggc

SEQ ID NO: 22697 - protein, 72 aa, Zea mays
  misc_feature: Ceres CLONE 1392623-F
MCGGAILANLREPAPRRLTERDIWQQKKNLKRAAGGARRSFAAEDDGGLRGRTLRSSRQTPVIQIWSSREGT

SEQ ID NO: 22698 - DNA, 774 bp, Zea mays
  misc_feature: Ceres CLONE 1392630-F
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (64)..(64): n is a, c, t, g, unknown, or other
  misc_feature (287)..(287): n is a, c, t, g, unknown, or other
  misc_feature (302)..(302): n is a, c, t, g, unknown, or other
  misc_feature (774)..(774): n is a, c, t, g, unknown, or other
gttttggtgtgggtttggtttcctcctcttctcttcattatttttttttttcttnnnggggcancaaacaagactggagctccccgcggtggcggccgctctatcaatagtggatcccccgggctgcaggaattcgcacgagaccattaccaagaacatcctaatcgaaaacgccctccagaccgcacgcacgcacggcacgagctcgccgcgatgtcatggttcgctcgctccatcgctgccacactttcatctgcccactctgacgacgatgaatccgagcccgnctccgggacaacagnccgccgggcggctccgaccccaccagcgccgagaccggtgagtccgatgagcagccgggacaccccgagccggcggggttaaaggggggacatctccggagctggacgaagtccccttcccccgccgggttcgtggggggggttgcctcctttcctgggggcccaccggcaatttgaagggaaaaaactgtaaaagggggggggggggggaaaaccgcccccccccccccgggaaggggcccccccagtctccccccgggatattgaacggggtactccgggggggggcccctcggggggaaaaaaaacggggggaagaggggaaaaaaacccgggttttcctccagagggggtgtgaaaaaaccccgcgggggggggggggggggaaaaaactcccccggggtggggggggatatctgttcccggggcatatttagcaccccgggtggaataaagggggggggaggggaan

SEQ ID NO: 22699 - DNA, 674 bp, Zea mays
  misc_feature: Ceres CLONE 1392631-F
  misc_feature: Encodes the peptide sequence at SEQ ID NO. 22700
  misc_feature (324)..(324): n is a, c, t, g, unknown, or other
  misc_feature (362)..(362): n is a, c, t, g, unknown, or other
  misc_feature (363)..(363): n is a, c, t, g, unknown, or other
  misc_feature (405)..(405): n is a, c, t, g, unknown, or other
  misc_feature (407)..(407): n is a, c, t, g, unknown, or other
  misc_feature (409)..(409): n is a, c, t, g, unknown, or other
  misc_feature (410)..(410): n is a, c, t, g, unknown, or other
  misc_feature (427)..(427): n is a, c, t, g, unknown, or other
cgctcttaactagtggatcccccgggctgcaggaattcgcacgagaccattacctagaacatcctaatcgaaaaagatctcccggcctgaggattcgattattctgttcgctctcgcccaagtcatcgtctggtcgtcgcccgcagaggcgcagacgcccaaagccggaaggggcgccatggccgcgtcggatctggagagcaaggccaaggaggccttcgtcgacgacgacttcgagctggccaccgagctctacagccaggccatcgacgccgggcccgccaccgccgacctctatgccgaccgcgcccaggcgcacatcangctcggcaactacattgaggctgtggcggatgctaacnnaagcattgagcttgatcctatgatgcataaagcttactaccngnannagtgctgcatgcattangctttgagaatacccaactgcaaaggctgctcttttgagtgggtcttcctatgcatcacgggattcagggtttgctcgtctatggaaggattgggatgaccgcatcccttgaggatttagccggcccccgaaaaaaatggtgagggctacgggggtggctcctttggggacaggggggttttcccaaatttgggaaaacccccccgggggtaaaaacccccgagaaaacaaaaaaaggggtggttac

SEQ ID NO: 22700 - protein, 115 aa, Zea mays
  misc_feature: Ceres CLONE 1392631-F
  misc_feature: SWISSPROT Homolog: EC 3.1.3.16 Phosphoprotein phosphatase
  misc_feature (49)..(49): Xaa is any aa, unknown, or other
  misc_feature (62)..(62): Xaa is any aa, unknown, or other
  misc_feature (76)..(76): Xaa is any aa, unknown, or other
  misc_feature (77)..(77): Xaa is any aa, unknown, or other
  misc_feature (78)..(78): Xaa is any aa, unknown, or other
  misc_feature (83)..(83): Xaa is any aa, unknown, or other
MAASDLESKAKEAFVDDDFELATELYSQAIDAGPATADLYADRAQAHIXLGNYIEAVADANXSIELDPMMHKAYYXXXCCMHXALRIPNCKGCSFEWVFLCITGFRVCSSMEGLG

SEQ ID NO: 22701 - DNA, 653 bp, Zea mays
  misc_feature: Ceres CLONE 1392633-F
  misc_feature: Encodes the peptide sequence at SEQ ID NO. 22702
  misc_feature (353)..(353): n is a, c, t, g, unknown, or other
  misc_feature (437)..(437): n is a, c, t, g, unknown, or other
tccccgcggtggcggccgctctagaactagtggatcccccgggctgcaggaattcgcacgagaccattacctagaacatcctaatcgaaaaaaccgcgccgctctctctctctctctcgcacgagccgcgccggcgccgccaccacgcgcgcgggagacagagaccacagccgcagccaccggcgggcggaataggaatggtggcgccgggggtaggagcaggaggaggtccgtcgcggtggccgacgccggaggagcttgacactgtacggaagaaggtggtggagattattgtaagggatgaacaataggttatggttgctgcttgcccctacagaatttgccctttgggngctcatattgatcatcagggtggagtactcacagctatgaccataaattatggagtactccttgatttcgttccctctaatggntctgaggttttacttcattctggtcagtttgaaggtgctataagattcagagttgatgacttgcaacagcctattgataaacctgagaacataaactggggaagttatgcaaaagggggttgtttaggccctgcaaaataagggatatgatcctaggaagggtatcttaggttttatttcttggtgggaaagggcttggaagttcccggcctcaat

SEQ ID NO: 22702 - protein, 87 aa, Zea mays
  misc_feature: Ceres CLONE 1392633-F
  misc_feature: SWISSPROT Homolog: EC 2.7.1.6 Galactokinase
MVAACPYRICPLGAHIDHQGGVLTAMTINYGVLLDFVPSNGSEVLLHSGQFEGAIRFRVDDLQQPIDKPENINWGSYAKGGCLGPAK

SEQ ID NO: 22703 - DNA, 687 bp, Zea mays
  misc_feature: Ceres CLONE 1392636-F
  misc_feature: Encodes the peptide sequence at SEQ ID NO. 22704
  misc_feature (382)..(382): n is a, c, t, g, unknown, or other
  misc_feature (475)..(475): n is a, c, t, g, unknown, or other
  misc_feature (512)..(512): n is a, c, t, g, unknown, or other
  misc_feature (524)..(524): n is a, c, t, g, unknown, or other
  misc_feature (532)..(532): n is a, c, t, g, unknown, or other
  misc_feature (533)..(533): n is a, c, t, g, unknown, or other
  misc_feature (554)..(554): n is a, c, t, g, unknown, or other
  misc_feature (613)..(613): n is a, c, t, g, unknown, or other
  misc_feature (684)..(684): n is a, c, t, g, unknown, or other
ggagctccccgcggtggcggccgctctagaactagtggatcccccgggctgcaggaattcgcacgagaccattacctagaacatcctaatcgaaaaacggaagggcccggacagttttgcgcacaagccccccattcccattctaccaccgacccgtcccgtcccactgcctgccagcgtctcccccgctccctctcctcgagagatctcgcgctccggcgatcgggcgcggcgggcggagggtcgcgaagtgccctgcccacccccgatgctcttcccgaagcgcatcaactacgtggccccgatgctcgcctccgccgccatcctgctcctcctcctctcgggctacttcgagctcccctccatctccaccccggcgcgnctcctcgcgggcgcagcgcgcttccccaccgcgctcgactccgtcggatcgcgcgaccgcgaccccttcacctcgctcctcgaggccttcgcntcctgggggacggccgcccgtcggctgccccccgcgntccgcgccaagnctcgccgnncgcgggggctggggcctgggncccggggcctgcccgctgccggagtgccgagcggcccagcgcccagcggctaacgggcnaccggcggaaggacccctgccgggcgggcgtcccggtcagccggggggcccgccggcgtggggcccggganccc

SEQ ID NO: 22704 - protein, 112 aa, Zea mays
  misc_feature: Ceres CLONE 1392636-F
  misc_feature (82)..(82): Xaa is any aa, unknown, or other
  misc_feature (86)..(86): Xaa is any aa, unknown, or other
  misc_feature (89)..(89): Xaa is any aa, unknown, or other
  misc_feature (96)..(96): Xaa is any aa, unknown, or other
MLFPKRINYVAPMLASAAILLLLLSGYFELPSISTPARLLAGAARFPTALDSVGSRDRDPFTSLLEAFASWGTAARRLPPAXRAKXRRXRGLGPGXRGLPAAGVPSGPAPSG

SEQ ID NO: 22705 - DNA, 675 bp, Zea mays
  misc_feature: Ceres CLONE 1392637-F
  misc_feature: Translation starting site: 146
  misc_feature (423)..(423): n is a, c, t, g, unknown, or other
  misc_feature (449)..(449): n is a, c, t, g, unknown, or other
  misc_feature (458)..(458): n is a, c, t, g, unknown, or other
  misc_feature (460)..(460): n is a, c, t, g, unknown, or other
  misc_feature (463)..(463): n is a, c, t, g, unknown, or other
  misc_feature (549)..(549): n is a, c, t, g, unknown, or other
  misc_feature (550)..(550): n is a, c, t, g, unknown, or other
  misc_feature (576)..(576): n is a, c, t, g, unknown, or other
  misc_feature (584)..(584): n is a, c, t, g, unknown, or other
aagctggagctccccgcggtggcggccgctctagaactagtggatcccccgggctgcaggaattcgcacgagaccattacctagaacatcttaatcgaaaaacaccaacctcagcacaccaaggagagtacgtggaggagcagccatggcttcatcggtggccgccgcggcgagcacattcctgggcacccgcctggcggacccggcgccacagaacgggcgcatcgtggcccggttcgggttcgggttgggcggcaaggcgaagcctgctccgaagaaggtggcgaagacatcgacctcctgtgaccggccgctgtggttccccggcgccgtggcgcccgactacctgacggctcgctggtcggcgactacgggttcgacccgttcggtctcgggaagcccgtggagtacctgcagttcgangtggactcgctggaccagaccctggncagaatgangncgncggcatcatcggcacccggttcgagtcctccgaaagtcagtccaccccgttgcagccctacagcgaggtgttcggccctcagcggnntccgcgagtgcgagctcatccacggncgctgggncatgctcgccaccctcggcgccctcttcgtcgagtgcctcaccggcgtcacctgggcagacgccggcaaggtggagctgggtgaacggtcc

SEQ ID NO: 22706 - DNA, 691 bp, Zea mays
  misc_feature: Ceres CLONE 1392639-F
  misc_feature: Encodes the peptide sequence at SEQ ID NO. 22707
  misc_feature (524)..(524): n is a, c, t, g, unknown, or other
  misc_feature (525)..(525): n is a, c, t, g, unknown, or other
aaagctggagctccccgcggtggcggccgctctagaactagtggatcccccgggctgcaggaattcgcacgagaccattacctagaacatcctaatcgaaaaaaaaagggtcatccgagttgccagccaattttgcatccccaccaccaatccaccaccccacacccagtgacagagacagaaggccgggcagggctacgcgacgcgacggagatggagcacacgaatcatcgccgccgccgtcaagctttggccaccgtgtcggcgacgacgacgctcctgctgcttctcctctgcctcgcggcgttgacgacggcagaggcgctgcgcgagcacagggacgagggcggcgctagcagcagtggcggaagcggaagcggctggcgcagcaacgccgccggcggcaagcaatcgccggccgtgtgggtggtcggggactcctacgcggacacggggaacctgggcgacctcgggcgggagctgacccgggagtggtacgacccgtacgggaccaccttcccggnncggcccggcgggcggtttctccgacgggcgcgtcctcaccgacttctagcctcccgcggatgggagggccaaggccgtggggtacaaagttggcgccaaggggcccccccgccccgttttccggggggcggggctatgaacctcccccccgccccgcgggcgcggc

SEQ ID NO: 22707 - protein, 159 aa, Zea mays
  misc_feature: Ceres CLONE 1392639-F
  misc_feature (104)..(104): Xaa is any aa, unknown, or other
MEHTNHRRRRQALATVSATTTLLLLLLCLAALTTAEALREHRDEGGASSSGGSGSGWRSNAAGGKQSPAVWVVGDSYADTGNLGDLGRELTREWYDPYGTTFPXRPGGRFLRRARPHRLLASRGWEGQGRGVQSWRQGAPPPRFPGGGAMNLPPAPRAR

SEQ ID NO: 22708 - DNA, 687 bp, Zea mays
  misc_feature: Ceres CLONE 1392645-F
  misc_feature (207)..(207): n is a, c, t, g, unknown, or other
ggagctccccgcggtggcggccgctctataatagtggatcccccgggctgcaggaattcgcacgagaccattacctagaacatcctaatcaaaaaatatcccttcctcgtatatcctttcctgagtaggagagagagttgagttaggagttgttgtgctgatcatctcggtcgaccgagagatggaccacacttcactgagatagangggaagatggcgcacgagccactggcacacagctccaccttctccgatgagacgaaagacaaaatggagcacgattcactggtggtacagtccacgcagcatcgcgagggccacaaccaccggcatccctgtcggcgatcaaggcgtggccgtgctacgtgggccgcttatcgggggtgcagggcccggcggttctggaatgcgcgggcgttgctcaccatgttatacattccctacggggtcctagagggggaggggtgggtaacctcaatgtggcaccccgcacgtacccgcaggtttgggtctcgccataccccaggcgttagtggggggtcccgggtatgggatttccccgggcctaccccaattttcaaacccggggggggggttcctttgccaccaccaatgaagaaactgggggcgcattttgggtccccccctttttttcaccccccccggggtgggtcccttcccaaaaaa

SEQ ID NO: 22709 - DNA, 714 bp, Zea mays
  misc_feature: Ceres CLONE 1392646-F
  misc_feature: Encodes the peptide sequence at SEQ ID NO. 22710
  misc_feature (231)..(231): n is a, c, t, g, unknown, or other
  misc_feature (251)..(251): n is a, c, t, g, unknown, or other
  misc_feature (287)..(287): n is a, c, t, g, unknown, or other
  misc_feature (298)..(298): n is a, c, t, g, unknown, or other
  misc_feature (311)..(311): n is a, c, t, g, unknown, or other
  misc_feature (346)..(346): n is a, c, t, g, unknown, or other
  misc_feature (356)..(356): n is a, c, t, g, unknown, or other
  misc_feature (357)..(357): n is a, c, t, g, unknown, or other
  misc_feature (361)..(361): n is a, c, t, g, unknown, or other
  misc_feature (388)..(388): n is a, c, t, g, unknown, or other
aaagctggagctccccgcggtggcggccgctctagaactagtggatcccccgggctgcaggaattcgcacgagaccattacctagaacatcctaatcgaaaaaattccccattcaccaatccccagtattgtagtaggggggaaaaacgagagaaaagaaacagcagtagcggaggcaatacgaaatggtggccgccgtcgcgtcgccttcgtcggcggcaccctccgccnggcgtccccatcgacatacnaggagatgatcatgcaggcgctgacggagctgcggnacccgagcggntcgagccgcagcngcatcgccagttacatcgccgaccactttctcggncttcactcgnngcangatggcttcctctcccgtcatcttcgnaggctcaagtcaatggcccactccgcctcgtttctggaaaatacttcgtcccacccgccgttaggggagggggggagtttccaaattccggccaaacccaaacctgttccgggggaaaaaaagggggcggggggggccccccaaaggacaaaaattaccccctttccgttttccccccccgttttttgggggcccaaggggggggggggccccccccaaaaaaaaaaaagccccccaaccccggggtcttccccccccccccctcgcccaaagggagagaagggcccccccctccttgggaaaaaaaaaggggggggccccccccg

SEQ ID NO: 22710 - protein, 152 aa, Zea mays
  misc_feature: Ceres CLONE 1392646-F
  misc_feature (1)..(59): Pfam Name: Linker_histone Pfam Description: linker histone H1 and H5 family
  misc_feature (11)..(11): Xaa is any aa, unknown, or other
  misc_feature (19)..(19): Xaa is any aa, unknown, or other
  misc_feature (34)..(34): Xaa is any aa, unknown, or other
  misc_feature (35)..(35): Xaa is any aa, unknown, or other
MIMQALTELRXPSGSSRSXIASYIADHFLGLHSXXDGFLSRHLRRLKSMAHSASFLENTSSHPPLGEGGSFQIPAKPKPVPGEKKGAGGAPQRTKITPFPFSPPVFWGPKGGGGPPQKKKSPPTPGSSPPPPRPKGEKGPPLLGKKKGGGPP

SEQ ID NO: 22711 - DNA, 857 bp, Zea mays
  misc_feature: Ceres CLONE 1392647-F
  misc_feature: Encodes the peptide sequence at SEQ ID NO. 22712
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (16)..(16): n is a, c, t, g, unknown, or other
  misc_feature (17)..(17): n is a, c, t, g, unknown, or other
  misc_feature (21)..(21): n is a, c, t, g, unknown, or other
  misc_feature (51)..(51): n is a, c, t, g, unknown, or other
tgggtcccccnnnccnntccnccccttccctccctttgtgcacccccaaancaaagctggcgctccccgcggtgggggccgctttccaatagtggatcccccgggctgcagtgattcgcacgagaccattacctagaacatcctaataaaactagctcaccgctcactcacaagcacgctgcgaaacacagacgcagagacccgcgcacagatcgaagcgcaggatgaaggtggaggtggtggagacgacgctggtgccgccgagcgaggcgacgccgcggcacgcgctgtggctgtccaacctggacctggcggtgcccaagacccacaccccgctcgtctactactaccccgaggcccgccggcgcccgcggccgtggtaggagcgtaaagcgagagggaagaaggttcgtttctttccacccgggcccgccctgcgccaaggcgccatgcccaagggtcgcctgctgcccccccccaccccggctggggagggacggtattggccggccccgggccccggaaccgccccgggcttcggatagttcgcaactggccccccggggcgaagggtgggcgctcagttatcagagcaactctgggggcgtctcgacctccccccccacactgaaacaaccacagtcccaagacctattttcgggggccccacccaccccacacctctcgacgcccaccaaccccaccctgccaactatcaccccccggcgacaccgggtagcccccacaaagaggcaagcaacagccgaagcggccccccacccccccgaccgctcaccacggacagacaacgcccacgcacgacagccccaccatacccacatcgacgccgagcgggc

SEQ ID NO: 22712 - protein, 52 aa, Zea mays
  misc_feature: Ceres CLONE 1392647-F
  misc_feature: SWISSPROT Homolog: EC 2.3.1.144 Anthranilate N-benzoyltransferase
MKVEVVETTLVPPSEATPRHALWLSNLDLAVPKTHTPLVYYYPEARRRPRPW

SEQ ID NO: 22713 - DNA, 640 bp, Zea mays
  misc_feature: Ceres CLONE 1392648-F
  misc_feature: Translation starting site: 223
  misc_feature (346)..(346): n is a, c, t, g, unknown, or other
  misc_feature (412)..(412): n is a, c, t, g, unknown, or other
  misc_feature (486)..(486): n is a, c, t, g, unknown, or other
cgctcataactagtggatcccccgggctgcaggaattcgcacgagaccattacctgaacatcctaatcgaaaaacgaaatggttttgccttcgcttttgcttatgcgtacgcgcggcgaatcacggcgcccaccttccaaccggacttgagtcacttgactccgccgcgggattccccgccagatctcattctcgccccaaccctaaccgccgacggtggccatgatggccaccgagcccttgtccccggggaatctcgtcgaggacgtcgaaacactacccctggactcctcctccactctcgcggctacgacggacccgctgctccgcccacctcccccctcgntcaccttctctcccaccgccggtgagaaccatggcgcttttctggacgaggaggatgaggacgtgntggatgacttcacgcctccgctggctcccatgccgctacggccgcgacgaagtcccgcgagccgtcaccgtggntcgctgagatcactgtctccgagcctaggaagcacgcggagcccgcgacgggagccgtgggcgtcattcccgggtcggccggctacgtctcctacccatcggccatcaggtggccgacggaggggagttccgcgtgcggcggcgattccgggga

SEQ ID NO: 22714 - DNA, 664 bp, Zea mays
  misc_feature: Ceres CLONE 1392650-F
  misc_feature: Translation starting site: 213
  misc_feature (562)..(562): n is a, c, t, g, unknown, or other
ggagctccccgcggtggcggccgctcttcaatagtggatcccccgggctgcaggaattcgcacgagaccattacctagaacatcctaatcgaaaaacagcacaagaacactcctagctgaagatctcgagtgcaacgcaacgttggcgcttggcggccagtagtagcagctaatttagcgtcgctccttcctagacgagagatcgagaaaccatggccaagctccaagtcactcctggcgccgcgttcaccgagtgcaatgaactcaacttccagggcctgtacctgtaccacacgcccctgggccccaaggccaaccaagctgcgatcgtagagagcaaggccaagatcggcatcggtgccaccgtggttaacaactgggcagtgtatgacgggccagggccaggcgctaagctcgtcggccgtgcgcagggcttgcacatcctagccggcaactgggtcaactcattcaccctggtgttcgaggatgaaaggttcagtgcgtccacgcttgaagtgaggggcataacggttgaaactggcgagtgggctgttgttggggncaccggccagtttgctatggcaacagcatcatctccaagaagttcacgagcagagaagcgacgggaacgtcattagagcttagtgtccatgcattctgcccg

SEQ ID NO: 22715 - DNA, 666 bp, Zea mays
  misc_feature: Ceres CLONE 1392652-F
  misc_feature: Translation starting site: 240
  misc_feature (351)..(351): n is a, c, t, g, unknown, or other
  misc_feature (356)..(356): n is a, c, t, g, unknown, or other
tccccgcggtggcggccgctctataactagtggatcccccgggctgcaggaattcgcacgagaccattacctagaacatcctaatcgaaaaactaacttctagggtttcaggactaacctccctcccttcgcgccatctcccgcggtgctgcctcctctggcgccgattcgccgctgggagccccaattctataacccctctgttcgatctgggatccgctagattcgttggggcggtgatgagggcgatggcggaagtgaatgcagaagggtgggtggagaatccgcagccactggcggcttcgagctcgtccgtggcggatggcaacaactggggcggcggaaagcggncgggnacctccccgccggggtcaagctcccgggatttgcatctccggtctgaaacgaacaagtggaccgataagaagaaactaaagggtggctggacactgaaagagggatgaacactgcgggaaggcagttgaaactttcagggttagaaaattgaaaaaaatagctgaattttttcaggaaagaactgagggtcaatgtttgcatgttggggagaaggttcttaaccgggaactatcaaaggccttgggctccggaggaagatgaaaaaatctttggccttggggggaagtatgacccaacaaaatggttatt

SEQ ID NO: 22716 - DNA, 695 bp, Zea mays
  misc_feature: Ceres CLONE 1392653-F
tcttccctagtggatcccccgggctgcaggaattcgcacgagaccattacctagaacatcctaatcgaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagcccacgccgtgtacctggccaccatccccgtcattcgtgcttggtgtgccgctctcgaacctgggcagcctccagccgcgtaccacctgcgcgcgcaggcggtggggccaaggccacctacaaacgtccccaccggcgctcgcttttccttcgcggaccgccccctaccctcttttccgcctcacatcgagggccaggcccccatcgcccgggggcacccccaccccccttccccctgggctgccacggttggtccccacccagttccccggggtctctcccggaggtgcggaattatcacaacgaggccgacggtccgactctcagactctcctcttctacg

SEQ ID NO: 22717 - DNA, 640 bp, Zea mays
  misc_feature: Ceres CLONE 1392654-F
  misc_feature: Encodes the peptide sequence at SEQ ID NO. 22718
  misc_feature (357)..(357): n is a, c, t, g, unknown, or other
  misc_feature (358)..(358): n is a, c, t, g, unknown, or other
  misc_feature (496)..(496): n is a, c, t, g, unknown, or other
  misc_feature (504)..(504): n is a, c, t, g, unknown, or other
  misc_feature (640)..(640): n is a, c, t, g, unknown, or other
aaagctggagctccccgcggtggcggccgctctagaactagtggatcccccgggctgcaggaattcgcacgagaccattacctagaacatcctaatcgaaaaggtgatagttctgattcccaggcaaggaaccctcttatcccttctcgtctcctgtcccgggaccggggaggccgggatcgagaaggggaacgagcgcgtcccgtgctcgccactcctcgccgatggcgtcctccactctgccagcctcccccttccgtatgtctctttccggactacgagccccggaccctgctaaggttaagcacgtatccgttcgaacccccgctcgccgtcttcccgttgcagcctccgcgnncacatcaggcgccgcggcggcggcggcgagggaacgcaagcgtttcctggagcgctacgggctcacccaaacgacttcgaggaagatgcagagataatccgagggtctactccaatattctgaaacttatcgtatggncaattggngggattttgagggggaaggcttcccttttcattttttgcagaggaaaaaaaggacaggggagggggagcatcccggaaaaggggaacaaattgggaaggggcatgactccggggagggggaggggccccgggaaan

SEQ ID NO: 22718 - protein, 76 aa, Zea mays
  misc_feature: Ceres CLONE 1392654-F
  misc_feature (45)..(45): Xaa is any aa, unknown, or other
MASSTLPASPFRMSLSGLRAPDPAKVKHVSVRTPARRLPVAASAXTSGAAAAAARERKRFLERYGLTQTTSRKMQR

SEQ ID NO: 22719 - DNA, 671 bp, Zea mays
  misc_feature: Ceres CLONE 1392655-F
  misc_feature: Encodes the peptide sequence at SEQ ID NO. 22720
  misc_feature (431)..(431): n is a, c, t, g, unknown, or other
  misc_feature (475)..(475): n is a, c, t, g, unknown, or other
aaagctggagctccccgcggtggcggccgctctataactagtggatcccccgggctgcaggaattcgcacgagaccattacctagaacatcctaatcgaaaaatttttaccgcacatctctccttcctcggcgtctcgcacaccccagcaccttcgtctcccctcccctcccctcccctcccccaacaatcggaaccggatagaaagttcggcttcctcccggacgactcggcgcaaggtcgcagcttttctctcgatttttcgcgcttccccgttttgacgcttgcttcgcatggggattctggagatctttggggcggttcgctgctgagatggttcgcctcatcacgcgctgctgtgactcccaacagttcttccgacccgaggagcccctgttatgaacggcatgccgatctctgcgtcctctgcgnaaagcgtcgacagtgccgcggtgggcgccggcacacccatgaanaatgcaacgggggcggacgctctcgccgagatggcgagacatcttaccgtggaaaggaaagaaacctttccggggctggtggagctccgccgtggacgaagacgaaaaaggggctggcccccgcggtggggaggggcgccccctggcccgcggggaacaagctgggcctctggaaccccccggcagaaaggcccgc

SEQ ID NO: 22720 - protein, 91 aa, Zea mays
  misc_feature: Ceres CLONE 1392655-F
  misc_feature (12)..(12): Xaa is any aa, unknown, or other
  misc_feature (26)..(26): Xaa is any aa, unknown, or other
MNGMPISASSAXSVDSAAVGAGTPMXNATGADALAEMARHLTVERKETFPGLVELRRGRRRKRGWPPRWGGAPPGPRGTSWASGTPRQKGP

SEQ ID NO: 22721 - DNA, 797 bp, Zea mays
  misc_feature: Ceres CLONE 1392656-F
  misc_feature (52)..(52): n is a, c, t, g, unknown, or other
  misc_feature (797)..(797): n is a, c, t, g, unknown, or other
aagagcccccccccccccccccctggggcggggtgaatattacctctccctntacaaagctggcgctccccgcggtggcggccgctctataactagtggatcccccgggctgcaggaattcgcacgagaccattacctagaacatcctaatcgaaaagttgttcccttcgttctctctccatctatctccctcagattacttgcgaccagcgacgctctggctggcccctttgagattgacctggggcttccatacaccaagagtgcagaaggaggatagatagatttggtggaagggttctccagggccgtcttctctccctctctctcaagtaaggtagcgtcgcctcctcggtgggggggtggaaagagggaaaattcccgaacctccctttggccaagaaaatggattcggaagcgggggggggtccgccggctataaccccaaggggggggggggcagcccccaacctttcttggggccggggggttttcaaaggaagtcttttggccgtggggggaatcaaaaaaaggagggctccccccggaaacctggggggggggtgggggccccccccctaatatgggccttcccggggggtgggggggttttctttccccaagggggccaagaagagtttcccccgaaaacccacttttttttttgggggccgagagatttttacccccccaccccacggggcgggggggggggaaaaaaaaatgtgtgtttttcctcccccacaaattgtgggagacaaaacaagcgcgcggtgggaagtccctaacacaaaccn

SEQ ID NO: 22722 - DNA, 758 bp, Zea mays
  misc_feature: Ceres CLONE 1392658-F
  misc_feature: Encodes the peptide sequence at SEQ ID NO. 22723
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (30)..(30): n is a, c, t, g, unknown, or other
  misc_feature (32)..(32): n is a, c, t, g, unknown, or other
  misc_feature (33)..(33): n is a, c, t, g, unknown, or other
  misc_feature (35)..(35): n is a, c, t, g, unknown, or other
  misc_feature (36)..(36): n is a, c, t, g, unknown, or other
  misc_feature (729)..(729): n is a, c, t, g, unknown, or other
  misc_feature (758)..(758): n is a, c, t, g, unknown, or other
tttccccccccnnnnnnnnnnngnnnngcngnntnntaaccatcctcccccaacactggagctccccgcgggggcggccgctcttccactagtggatcccccgggctgcaggtattcgcacgagaccattacctagaacatcctaatcgaaaagcaaagaggcgtcttccaagtttgtagggttaccggatcggaggagcatccccgcctaggtcaccacaggcatggttcgcggatcgctaggcaagcttgcgtcgcgcgccctctccgtcgccgggagatggcagcaccagcagcttcgccgcctcaacatccacgagtaccagggtgcggagttgatggggaagtacggtatcaacgtacccaggggtgcggcggcggggtccgtacaggaggtcaatgacgccttgaagaacatgttccccagtgagaaagagatagttgttaaaagtcaaatccttgctgccggccgagggctgggaactttcaaaagtgggctgcaaggaggtgtccatattgttaaggctgaggaagctgaaagcattgcacgtaaaatgttacgccagattctggaaacgaaacaaactggtcccggagggaaaagattggggagcaagggcctaccttgtgtgaagaaactggctccttagctaaggagcagggatttttggccatcccccccttgattagggacaaaccgcgccgactcccgccttcctttacgtgggntgggcggttccggtactccctcacccccn

SEQ ID NO: 22723 - protein, 141 aa, Zea mays
  misc_feature: Ceres CLONE 1392658-F
  misc_feature (29)..(140): Pfam Name: ATP-grasp_2 Pfam Description: ATP-grasp domain
  misc_feature: SWISSPROT Homolog: EC 6.2.1.4 Succinate--CoA ligase (GDP-forming)
MVRGSLGKLASRALSVAGRWQHQQLRRLNIHEYQGAELMGKYGINVPRGAAAGSVQEVNDALKNMFPSEKEIVVKSQILAAGRGLGTFKSGLQGGVHIVKAEEAESIARKMLRQILETKQTGPGGKRLGSKGLPCVKKLAP

SEQ ID NO: 22724 - DNA, 683 bp, Zea mays
  misc_feature: Ceres CLONE 1392660-F
  misc_feature: Encodes the peptide sequence at SEQ ID NO. 22725
  misc_feature (315)..(315): n is a, c, t, g, unknown, or other
  misc_feature (480)..(480): n is a, c, t, g, unknown, or other
  misc_feature (683)..(683): n is a, c, t, g, unknown, or other
aaagctggagctccccgcggtggcggccgctctataactagtggatcccccgggctgcaggaattcgcacgagaccattacctagaacatcctaatcgaaaatttttctgctgcccagccgccgtccgtccgcgcttcactatccttcattccctcccctgtcagcgacgactgggtaggctaccgccgccgccctacgctaggtgcccatctcttcgccggcgaagagcgcccaccaagctccggccaagggcgtgatggcggctgtaggcagcttgaagccggggatggagactcttcatgtgcaggactacnaggacgcgcctccggccaaggccgcggtagagagcctccagccggcgatggagagtctgcatgtgcaggattacaaggacgcgcctccggccaagggcgtggccgccgccgccgccgtagggagcttgcagccgggggcggagatcctgcaggtgcaggactacnagggacgctacatgtattatggtgcttacccggcttatgcctatggagcctatggtggggctggggggagtacccatacctgagccatgatggagcacagacaccaactgctggtacctatgctgacatgtactatggtatgctcccaatatggtggtgcaccatgggggcatgatggtccagatttatgggtcacagatttn

SEQ ID NO: 22725 - protein, 101 aa, Zea mays
  misc_feature: Ceres CLONE 1392660-F
  misc_feature (20)..(20): Xaa is any aa, unknown, or other
  misc_feature (75)..(75): Xaa is any aa, unknown, or other
MAAVGSLKPGMETLHVQDYXDAPPAKAAVESLQPAMESLHVQDYKDAPPAKGVAAAAAVGSLQPGAEILQVQDYXGRYMYYGAYPAYAYGAYGGAGGSTHT

SEQ ID NO: 22726 - DNA, 724 bp, Zea mays
  misc_feature: Ceres CLONE 1392662-F
aagctggagctccccgcggtggcggccgctctatcactagtggatcccccgggctgcaggaattcgcacgagaccattacctagaacatcctaatcgaaaaaaaaataaaatccaattttctcagtctcgagcgcccgcgtccctcgccccgtcgcgactcgcgacttcgcgagtcgccccgtcccagcctcccagccgtcccggctccccgcgaccccgccctccggcagtccgggcgcgggggctcctctccgatccggtgagccgaacgaggatcccaactccccgaagaaagcggccacagccagagccaggggtggctcggctctcctctcacagactgcgccgcagcgcctaagggttgggctggcagccgctcccgggcggtcgtaccccgggccccggcccctgttggctaaattccgcctggaagccaaaagatctggcccccaagggaccggcccgggctggccccttgggggttttcgggggggtcttgggaacccagtccaacccccttttgtccccacaaatacggagggtggcagaagtggtatctctcgaaaaaacatttccccgacaaaagtattttccacgctcagtggcctggcccccttttctctcatgggctggtgttatttccctcctctataattactccacgtcgtcaataaacatccctcccccacccccccacgtcaacctctaatctcacccgctaaa

SEQ ID NO: 22727 - DNA, 663 bp, Zea mays
  misc_feature: Ceres CLONE 1392665-F
  misc_feature: Encodes the peptide sequence at SEQ ID NO. 22728
ccccgcggtggcggccgctctatcctagtggatcccccgggctgcaggaattcgcacgagaccattacctagaacatcctaatcgaaaaatccgttccccgccttccgcttccctaccccccgcatcacctaccaacggcgacaccatgggccccttcgcgaaggaggagcaccaggtcctagccgagctcgtcctcgcgcagcgcaacccaggcgcgttcgcatgcggtgcgtggggcgtgtcaggtcccaccgtcacctccacgagcccgaccaacaatcaggtcatcgcagaggtcgtggaggcgtccgtgcacgactacgaggagggcatgcgcgcctgcttcgatgccgccaagacatggatggcgattcctgctccaaagcgaggagagatcgttaggcaaatcggtgatgcactgagagcaaagctccatcaccttggcaggcttgtgtcacttgagatggggaaaattcttcctgaagggatcggtgaggttcaggaaatcatcgacatgtgtgattatgctgtggggctaagtcgccaactaaatggatccattataccatctgaacgaccaaccatatgatgatggaggtgtggatccccttggaagttgtggtgttataacggcatttaatttcccttgggctgggcttggg

SEQ ID NO: 22728 - protein, 147 aa, Zea mays
  misc_feature: Ceres CLONE 1392665-F
  misc_feature: SWISSPROT Homolog: EC 1.2.1.3 Aldehyde dehydrogenase (NAD(+))
MGPFAKEEHQVLAELVLAQRNPGAFACGAWGVSGPTVTSTSPTNNQVIAEVVEASVHDYEEGMRACFDAAKTWMAIPAPKRGEIVRQIGDALRAKLHHLGRLVSLEMGKILPEGIGEVQEIIDMCDYAVGLSRQLNGSIIPSERPTI

SEQ ID NO: 22729 - DNA, 739 bp, Zea mays
  misc_feature: Ceres CLONE 1392667-F
  misc_feature: Encodes the peptide sequence at SEQ ID NO. 22730
  misc_feature (1)..(1): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (20)..(20): n is a, c, t, g, unknown, or other
  misc_feature (25)..(25): n is a, c, t, g, unknown, or other
  misc_feature (46)..(46): n is a, c, t, g, unknown, or other
  misc_feature (47)..(47): n is a, c, t, g, unknown, or other
nggttggtnnnannnnnaantgganactggcaaaacaaaaaaaatnnggcccgccgccccccaaaataacgctccaccgcggtggcggccgctctagaatagtggatcccccgggctgcaggaattcgcacgagaccattacctagaacatcctaatcgaaaaatatccccagctttttctccaagcgtccgttcaggaagctgtccggcaacgagccgctcggcactgggcggtggccgtgcaagagcgatcgggaccgcatcgctcgtctgctcctccaggcctccgcctccctcatcatcactgcagcggcgagaagaacaagggacggtccggcggtggtctccactgacatcgcctaccatggctaccatgctgcgccggtgcatgcgggatctgcgcccgctgcggtctctcgcgagggtccccagaccgatcttcggcgagagtccaacatttcttaaatgtagaaagaactcaacaaaggcatctcccaaagagttctacacagaatgctgccccaggtcctcaaggacaaccttctcaggcgggaaaagaatggtctcaaagccttgctcttggaaactccttgggggtccggggcagcaaggctatacgggggcaccatccaccttgggtgggattcaggagccccccaattttacgcggccaaggacattctgcccctctttaagcctaagggcaagacggaaacacggtcccgccaccgcgccccaa

SEQ ID NO: 22730 - protein, 75 aa, Zea mays
  misc_feature: Ceres CLONE 1392667-F
MLPQVLKDNLLRREKNGLKALLLETPWGSGAARLYGGTIHLGWDSGAPQFYAAKDILPLFKPKGKTETRSRHRAP

SEQ ID NO: 22731 - DNA, 637 bp, Zea mays
  misc_feature: Ceres CLONE 1392668-F
  misc_feature (637)..(637): n is a, c, t, g, unknown, or other
gctcttcactagtggatcccccgggctgcagtatttcgcacgagaccattacctagaacatcctaatcaaaaaggacccttgtttgcctatacgctgccagcctgccttttataagttcttcttccatcgctccacccccacccccttctctctcgtagcaacgtttggtccgccgtctctgccgctctactcggtcgtccaggtcttgtacgaccccttcgccgacgaggcagcggacactttcttatgtctgataggatctatgtccgattatcatgatgatgactacgacattgatgagattgagaatgactatgatatggatgatcctgctgatgtcatggaagactagcagcgagccgtaggcattctgatgcgcaggtcacgattatggacaaccaatggacagtcccagatacttcatcactatatgctagaaatgaagggactttcaaggactaccgtgtaagcccctaaccttaccccttaaaaatatagacgggccgattaaaacagtgaaaaattttgggaatggccctacctctggaaaaaaacttatgaaggtttgacagcccacaaaaaagggggaaaggcctatgagctcaaacaaataacctcgacgaaaaaggcaaattn

SEQ ID NO: 22732 - DNA, 908 bp, Zea mays
  misc_feature: Ceres CLONE 1392671-F
  misc_feature (9)..(9): n is a, c, t, g, unknown, or other
  misc_feature (10)..(10): n is a, c, t, g, unknown, or other
  misc_feature (12)..(12): n is a, c, t, g, unknown, or other
  misc_feature (15)..(15): n is a, c, t, g, unknown, or other
  misc_feature (16)..(16): n is a, c, t, g, unknown, or other
  misc_feature (35)..(35): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (185)..(185): n is a, c, t, g, unknown, or other
ttacccccnncnacnnatcgcctatcccctccccngccgnnnnaacatagtggagctccaccgcggtggcggccgctctattactagtggatcccccgggctgcaggaattcgcacgagaccattacctagaaacatcctaaatcgaaaaaacaaaaaccagaccacgtcggaacggcaacagcnaagcttgcctctcctcccttggcgcgcgcggtgatttcatctctcgcccgatcccatcccaccccaccccacctcaccgggagcccctctccccctaactcctccggcagctgctccgatcccgaaaccgtgattcgctcgatggcggaaaccgcgggcggcaacaagatccgcaaccgccaagctggttcttcttgaggacgtgggcgccggcaaatcgagccctggcccttcgggtttgtgaaaaggccagttcgtcgaagtcccaggaaatccacccatccggcgccggttttctttctccgaaagaaccccggggcggtggaaccgacgaacacggcccaaagcctccaagaaaatggggaacacgggccggggggcaaggacgccgcgcacccaccgggcttggggcctcccccagggtacttaacccggggacgtggcctggcgggacttgtgccatataattgtgtgtctaaacaaaccctctcagcgaaaccgccgggcccctccttttttaccgccgggccccaaagaaaataggagggcctcaaccaacacctttctaagacaacaaggggaacaactccggaaaacaaaataagacggtctcctttggcccgagaaaaccaagggttggattttttgcaaaataaccacaaggcagggtgggtcctgaagaatagaaacaaaaagcgggttatgtccccaaacaaaaaatgg

SEQ ID NO: 22733 - DNA, 735 bp, Zea mays
  misc_feature: Ceres CLONE 1392673-F
  misc_feature: Encodes the peptide sequence at SEQ ID NO. 22734
  misc_feature (532)..(532): n is a, c, t, g, unknown, or other
  misc_feature (541)..(541): n is a, c, t, g, unknown, or other
  misc_feature (631)..(631): n is a, c, t, g, unknown, or other
  misc_feature (735)..(735): n is a, c, t, g, unknown, or other
aaagctggagctccccgcggtggcggccgctctataactagtggatcccccgggctgcaggaattcgcacgagaccattacctagaacatcctaatcgaaaaaagcagcgaaatccaatctagaagcgcccctctccctctctctctctctcttcgccgtccgaagctccgcaccccaatctaatcgacacctcgccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgcggctcagaactgctgggttaagaagggaggtgctttcaccggtgaagtcagtgctgagatgctcgtcaaccttggtgttccctgggtcattcttgaacactctgaaaggagagctctgctgggagaatcaaatgaattttgtgnagacaaggntgcgtatgccctgtctcagggactaaaggtcattgcatgtgttggtgagacacttgagcagagggaggctgggtctaccatggaggttgntgctgcacaaacaaaagcaattgctgagaagatcaaggactggagcaacgtagttggtgcctatgaaacagttgggcctatgggaactggaaaagctgccaccn

SEQ ID NO: 22734 - protein, 178 aa, Zea mays
  misc_feature: Ceres CLONE 1392673-F
  misc_feature (5)..(178): Pfam Name: TIM Pfam Description: Triosephosphate isomerase
  misc_feature: SWISSPROT Homolog: EC 5.3.1.1 Triose-phosphate isomerase
  misc_feature (111)..(111): Xaa is any aa, unknown, or other
  misc_feature (114)..(114): Xaa is any aa, unknown, or other
  misc_feature (144)..(144): Xaa is any aa, unknown, or other
MGRKFFVGGNWKCNGTTDQVEKIVKTLNEGQVPPSDVVEVVVSPPYVFLPVVKSQLRQEFHVAAQNCWVKKGGAFTGEVSAEMLVNLGVPWVILEHSERRALLGESNEFCXDKXAYALSQGLKVIACVGETLEQREAGSTMEVXAAQTKAIAEKIKDWSNVVGAYETVGPMGTGKAAT

SEQ ID NO: 22735 - DNA, 672 bp, Zea mays
  misc_feature: Ceres CLONE 1392674-F
  misc_feature: Encodes the peptide sequence at SEQ ID NO. 22736
  misc_feature (428)..(428): n is a, c, t, g, unknown, or other
  misc_feature (436)..(436): n is a, c, t, g, unknown, or other
  misc_feature (440)..(440): n is a, c, t, g, unknown, or other
  misc_feature (441)..(441): n is a, c, t, g, unknown, or other
  misc_feature (447)..(447): n is a, c, t, g, unknown, or other
  misc_feature (450)..(450): n is a, c, t, g, unknown, or other
  misc_feature (464)..(464): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (477)..(477): n is a, c, t, g, unknown, or other
  misc_feature (488)..(488): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (498)..(498): n is a, c, t, g, unknown, or other
  misc_feature (499)..(499): n is a, c, t, g, unknown, or other
tccccgcggtggcggccgctctataactagtggatcccccgggctgcaggaattcgcacgagaccattacctagaacatcctaatcaaaaaattgttcgcgtcgtccgccttctctctctctctaacccactgccagccacctcttcgaccgtcgcgaccactcgccaagtaaattttcttccgcccacctgactacgcctcgacctcggcctcggcgccgcctccgtccgccggacgcggcagccatggcgccagcggtggggctcaagcgctccgccacgcagaccatcactctgccgccgcccgacacgcggctggctgtgcgcgatgtcatgcgctccacgatcccgtcgcagcccgccgtggcgccggcgtccacggagaggcaggcgcccgccgcggcgttgcaggggttcctgtgcctggnaggagtgnacgnnaggcgntgnagctacgtggtggnacgtgnnnccgcnaaaagggagancagnnnncgnngccgtccccgctggggccgcccgtcagggcccgtgccgctgcagtcgccgcttccggctggcggagaaaatatggcattcataagaatcatatgtgggggccctgaaggtttcccagaaaggggtactcccttcatatgaaccttacagggaccttggaggggttctgaagtt

SEQ ID NO: 22736 - protein, 130 aa, Zea mays
  misc_feature: Ceres CLONE 1392674-F
  misc_feature (61)..(61): Xaa is any aa, unknown, or other
  misc_feature (64)..(64): Xaa is any aa, unknown, or other
  misc_feature (65)..(65): Xaa is any aa, unknown, or other
  misc_feature (68)..(68): Xaa is any aa, unknown, or other
  misc_feature (73)..(73): Xaa is any aa, unknown, or other
  misc_feature (75)..(75): Xaa is any aa, unknown, or other
  misc_feature (76)..(76): Xaa is any aa, unknown, or other
  misc_feature (81)..(81): Xaa is any aa, unknown, or other
  misc_feature (82)..(82): Xaa is any aa, unknown, or other
  misc_feature (83)..(83): Xaa is any aa, unknown, or other
  misc_feature (85)..(85): Xaa is any aa, unknown, or other
MAPAVGLKRSATQTITLPPPDTRLAVRDVMRSTIPSQPAVAPASTERQAPAAALQGFLCLXGVXXRRXSYVVXRXXAKREXXXRXRPRWGRPSGPVPLQSPLPAGGENMAFIRIICGGPEGFPERGTPFI

SEQ ID NO: 22737 - DNA, 720 bp, Zea mays
  misc_feature: Ceres CLONE 1392676-F
  misc_feature: Encodes the peptide sequence at SEQ ID NO. 22738
tgccccccccagataaaaaagaggatacgggggtggggaatgttaaacccaaaatggagctccccgcggtggcggccgctctagaactagtggatcccccgggctgcaggaattcgcacgagaccattacctagaacatcctaatcgaaaagcgattttaccgtggacgactggagagggcgacggggacgaacgagacgaccgtacattcgttatcggactgggaagcagcggcggtacaaagtgtgggagagaaaggagaagagacttgatgtcctcgcagtttgtccaatagatctcctcgccgcctcacccgtctcctcctccgcagcttccccgcgatcccgaccatggagggcgacggtaccaacccttgatgcggcgatagagtcgctcctgaatgtcgagaagcagatgaggctggccggagatgtcgccggcactcggaaggccgtcatcgacatcgtcgagctctgctacaagggcggcgcgtggaagacgctaaacgaccagatcgttctcctatctaagaggagaggccaggcttaagcaggctattactgctatgggtcagaaagcaatgcagtatattaattttgaccccagggcattgacacaagccttcgaggctaataaaaaccactgaagcagtgtcctctgctggccaaaaacctatggttggagataaaagagaggcaaagattgatccaaaggcttgga

SEQ ID NO: 22738 - protein, 44 aa, Zea mays
  misc_feature: Ceres CLONE 1392676-F
MRLAGDVAGTRKAVIDIVELCYKGGAWKTLNDQIVLLSKRRGQA

SEQ ID NO: 22739 - DNA, 776 bp, Zea mays
  misc_feature: Ceres CLONE 1392681-F
tacccccccccccccccccgccccctacttaattatatattattacaccataaatacgggagggggtccaggggggggggggacgtttctccaaaagcggatcccccggcctgcatgaattcgccacgagaccattacctagaacatcctaatcgaaaataaattctaatcgaaaactcggcctgaatcgaacagctggatcatcaagtactgttgatgctaatgtggatgctactgtattgccacttgaacctaaaggtggccaactgcctttgttcagcagcggcgatcgcatgtcagacattgattctggatatgaggcagcagaaattgcagcttctactcaaacctcttcgggtgtcacaacatatctgtgttctgctggaagtgattttggaagctaatggatgctggttaatcctgaccaatcagaggcaccatcaacttctgctggtacatcatcgcagcagaaagtcggaccctacaagcgagcctcagcggcatggaagccccgccttccagatcagccggaagaaacagaggcacaataactcttttgccgccctttcccgcgctgctaacccacccccccccacaacccccctctggtaccattaataagtcccattacacaaactaaacaatcgagcggcgaaaacgcccacaaaagaagcctgagacccaccccggcccccaccccacaacaaagtcgcggcgaacagacagaaggggttgggaggggggggagggaagggggattgcgggggagaaacgcg

SEQ ID NO: 22740 - DNA, 724 bp, Zea mays
  misc_feature: Ceres CLONE 1392682-F
gctcagttacagaggatcccccgggctgcaggaattcgcacgagaccattacctagaaatcctaatcgaaaactgatacaaacccgtcctctgtccgtcctaccaccaccgctcacctcggtttggctttctcccctcttccgcacccgcttctcgctccggattccggattccctctgctctttccctaccgaaggtagccacggcgggcagaggtaaggtgatcggctcaggcgccgccaagaaggtcacgtccaggagctccaaggctggcctccagttccccgggggaaggatcgcccggctccctcaaggccggcaagtatgccgagagagtcggcgacggcgcccctgtctacctcgctggcgtgctcgagtatctttgctgctgaggctcttgaagctggcccgccaatgcgggcaccgaacaaccaaaagaccccccaccgcacccgccgcccacatccacctcgccctcccgccaccgacgaaacagcccccaccccttgttcgggcacgggggacccatcgctagcggggggcgcaactggccgcccctccacaacccttttcgcccccgaaaaaagcgccgaccgccggctagcccccagggttgccgggcgggtgacccagaacctatcgcccttcacctgcgcccggggggggaccctccgggacggctcgccccacccaacctcgcgccctgggccagaaacggcaggcg

SEQ ID NO: 22741 - DNA, 662 bp, Zea mays
  misc_feature: Ceres CLONE 1392685-F
  misc_feature: Encodes the peptide sequence at SEQ ID NO. 22742
  misc_feature (457)..(457): n is a, c, t, g, unknown, or other
  misc_feature (662)..(662): n is a, c, t, g, unknown, or other
ggagctccccgcggtggcggccgctctagaactagtggatcccccgggctgcaggaattcgtacgagaccattacctagaacatcctaatcaaaaagtcacgctagtagtaggaaatcctagcgcgtcgctgcttccattaccgcctccgcaaccagcccgccgcgcccccgagcgtttcgttccgggagcggcaagactgggacacgccagccctttatttcgagctttctgcgtgcgggaggggggttgacaggcgatggcggccgagggcgaggcggcggcgctggagttcacaccgacgtggatcgtcgcggcggtctgctctctcatcgtgctcctctcgctcgtcgccgagcgatgcctccactacctcggcaagacgctcaagaggaaagaccagaagccgctcttcgaggcgctgctcagggtcaaagaagagtgatgccttctggggntcatctcctgctggctgacggtgtcccaggggatgatccgggaggacgtgcatccctgaacgctggaacatccacatgctgccatgcgagaagccaaatgaaagggccggggaggccgccccatgggagattttggagggacccttggcaagaaccggaaggcggctgtttaaagaaagacctgttgggggttgaaaaaaggcan

SEQ ID NO: 22742 - protein, 61 aa, Zea mays
  misc_feature: Ceres CLONE 1392685-F
MAAEGEAAALEFTPTWIVAAVCSLIVLLSLVAERCLHYLGKTLKRKDQKPLFEALLRVKEE

SEQ ID NO: 22743 - DNA, 701 bp, Zea mays
  misc_feature: Ceres CLONE 1392688-F
gctctcaactagtggatcccccgggctgcaggaattcgcacgagaccattacctagaacatcctaatcgaaaaacacagccgccgctgtttcttcatcttactcgtgctcggcacgcaggcgacggcgacggcggcggcgttcaggctcgggctctcagcgacggtatcagtggtctcccgcctctcgccagtcgcgtcgcgccctcgcctccggtcctctgcacaccgtccggtgaccttgtgttgaaagtttttccaggaactgcttgctcacccatttctcaattaaaaaacctcaaatttctggtccctgagccacaatccaggaccataccaatttagtgagtccggacagatggcaaatgcccgcagttctgggccaatggtggattcccagggccggtccccaaaggaactaatcagggtgttggttggtggaaccccggggaagggaaatgggaaaaggatggggtttttggcatggaaaattttcccgggggccctctaacttcttaaaagaggtttacccctaatcaccggggggatctgtgaaaaaaggaatgtgccctacaaaagcggcaatgaaaaaaacgacaacaggtatttccgggtcataagtcgaggggcacgtgcgccggcggcccgcggaaagagggctcatatcaccaagccgtgcgttgcagtgctatagacgcctgcg

SEQ ID NO: 22744 - DNA, 661 bp, Zea mays
  misc_feature: Ceres CLONE 1392689-F
  misc_feature: Encodes the peptide sequence at SEQ ID NO. 22745
  misc_feature (412)..(412): n is a, c, t, g, unknown, or other
  misc_feature (462)..(462): n is a, c, t, g, unknown, or other
  misc_feature (463)..(463): n is a, c, t, g, unknown, or other
  misc_feature (661)..(661): n is a, c, t, g, unknown, or other
acccgcggtggcggccgctctatcaatagtggatcccccgggctgcaggaattcgcacgagaccattacctagaacatcctaatcgaaaagggacccgatccctctccttctctgacccgacccgaccaatccaatccatcccctctccatctcccatgaccatgaacagcggctcggcaatatactactgctaggttatgctactccattacgaaaaagcgcagaaagagcgcagaatggaatcgtcgctcttatcatactccatgactccatcactagactagagagagaaacccttgtaccctttgttctgtttatcccccatttctccgagtcacccacccatcgccgaacttcgagtccaaggaagcggagccaccggagaaggggatatttgcctttcccgtcggnggcctagggagcaggagagatgcagcggcggcgggggcaaacgtgggcgnnggtggagaagacggcccaggcggcgtcggcgcacgccgcgctcttctgcttcactctcctcctcgcgctcagggtcgacggacgcaccacatactcctggtggataatattcattccactatggctctttcatggatattgtgcgcgtggaaggttttcaatgcctgccccttcattacctcatggccgtcattgggn

SEQ ID NO: 22745 - protein, 76 aa, Zea mays
  misc_feature: Ceres CLONE 1392689-F
  misc_feature (11)..(11): Xaa is any aa, unknown, or other
MQRRRGQTWAXVEKTAQAASAHAALFCFTLLLALRVDGRTTYSWWIIFIPLWLFHGYCARGRFSMPAPSLPHGRHW

SEQ ID NO: 22746 - DNA, 621 bp, Zea mays
  misc_feature: Ceres CLONE 1392689-R
  misc_feature (621)..(621): n is a, c, t, g, unknown, or other
caattgggtaccgggccccccctcgaggtcgacggtatcgataagcttttttttttttttttttgttccaatcacctcagtacggcttgaaatcatatctcccgtgattcttggtcaaagatcggacacaacttttcttgtccaggcacgcttccacaacccttacatgctctcgctgacccttcacattgtgaaaagccaccaagccgccgacgaagcattgcggtaacaaatttcggcagacatttttctactacaaaataatacaacagagatgtttacatttttttgttccactttcttctcaaacaaggactagattcaaacaaggcagtgtttttatttacagtctgtttttgtttcactttcttctcaacaactgcatatccctgagaaaatgctgctacgcgaacaagactatctgactcatctaccaatcacaagagggaagggaaatacactgaccacatacttacagtagataactggtccaaaacgacaatgctcatcaaccacatatccatgcttttggttagacatgatatacttgtatttcccccatatattgcaaaccctttctgaagtgcaaacctcaatcagcttaaagttgtgatcgagacn

SEQ ID NO: 22747 - DNA, 696 bp, Zea mays
  misc_feature: Ceres CLONE 1392694-F
  misc_feature (292)..(292): n is a, c, t, g, unknown, or other
  misc_feature (293)..(293): n is a, c, t, g, unknown, or other
  misc_feature (300)..(300): n is a, c, t, g, unknown, or other
  misc_feature (304)..(304): n is a, c, t, g, unknown, or other
  misc_feature (308)..(308): n is a, c, t, g, unknown, or other
  misc_feature (309)..(309): n is a, c, t, g, unknown, or other
  misc_feature (329)..(329): n is a, c, t, g, unknown, or other
  misc_feature (334)..(334): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (347)..(347): n is a, c, t, g, unknown, or other
  misc_feature (348)..(348): n is a, c, t, g, unknown, or other
  misc_feature (350)..(350): n is a, c, t, g, unknown, or other
  misc_feature (544)..(544): n is a, c, t, g, unknown, or other
tccccgcggtggcggccgctctatcaatagtggatcccccgggctgcaggaattcgcacgagaccattacctagaacatcctaatcaaaaatcaccaaacgccggtggagtcactcgagcccgcccgggtctcttcctcttccattgattccattcaagatcactactgttaccagccagccagtcgttcgttaagaagagagcgagcgagcaagagagagagagagggagaagggggaagatcagaacgaagagagggagatgagggggcaaacgcagacagcttccgcgnngggccgntggncganngcgacgcgctgccgcgtggngttgntggggnnngcccnngnccctcctgcttgccatttacggaggtggccgggggggggcttggtggaatccaacccgggcctgggctaaaatttttaaaaaaaaaggttgccccagggggggcctctttggccgagggtccccgggggggagggctccccaaaaccgggctcccgggggggcccccccgccccccctttttggggggggtttnagggggggggggagccgctacctctctgggggcccccgggaaaagaaaaaaaaacgcccccccccacttggctggggggttcctacattatttccacgaataccgaggcgtcggggggtggggcgcaccctcacgctgtgcgcgctccttcc

SEQ ID NO: 22748 - DNA, 663 bp, Zea mays
  misc_feature: Ceres CLONE 1392698-F
  misc_feature: Encodes the peptide sequence at SEQ ID NO. 22749
  misc_feature (249)..(249): n is a, c, t, g, unknown, or other
  misc_feature (609)..(609): n is a, c, t, g, unknown, or other
  misc_feature (617)..(617): n is a, c, t, g, unknown, or other
aaagctggagctccccgcggtggcggccgctctagaactagtggatcccccgggctgcaggaattcgcacgagaccattacctagaacatcctaaaaaaaaaggaattctgccttcttctctcatcttcctgctcaacatcagtagcagctttagctgtagcagcgccaccggccaccgccacgctatggccaccacgttgcacaagcccctgggggcgatcaccgttgacgacctcgccgcggcggcngcctgggtcggacgccaccgcgctccacgcagcgctccggcgcgcgctcgactcgcacggacccaccgaagtgtggggcgagctctgccggtccgtgctctgtccgtctgtccccttcgccgtccaccggatgctctactacggttgcttcgccgggttcccgtctcccacgccgccgcctggacgcccgaccccaaggaggctgtcttgaccaatgtcggccgtgtcctcgaggcgcggggtagggacttcctcggcgacgcgtaacaggatccatccccagctttccagacctccacaagttctccaacgaaaccccgaggcggactggaagatggtatttgaggatatgggtatccnattccagngaagagccatcctgcatctggaaaaagaaccctgcatatcctgggg

SEQ ID NO: 22749 - protein, 109 aa, Zea mays
  misc_feature: Ceres CLONE 1392698-F
MATTLHKPLGAITVDDLAAAAAWVGRHRAPRSAPARARLARTHRSVGRALPVRALSVCPLRRPPDALLRLLRRVPVSHAAAWTPDPKEAVLTNVGRVLEARGRDFLGDA

SEQ ID NO: 22750 - DNA, 666 bp, Zea mays
  misc_feature: Ceres CLONE 1392700-F
  misc_feature: Translation starting site: 234
  misc_feature (246)..(246): n is a, c, t, g, unknown, or other
  misc_feature (247)..(247): n is a, c, t, g, unknown, or other
  misc_feature (255)..(255): n is a, c, t, g, unknown, or other
  misc_feature (258)..(258): n is a, c, t, g, unknown, or other
  misc_feature (259)..(259): n is a, c, t, g, unknown, or other
  misc_feature (262)..(262): n is a, c, t, g, unknown, or other
  misc_feature (263)..(263): n is a, c, t, g, unknown, or other
  misc_feature (271)..(271): n is a, c, t, g, unknown, or other
  misc_feature (298)..(298): n is a, c, t, g, unknown, or other
  misc_feature (301)..(301): n is a, c, t, g, unknown, or other
  misc_feature (304)..(304): n is a, c, t, g, unknown, or other
  misc_feature (326)..(326): n is a, c, t, g, unknown, or other
tccccgcggtggcggccgctctagaactagtggatcccccgggctgcaggaattcgcacgagaccattcctagaacatcctaatcgaaaaccacctccaaagtccaaaagcgaagcctacgcccgccccaacggtgaaaacgtcggaaccctagatccctctcacggtcgcgcctgtgctccaaaaccttagatccgacatgcatcagcccagagcccgctacccacccgggtatggctccagcgnnggaggcgntgnncgnngaaggcgntaatggagtaggaagaaagagcagcgncgncgnaggaaaacacaactactacggncggaacacacatccacagcatcaacaccactaccagcagcagcagcagcactcgcataggaactcctcgcaccagcagcagtggctggcgcgagaccagggccccgccgttgcggggccagtgtctggaaacgctgtgcctaagacggcgcctcagcttgacgctggtgactcgagttcctcaagatgggaaggctcaactaaatataccagctccagacacacgctacggggacagaggatgtcactgcaacaaaagggcattgaggtttgaggatttatttcctgaaaacgtggagttgcttatggggaatatatggaagaagggattttgaaatgcc

SEQ ID NO: 22751 - DNA, 790 bp, Zea mays
  misc_feature: Ceres CLONE 1392703-F
  misc_feature: Encodes the peptide sequence at SEQ ID NO. 22752
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (22)..(22): n is a, c, t, g, unknown, or other
  misc_feature (46)..(46): n is a, c, t, g, unknown, or other
  misc_feature (49)..(49): n is a, c, t, g, unknown, or other
  misc_feature (790)..(790): n is a, c, t, g, unknown, or other
tttttttnnnccccccctcccntccccctcctctcctttaaaaatnttntgtgcaaagctggagctccccgcggtggcggccgctctagaactagtggatcccccgggctgcaggaattcgcacgagaccattacctagaacatcctaaaaaaaaaataggccgcaccgcatttcgaaaggccacgccaccgccacctccacctcctcgaagccgccgcgaccgatcgagcgaagcgtcccttcccgcgccgacgccgaaaccctagctcctcttacgccatggccaccgtgtcgctcactccgcaggcggtcttctccaccgagtccggcggcgccctggcttctgccaccatcctccgcttcccgccaaacttcgtacgccagctcagcaccaaggcacgacgcaactgcagcaacatcggcgtcgcgcagatcgtcgccgccgcgttggtccgactgcctcgctgcccgccgcctccgcgggggggcggatgtcagcgcaattcctaacggctaaggcttgcgagcccggtcggccggcggtattgggccgaagcgtaaacctgctccggttccgacgccaagcctcgcccggcccacagcggacagaaaaagcattggcaaacacacatacgcacgggggaagttaatacaccacggccgcggcggggaaaaacgcggaaacgtagacggtgaacaaacacaaacctcccagatatcaaaatcccactcttaaacggggaggataaaagacacggccaccaaatattaaatacgacaccgccaacn

SEQ ID NO: 22752 - protein, 76 aa, Zea mays
  misc_feature: Ceres CLONE 1392703-F
  misc_feature: SWISSPROT Homolog: EC 2.5.1.48 Cystathionine gamma-synthase
MATVSLTPQAVFSTESGGALASATILRFPPNFVRQLSTKARRNCSNIGVAQIVAAALVRLPRCPPPPRGGGCQRNS

SEQ ID NO: 22753 - DNA, 706 bp, Zea mays
  misc_feature: Ceres CLONE 1392714-F
  misc_feature: Encodes the peptide sequence at SEQ ID NO. 22754
tggcggccgctctatacacagaggatcccccgggctgcaggatttcgcacgagaccattacctagaacatcctaatcgaaaaaccgcagccgcagcacaatcgcctcgccttcccttccccaccagcccgtctctctcttctctctgtctctcttctcgtagccgcgtccacctcgcagcagcaagcaagcgcgaccaaatggcgcctctaggagacggcggagctgctgccgcggcgacgtccaacaacctggtggtgtcgttcggcgagatgctgatcgacttcgtccccgacgtggccgggctgtcgctggccgagtcgggcggcttcgtcaaggcccccggagacgcgcccgccaacgtcgtctgcgccatcgccaagttcggcggatcctccgccttcgtcgtcaagttcggcgacgacgagttcgggcacatgttggtgaacctcctgaagcagaacaacgtgaacgcggaggggtggctgttcgacaagcacgcgcggacggcgctggccttcgtgaccctcaagaacgacggggagcgcgagttcatgttctacagggaacccgagcgcggacatgctgctgaacggagggggagctttgacctgcggcctgggggggtggcgccatgggtgttcccagtaaggggtccattttcgtttattcttccgaacccgtgcccgctccgggggcaaattggg

SEQ ID NO: 22754 - protein, 169 aa, Zea mays
  misc_feature: Ceres CLONE 1392714-F
  misc_feature: SWISSPROT Homolog: EC 2.7.1.4 Fructokinase
MAPLGDGGAAAAATSNNLVVSFGEMLIDFVPDVAGLSLAESGGFVKAPGDAPANVVCAIAKFGGSSAFVVKFGDDEFGHMLVNLLKQNNVNAEGWLFDKHARTALAFVTLKNDGEREFMFYREPERGHAAERRGSFDLRPGGVAPWVFPVRGPFSFILPNPCPLRGQIG

SEQ ID NO: 22755 - DNA, 724 bp, Zea mays
  misc_feature: Ceres CLONE 1392717-F
  misc_feature: Encodes the peptide sequence at SEQ ID NO. 22756
  misc_feature (463)..(463): n is a, c, t, g, unknown, or other
  misc_feature (466)..(466): n is a, c, t, g, unknown, or other
  misc_feature (469)..(469): n is a, c, t, g, unknown, or other
  misc_feature (565)..(565): n is a, c, t, g, unknown, or other
  misc_feature (589)..(589): n is a, c, t, g, unknown, or other
  misc_feature (677)..(677): n is a, c, t, g, unknown, or other
  misc_feature (683)..(683): n is a, c, t, g, unknown, or other
tccccgcggtggcggccgctctagaactagtggatcccccgggctgcaggaattcgcacgagaccattacctagaacatcctaatcgaaaagtggattgtactgttctcagtggattaatagaattggacgctggagatagacccgccggagaagatggcctgcccactgctcacagtagtctagtccctgcccaccaagtacggatctcatctcaccagctgcctgtgcagcagtccaattcctcttgctggagcataccagaagcagaatcgggtgagaggaaatgggatcaacaagaacgtctcatccatctttcccggtcctcctgctcttcctcctcgctaccgccgccgccgccggaagcaacaaggctgaggaggtggacgacctccagtaccttattgacaactccgaagacatcccacccaacgaccctgacggtgcccctggaggggcggcgncgncgncgactacgacgacgaccttctcttccaagatcaggaccaggacctcccagactacgagccgcagatcgacgagacccacgtcgtggtcctcaccgncgccaacttctcctccttcctcgncgccacccgccatgtcatggttgagttctacgccccctggtgtggccactgccgcgagctcgcccctgatacgccgccggcggcgggnatctcnggcgtcaccacaccagaccgatctcgctctttgcaaggcga

SEQ ID NO: 22756 - protein, 39 aa, Zea mays
  misc_feature: Ceres CLONE 1392717-F
  misc_feature (1)..(31): SWISSPROT Homolog: EC 5.3.4.1 Protein disulfide-isomerase
  misc_feature (2)..(17): SWISSPROT Homolog: EC 2.4.1.119 Dolichyl-diphosphooligosaccharide--protein glycotransferase
MVEFYAPWCGHCRELAPDTPPAAGISGVTTPDRSRSLQG

SEQ ID NO: 22757 - DNA, 773 bp, Zea mays
  misc_feature: Ceres CLONE 1392718-F
  misc_feature: Encodes the peptide sequence at SEQ ID NO. 22758
aagctggagctccccgcggtggcggccgctcttttccagtggatcccccgggctgcaggaattcgcacgagaccattacctagaacatcctaatcgaaaaaaccttcttttcctatccgtcaccagcttcaatttgtacacatcaccctacggcggaagggagaggcatgcaaatgaactgcgcctccaccgatccggaaaagaagaagattgaggagcgttgcctgctcgactagtatgcctacttaatcgtgctggacagcacaaacaacgcagcggccgctgaccctgtgctagcggagaaggttgtcaaggcgcgcgtagaggtcggcgactacgtcgactgcgttctcaccacacatcagcactgacatctcgctgttgctgatgacaacatgacgctgcagttgccaggcataaacgtattaggtagcatccctggacaagagaaaagcttgactggaccaggggacaaaggaatgaagttgtcacctggggaaggaattgggtaaactatggctaaaaaaccccttggcccctaaagggccttattccgctactatgttactatgaagggaggtttaaaaaccccgggttttccccggcaaaaaccttggtcctttgaggaaagggaaaaattttttggagggttcccaaaatgaaattttaaaaaccctttttatttaaaacgggggttcccggcccaaaggcacccccaaggtttgtggggggggggggcgcccccgtggagaaaaaccaaaaaatattgtggg

SEQ ID NO: 22758 - protein, 38 aa, Zea mays
  misc_feature: Ceres CLONE 1392718-F
MTLQLPGINVLGSIPGQEKSLTGPGDKGMKLSPGEGIG

SEQ ID NO: 22759 - DNA, 726 bp, Zea mays
  misc_feature: Ceres CLONE 1392722-F
  misc_feature (382)..(382): n is a, c, t, g, unknown, or other
tcaccgcggtggcggccgctctataactagtggatcccccgggctgcaggaattcgcacgagaccattacctagaacatcctaatcgaaaaaaaacgcagcgacctcgccccccctgccccgctcctccccttttcccggtagcagagacggagcaccgcagcccgccagaaaggaagacgaaacgcgccgcggcgcaacgcaccgcgtgctagtgaaagggcgcagcggaaggccgccgccgcgctgctatttagacaggaagcggggcgatcgaatcgcgtctctcaaccaatcgataaatctgccggtaggtcgatcaaggagagcgcggtccacgtctccgttccgttccgttgcggggaaggaaggaaggagagagnagagcgatggcgtccgggtaccgcgcggaggaggagtacgactacctgttcaggtggtgctgatcggggacagcggcgtggggaaagtcgacctgctgtccgcggtccgcagggacgagttcaagctcgagaacagggccaccatcgggggcaagttcgccccaagaacgtcaaggtcgacaccaactcgcaaggaacaaatctgggaccccgccgggaggaaaggaacggggcatcccgagggatataaacggggcggggtggccccttgttggttaaaaagtgagccccccacccactttgaaaaggggaggggtgggggggaagtggggacccccggggcc

SEQ ID NO: 22760 - DNA, 865 bp, Zea mays
  misc_feature: Ceres CLONE 1392723-F
  misc_feature: Encodes the peptide sequence at SEQ ID NO. 22761
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (27)..(27): n is a, c, t, g, unknown, or other
  misc_feature (29)..(29): n is a, c, t, g, unknown, or other
  misc_feature (278)..(278): n is a, c, t, g, unknown, or other
ccctccccccnnnnnnnnnnnnctttntnattctctttttagggcccgggcccaagctggagctccccgcggtggcggccgctctataatagtggatcccccgggctgcaggaattcgcacgagaccattacctagaacatcctaatcaaaaaagatatcgcatcgccgtcgcgtcgtcgtcgatctccccgccccgccccgcccgcgccgcggaatctgacacatctccctaatctctcctaggaccgggtgcccttacatccacgccgcaacgcanatcgccgtccgaagccctcgcggtctctcgtctccccgtgcgagaggacgccggcagcagcggcgtgccagtgcgggggcttgttgggggaaagaccggagggcggcggcagagctcgccgcccagaggtgcacgggaaggccttgtttctcggccgtcggcttgggggcaagggcgagtagccccccgggaaagggaggaggggaaataatcattggagcttcgaatctcgcccttttcggcgggaagcccacccaccgtgggtggggagggcggaaatggccaccagtcggaaaagtctggagaagcgaatgaacccccccttcgggtgctgctcccctcgggtacacaatcctgtgacaaagagtcactacaccaggtcagatattggccgcggggccacgggggaagagggcactcgtgcgggcgggcacggtttctgctggcccgcggcggcctgaacctccggcccggccaaacaacaaggaggtcccgagtgtttgttgattgtggaatcaccacgtagaagacgggaactaacgattgcccagatcagcacgtccaccaccactctccaccgccccccg

SEQ ID NO: 22761 - protein, 60 aa, Zea mays
  misc_feature: Ceres CLONE 1392723-F
MATSRKSLEKRMNPPFGCCSPRVHNPVTKSHYTRSDIGRGATGEEGTRAGGHGFCWPAAA

SEQ ID NO: 22762 - DNA, 669 bp, Zea mays
  misc_feature: Ceres CLONE 1392725-F
  misc_feature: Encodes the peptide sequence at SEQ ID NO. 22763
aaagctggagctccccgcggtggcggccgctctagaactagtggatcccccgggctgcaggaattcgcacgagaccattacctagaacatcctaatcgaaaaagatttggatgtggactagatgcttaaggtgtgaacgtgaaagtggggtccccagatcatcacgaagggtgataatgtcagctgaagcacactacctttcatttgggaagttccttgaacttagtttttcaagccactcaaccgctagaaggctgccaatatgcgggcattcactcaatacggattgtctgcgctttttttgggttgggctccaaagttgcaatgttccagtattcctcagtcgaaatttacaatgcctgcaaaccacagcctactcttgagattcacaaccccgatatgcacaaagatgccccaaggttgctgccctcgtgtttcgtgctctgattggtgagtcttcaatgagagctgattccagttatatagagggtgaacaagctttgattatttcttttgttaattggggcaacatatagaagggaacaagcttattaaaggaaatccttgtacaatcaagaggtcatacaatagaatgaacgatattgtgattctctcaagggtggcttcatgagcaagaaacattcaccttggtcctaaaattcagactgg

SEQ ID NO: 22763 - protein, 90 aa, Zea mays; identical to SEQ ID NO: 11994
  misc_feature: Ceres CLONE 1392725-F

SEQ ID NO: 22764 - DNA, 732 bp, Zea mays
  misc_feature: Ceres CLONE 1392728-F
  misc_feature: Translation starting site: 265
  misc_feature (555)..(555): n is a, c, t, g, unknown, or other
aagctggagctccccgcggtggcggccgctctataactagtggatcccccgggctgcaggaattcgcacgagaccattacctagaacatcctaatcgaaaaactgtctccgcttccgctcccgactcctttgtctcgtcctcatccatccaaccaggcgagccaacaagcaagcaaaagtaaacggggcgaggagctggagagacgccggcgacgcgaagcaaccgcccgatcggagccgcggctgagcaggagggagccggagatggtgggtctcgtcggcggcagcacggcgcgggcggagcacgtcgtcgccaacgccggaggggaggcagagtacgtgcgccgcatgcaccgccacgcgccgaccgagcaccagtgcacctccaccctcgtcaagcacatcaaggcgcccgtccacctcgtgtgggagctggtgcggaggttaaccagccgcagcggtacaagccgttcgtcaaggaactgcgtcgtgcgcggggaaccagttcgaggtcggaagcctgcgcgacggtcacgtcaaagaccgtcctgccgngaacgaccaagaccgaacggcttcagcaggtcgacgacaacccggcacatacttcgggggcaagttccgtcggggggaaccaaccgccctccagaactaactcatcccattaaaaactggccccccccaaaaaaatttggcgggagggcccggccccccccggggggatcaaaatcg

SEQ ID NO: 22765 - DNA, 680 bp, Zea mays
  misc_feature: Ceres CLONE 1392730-F
  misc_feature: Encodes the peptide sequence at SEQ ID NO. 22766
  misc_feature (362)..(362): n is a, c, t, g, unknown, or other
  misc_feature (420)..(420): n is a, c, t, g, unknown, or other
  misc_feature (463)..(463): n is a, c, t, g, unknown, or other
cgctcttaactagtggatcccccgggctgcaggaattcgcacgagaccattacctagaacatcctaatcgaaaaaaccgcatcatcctttccctcgcgccgccgccaacgcaacccttgcagccccaatccctcacagcaaccatggctggcgcgcaggagtccctctctctggtgggcacgatgcgcggccacaacggcgaggtgacggcgatcgcgaccccgatcgacaactcgccgttcatcgtctcctcctcccgcgacaagtccctgctggtgtgggacctgaccaacccggtccactccaccccggaatccggcgccaccgccgactacggcgtccccttccccgcgcctcacggncactcccactttcgtcaggacgtcgtcctcagttcccgacggcagttcgccctttccnggctctgagatggagagctccgcctctgggacctctccacggnctcacacccggcgtttcgtcggcacgagaggatggcctcccgttgccttccccgtggaaaccgcaaattgttcccgggcccgggaaaaacattaaattttggaacccccgggggggggaaaccccccggggggggccccgggggggggaggacccaaagggggggccctgggggggttcccccaaaatttttccccccttttttcccttttgggaac

SEQ ID NO: 22766 - protein, 94 aa, Zea mays
  misc_feature: Ceres CLONE 1392730-F
  misc_feature (8)..(47): Pfam Name: WD40 Pfam Description: WD domain, G-beta repeat
  misc_feature (93)..(93): Xaa is any aa, unknown, or other
MAGAQESLSLVGTMRGHNGEVTAIATPIDNSPFIVSSSRDKSLLVWDLTNPVHSTPESGATADYGVPFPAPHGHSHFRQDVVLSSRRQFALSXL

SEQ ID NO: 22767 - DNA, 654 bp, Zea mays
  misc_feature: Ceres CLONE 1392731-F
  misc_feature: Encodes the peptide sequence at SEQ ID NO. 22768
  misc_feature (169)..(169): n is a, c, t, g, unknown, or other
  misc_feature (307)..(307): n is a, c, t, g, unknown, or other
  misc_feature (315)..(315): n is a, c, t, g, unknown, or other
  misc_feature (368)..(368): n is a, c, t, g, unknown, or other
  misc_feature (373)..(373): n is a, c, t, g, unknown, or other
tccccgcggtggcggccgctctagaactagtggatcccccgggctgcaggaattcgcacgagaccattacctagaacatcctaatcaaaaaacaacgcacatgcggaagcggagacgctgacgcacctctgagcctggcggcgatttttctatataaccagcgccgctnattccgggtgcttcgctgtagagatgcggtaaaagcgaaagaagaatccgatccgcttctccacgccgaacccggtaaggccgccgccgcttctcgaatgggctcaacctcctcctcctcgcctcagccggccgcggnggcggcgncagcgtcgcccggggcagcttcctcgccccgagatcgccgcgcaggtggaggncgcgncgccccgcccccggtcccgccctatgtcaggcggccggcgggtccctgggccgcgtcatggaggcgtgctgcctggcagcgatcgacgtcgtcaagacgggggtgcaggtcgaccggacgggggcctaccggggaatcgcgcactggggcgcccccgggccccgggccagagggcgtggccgccctttgggaaggcgcccctgccctttggacaaggacttaagggtcaagaacccggtggggttcggatcaagcgccggggtgcgatcgccgcacacaga

SEQ ID NO: 22768 - protein, 74 aa, Zea mays
  misc_feature: Ceres CLONE 1392731-F
MEACCLAAIDVVKTGVQVDRTGAYRGIAHWGAPGPRARGRGRPLGRRPCPLDKDLRVKNPVGFGSSAGVRSPHT

SEQ ID NO: 22769 - DNA, 638 bp, Zea mays
  misc_feature: Ceres CLONE 1392732-F
  misc_feature: Encodes the peptide sequence at SEQ ID NO. 22770
  misc_feature (440)..(440): n is a, c, t, g, unknown, or other
  misc_feature (509)..(509): n is a, c, t, g, unknown, or other
tccccgcggtggcggccgctctagaactagtggatcccccgggctgcaggaattcgcacgagaccattacctagaacatcctaatccaaaaatatcccatcctgatctctcctcccttcttcagtgcagcagcaggccagcagcacgccacccgccccactcctgcctccgatccgctgcttactcgccacccggagatggccaccgccgccgccttctccgtctcctcgccggcggcctccgccgtcgccgcgcgatccaaggtgtttgggaggaggagtaaccaggcgagaactagaactggctgccgcgtcggcatcacgcggaagaactttggccgtgtcatgatggcccttgcagtggatgtttctcgtttttgaaggagtggccatggctcctcagaccaaattcttgggggttctgaggcctttaagcagatnaaagcgagtgacgctcatccttggtgttgtgcctataggacagagagctgcagcctacgtgctcatgtnatccagaagctgaaaatctatgttggagaaagagaaacaagagatctccccatgaggtttagccgggttaacaaagcacagagagttatggttgaggtgatacccggtataaaacaggggtggtggcaa

SEQ ID NO: 22770 - protein, 60 aa, Zea mays
  misc_feature: Ceres CLONE 1392732-F
MATAAAFSVSSPAASAVAARSKVFGRRSNQARTRTGCRVGITRKNFGRVMMALAVDVSRF

SEQ ID NO: 22771 - DNA, 699 bp, Zea mays
  misc_feature: Ceres CLONE 1392734-F
  misc_feature: Encodes the peptide sequence at SEQ ID NO. 22772
  misc_feature (336)..(336): n is a, c, t, g, unknown, or other
  misc_feature (339)..(339): n is a, c, t, g, unknown, or other
  misc_feature (384)..(384): n is a, c, t, g, unknown, or other
  misc_feature (418)..(418): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
tggagctccccgcggtggcggccgctctagaactagtggatcccccgggctgcaggaattcgcacgagaccattacctagaacatcctaatcgaaaaatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtaacagccacggccggggcggaggacggagtggtcgaacgggaccgcaaggaggacctgcgntgntgcaagcaggcgtgcgagtggcagtacggaaaggacaccccgcgnaaagagggaatgcgagagcgagtgccgcgagcgncaccagcaagctgacgcgggcgaggaacgcgacagcggcgtggacggctacgtctcccgctccggaggggcgagtgcccggcgcagtgcctgcgccgccacgagggcccagccgtgggagaacccagagtgcatgaggcggtgccgccgccgcggactggccgtcgacatggagcaagagtacggtcgcggagagcgagcgacggnnnnnnnnnnnnnnnnnnnnnnnnnnnnnnnnnnnnnnnnnnnnnnnnnnnnnnnnnnnnnnnnnnnnnnnnnnnn

SEQ ID NO: 22772 - protein, 74 aa, Zea mays
  misc_feature: Ceres CLONE 1392734-F
  misc_feature (44)..(44): Xaa is any aa, unknown, or other
  misc_feature (71)..(71): Xaa is any aa, unknown, or other
MGKGSVGASWWAFLLLAGVLLVVTATAGAEDGVVERDRKEDLRXCKQACEWQYGKDTPRKEGMRERVPRAXPAS

SEQ ID NO: 22773 - DNA, 680 bp, Zea mays
  misc_feature: Ceres CLONE 1392735-F
  misc_feature: Translation starting site: 188
  misc_feature (407)..(407): n is a, c, t, g, unknown, or other
  misc_feature (607)..(607): n is a, c, t, g, unknown, or other
tggagctccccgcggtggcggccgctctagaactagtggatcccccgggctgcaggaattcgcacgagaccattacctagaacatcctaatcgaaaactctgtctctctagggtttttgattttagccgccgccgctgctcatctcacatccctcgagaagacgcctgctactcgccgatcgatacgatggccgtcttctccgacctccacaccgccgacggcctcaagtccctcgaggctcacctcgccggcaaaacctatgtgtctggtgacgccattagtaaggatgacattaaggtcttcgccgcggtgccgtcgaagcctggcgctgagtttcctaatgccgcccgctggtacgagaccgtctctgcggctgtagcctcaagattccctggtaaggctgttnggtgtaatctgccctgcggatcagctcctggcgcagctgctcctgcggatgaggctgaggatgatgatgaccttgatcttttttgtgatgaaactgaggaggacaagaaggcagctgatgagcgtgccgccgctgccaaggcctcttctaaaaagaaggaagtggtaaatcctccgtccttatggatgtcaaaccatggnacgatgaaactgatatgaaaagctggaggaagctggccgcagggtccaaatgaaggtctgacttggggagcac

SEQ ID NO: 22774 - DNA, 777 bp, Zea mays
  misc_feature: Ceres CLONE 1392738-F
  misc_feature (47)..(47): n is a, c, t, g, unknown, or other
ttgaagcccaacccacccccctacgccgcccccctcctttgtgggtncttttttttcaaagctggcgctccccgcggtggcggccgctctagaactagtggatcccccgggctgcaggaattcgcacgagaccattacctagaacatcctaatcgaaaaaaggcccaactccactcatcgccactgcgccggaaacccaaagcggggaggaggagcggaaaagaaaaggaaaatgggaggagcggaagcaagtccgagcaagtcagaggatccgccggcctatctccgcctataagatgccgtcccaccccccaccttcctagcagctgctctccaccaagagctgctggcaccaccaaaccaatcgctggatttgtccagagtatttccggtttcaccgccctagatctgacccgagacgccgcgtcttcgctgagatggggattactgtgaggcggtccgacgatggtgcgcccgggggcggaagaccgccgcggcggcgggtgggggaactcccacctccaaccgtggggggagccgaggtttccaaacggcccaggggtctacctttcctaccgccacgcacggcccccggtgccggttaggccggaagagacctctctccaaagtgcaagaggggagaaataagcggcgacggaccggacggcgtgttcagggggcgtttcctctcccacggggcgtgcgctcgccccctccccgcgactccaatgtctgcctccccggcccgcactccccctccctgcgcctgtcgtcccc

SEQ ID NO: 22775 - DNA, 668 bp, Zea mays
  misc_feature: Ceres CLONE 1392741-F
  misc_feature: Encodes the peptide sequence at SEQ ID NO. 22776
tggagctccccgcggtggcggccgctctagaactagtggatcccccgggctgcaggaattcgcacgagaccattacctagaacatcctaatcgaaaaagcagtactgcctccactgcagtcccagctcagagctctcagcggtggcggccggcgaccggcgacatcctccggtatcgactcccgtggagtggagcgttgaaccacgctgcggacctgcattcaccagtccgccgtttccttcgccttcgccttctccgcgtgatccggttgctctggccactgatggccggtgacattacatgcggatccttgctgcaaaaattgcagttgatatgggatgaagttggcgagagtgatgaggatcgtgacagggtcctttatcagctggatcaggaatgccttgatgtttacaagaggaaagttgacaagcaactaactctagggatctcctgatccaggctctggatggactcaagatagaacttgctaggctttctttctggtcttggagaaaaagttatttgcagaacccctgagaagacaacaggaacaatcaaggagcagctagttggtatagcgccaacacttgagcagctgactaaccagaaagatgaagcaacaccgagtttgttaaggacacatcacaattgatcaataatggggggag

SEQ ID NO: 22776 - protein, 56 aa, Zea mays
  misc_feature: Ceres CLONE 1392741-F
MAGDITCGSLLQKLQLIWDEVGESDEDRDRVLYQLDQECLDVYKRKVDKQLTLGIS

SEQ ID NO: 22777 - DNA, 674 bp, Zea mays
  misc_feature: Ceres CLONE 1392742-F
  misc_feature: Encodes the peptide sequence at SEQ ID NO. 22778
  misc_feature (326)..(326): n is a, c, t, g, unknown, or other
  misc_feature (355)..(355): n is a, c, t, g, unknown, or other
  misc_feature (399)..(399): n is a, c, t, g, unknown, or other
  misc_feature (437)..(437): n is a, c, t, g, unknown, or other
  misc_feature (519)..(519): n is a, c, t, g, unknown, or other
  misc_feature (562)..(562): n is a, c, t, g, unknown, or other
tccccgcggtggcggccgctctagaactagtggatcccccgggctgcaggaattcgcacgagaccattacctagaacatcctaatcgaaaaacagatatatatgccgtgaccaaaccgtcgcttccatttttcgcccgccgcccccagtcccgatccgaagctgtgcctcgtaccatttcgatccaatggcgccgacgtcgaagctgtcgacgggcatcaagcgcgcttcgcggtcgcacgcgtaccatcgccgtgggctgtgggccatcagggccaagaacggcggcgccttccccaaggccgacaaggccgccgccgccgtggnacccaagttctaccctgccgacgacgtcnagcccccgcgttcccagcacccgcaagcctaagcctaccaagcntcaggtcgaggaatcaaaacacgaggcagtatcctcantctcatggggtttgcaaacaccaacttcatcagtgtactcagctaatggaatttatgggtatgatgggagctatggacccgncctttggtatggatcgcacatgtataattctggattatatggngggatggaattcactgtatgatggaaagtacagaaccagaggaagagggtacagtgggtattatgtttatggtaatggaaacatagatggctttaatgagctgaaagagggc

SEQ ID NO: 22778 - protein, 66 aa, Zea mays
  misc_feature: Ceres CLONE 1392742-F
  misc_feature (1)..(49): Pfam Name: Ribosomal_L6e_N Pfam Description: Ribosomal protein L6, N-terminal domain
  misc_feature (47)..(47): Xaa is any aa, unknown, or other
  misc_feature (57)..(57): Xaa is any aa, unknown, or other
MAPTSKLSTGIKRASRSHAYHRRGLWAIRAKNGGAFPKADKAAAAVXPKFYPADDVXPPRSQHPQA

SEQ ID NO: 22779 - DNA, 695 bp, Zea mays
  misc_feature: Ceres CLONE 1392743-F
  misc_feature: Encodes the peptide sequence at SEQ ID NO. 22780
  misc_feature (216)..(216): n is a, c, t, g, unknown, or other
  misc_feature (416)..(416): n is a, c, t, g, unknown, or other
  misc_feature (445)..(445): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
aagctggagctccccgcggtggcggccgctctagaactagtggatcccccgggctgcaggaattcgcacgagaccattacctagaacatcctaatcgaaaaacctctcactaccaccaccactgccccggatccataccagctgcagcagcagcgcgcgcgagctagcttcggtcggtcgatagatcgatcgatcgctcggccatcatggcgcggnaggagcaggcgctgctgtcgacggagatcgggaaaccgcggcgtggagccgtcgggcccggacgccggctcggcggccttctcggggggggggggccgccgcctggcggacttcctggagtcggtggacctcaagtacgtgggcctcgggtaccactacctcatcaggcacggggtggacctggccaccatccccgtcantcgggctggtgtgcggcgccgaagctggncagcctcagccgcgacgagctgtggcgccaaggtggggnnnnaggccacctacgacctcggcaccgtggtcgccttttctcgccggccctcgctttacccattccggtttaaataatgtccagggcccaggcccgggtacccccatcgatttcggagggtaaaagccggccggagaaggctaaggggggccaggggggaggtcaatcgaccgggggcggaaagtccggcaagttccaaaagggaccaccc

SEQ ID NO: 22780 - protein, 45 aa, Zea mays
  misc_feature: Ceres CLONE 1392743-F
MSRAQARVPPSISEGKSRPEKAKGGQGGGQSTGGGKSGKFQKGPP

SEQ ID NO: 22781 - DNA, 638 bp, Zea mays
  misc_feature: Ceres CLONE 1392744-F
  misc_feature (328)..(328): n is a, c, t, g, unknown, or other
ggagctccccgcggtggcggccgctctagaactagtggatcccccgggctgcaggaattcgcacgagaccattacctagaacatcctaatcgaaaagacgacacacctgacacgtgggtctatcagtcatcctggtccttttattttctttcttctctcacccggttcttcctcctcccgagtcccgaactctcgatccactcatccgctgagggcgtcggccttctggcccttctccccccggccgacctcgcccctccggcgctccgtccgcttcctgaactcgtctccctcacggacgttctcctccctccgctcgccgcgccgnaaacccggagaggagaccgccgctcggtcgagcaccacctggggcccagcgtcctcgcgaccagctcttagcgcggcgtccgccctctgcaagcctggggcccccgggactggctctcggcgggacacaactccccggttagggctcccgctgcacaggggcggggatcttcttctttccttccggcgtttgcaggtcctctcagccgcctctacgggtggttgattggggccccaccgccaaactacccgggctatggaagatggcattacgaacccactgggctggtgatttgaatgctgtagagcgg

SEQ ID NO: 22782 - DNA, 633 bp, Zea mays
  misc_feature: Ceres CLONE 1392745-F
  misc_feature: Encodes the peptide sequence at SEQ ID NO. 22783
  misc_feature (337)..(337): n is a, c, t, g, unknown, or other
aagctggagctccccgcggtggcggccgctctagaactagtggatcccccgggctgcaggaattcgcacgagaccattacctagaacatcctaatcgaaaaagtttcagaccccgtgtggattagtcgctgtcacgatcgaggcggggcgccaattgcggtggccaccacctccaatccactccccgcggtggcctcgccgagctgttcttgctccgtcctccctccaactccaagatttgtttcgcacccgattcctgagcttccgcggcgcttcttgctgaaagaaagctccgagttcttcagttctggatcgatagagaggcggttcctttgcnggctctgaggttcagctctcgctcttgatttgtctcatcgacgcatcagttgggctgcaggcttagagctggaaggaataatttgactagagaaatggggcagtgttgtagcagagctcccgcccccgactctggacggggaggcaccaatggttatggctattctaaccaggcaaagcccgggaaaacaccttccagtacaaccctcctccgcagccgggcgaagggaggaccccccccccggcaacaaccctccggtagccccacctgggcctgtgcctgggccccgaagccca

SEQ ID NO: 22783 - protein, 67 aa, Zea mays
  misc_feature: Ceres CLONE 1392745-F
  misc_feature: SWISSPROT Homolog: EC 2.7.11.1 Non-specific serine/threonine protein kinase
MGQCCSRAPAPDSGRGGTNGYGYSNQAKPGKTPSSTTLLRSRAKGGPPPRQQPSGSPTWACAWAPKP

SEQ ID NO: 22784 - DNA, 571 bp, Zea mays
  misc_feature: Ceres CLONE 1392747-F
  misc_feature (227)..(227): n is a, c, t, g, unknown, or other
  misc_feature (291)..(291): n is a, c, t, g, unknown, or other
  misc_feature (293)..(293): n is a, c, t, g, unknown, or other
  misc_feature (294)..(294): n is a, c, t, g, unknown, or other
  misc_feature (299)..(299): n is a, c, t, g, unknown, or other
  misc_feature (300)..(300): n is a, c, t, g, unknown, or other
ggagctccccgcggtggcggccgctctagaactagtggatcccccgggctgcaggaattcgcacgagaccattacctagaacatcctaatcgaaaaacatcgatcagtcgcgtgtctaggtttcctctctcaccatagcgcccgctctgtcgcccttcgttcacctctccttcctctcctccctgcctggccagggagaaggggaagtcagaaaggcacggagtggncgcaaaagcaggacgcacggtgaaacccttttggaaagcttgtcccctgggccgtccgtccggncnntcccnncaaagggaattccccccccaaagggagagggggtgggggggaaaaaaaaaaaaaacacccccccccccccctttccttttaaaaaaaaaaaaaatttggggccccccttcggaaaaaacccccctccagggggggaccgggggggaaaaccccccgggggggggggggggggggcttttatttgcttttaaaaaaaaaaaaggggggggggggcccccattaattaaaacacaaaaaaaggggggggtgggtcccccctttttttttcttg

SEQ ID NO: 22785 - DNA, 805 bp, Zea mays
  misc_feature: Ceres CLONE 1392753-F
gaacaaacgagcgggggccccttaactatttaaggagggagccctcggaggtaagctgtagctccccgcggtgggggccgctctagaatagtggatccaccgggctgcagggattcgcacgagaccattacctagaacatcctaatcgaagactacatgccaaatctggaggcaagagaaccgggagagggcgtgttgggttgctcgtcgtgatcccggacggcaatacctgcccttgcctacttgccactgcttgcgtacactgatgtccttgttcaatcccctctagaaagcagaaacattgcttaattggcttggctattgctgttacctccacacaaaagagagaaccggcggcgagttaagaactagccatggacggacacgggcggggtctcccggtggaaggtggttaagccggctcgggcggttgggctggcccctggggttcggcggccccagggggccgaagcgggccctgggggggcgggcccggccggggacaacccgaggcggcggggggtcctcttggggcctggtagggtcctccccgctccccggccccctctggtggtgcgtgtccctcccccagggcggagcgacctgcccctacatcgagacgcgctgccccgcgcggcccccccacccccccgccgcccgccccgccccccagttccctctcgcctcccgccgggcgcctccttctctctcatttagacgcgtgacaattcttcacctgaaaccaacgcgcccctttctataacgaaagaagagccgtatcacgccctacgtgacggcaagaacc

SEQ ID NO: 22786 - DNA, 473 bp, Zea mays
  misc_feature: Ceres CLONE 1392754-F
  misc_feature: Encodes the peptide sequence at SEQ ID NO. 22787
  misc_feature (223)..(223): n is a, c, t, g, unknown, or other
gctctgaatagtggtcccccgggctgcaggaattcgacgagaccattacctagaaatcctaatcaaaaaagaacaacagggctcctcgcaataattcgtgcatccatggcgaagctcgtcaacaagctggtcgattcattcgaccacgacgaggcgccggcgccggacgtcggctgcgtgcgcgccgtgctggacgagctcgtcctcaccctttcctcttcgntcttcaccgggcgtccccccgccctccatggggcccgcccgggggtccccggcgggggaaaagcccccggggggggaggggtttattggccccgaatggggcgaaaccccttgggcgggcgggttggggttttatgggcgcaacggggtttgggccccgcttgggggcgtcccctgggggggggacccgccccccgtctttttttttcacagggggttttcccggggggggggcaccccccctttccaaa

SEQ ID NO: 22787 - protein, 122 aa, Zea mays
  misc_feature: Ceres CLONE 1392754-F
  misc_feature (40)..(40): Xaa is any aa, unknown, or other
MAKLVNKLVDSFDHDEAPAPDVGCVRAVLDELVLTLSSSXFTGRPPALHGARPGVPGGGKAPGGGGVYWPRMGRNPLGGRVGVLWAQRGLGPAWGRPLGGGPAPRLFFSQGVFPGGGHPPFP

SEQ ID NO: 22788 - DNA, 640 bp, Zea mays
  misc_feature: Ceres CLONE 1392756-F
  misc_feature: Encodes the peptide sequence at SEQ ID NO. 22789
  misc_feature (233)..(233): n is a, c, t, g, unknown, or other
  misc_feature (339)..(339): n is a, c, t, g, unknown, or other
  misc_feature (429)..(429): n is a, c, t, g, unknown, or other
  misc_feature (477)..(477): n is a, c, t, g, unknown, or other
  misc_feature (484)..(484): n is a, c, t, g, unknown, or other
  misc_feature (485)..(485): n is a, c, t, g, unknown, or other
  misc_feature (490)..(490): n is a, c, t, g, unknown, or other
  misc_feature (495)..(495): n is a, c, t, g, unknown, or other
  misc_feature (503)..(503): n is a, c, t, g, unknown, or other
tggagctccccgcggtggcggccgctctagaactagtggatcccccgggctgcaggaattcgcacgagaccattacctagaacatcctaatcgaaaaatccgtccattccaatccccctcttccgctccgcctccctctagctcctctccctctcgcagccatcctcgtccccccaagaatccggacgtcgtttgtcccctccttttctgggcgtttacatctttaagctcanagagaaagtattatgaagatggcgcacttgatcactaattgcagctttcagacattctcgagttctcctaattactgccgcaatattgggcaactacagaactcanaatcttcaaatctgtccctcaaatcttgttccagggagacaaagaagtcatatgttacctgtgctagcgctgcccgtacaggacagacancaacacctcttactggtagccagcaagcttatgagcattcatcctcancactaannaggtnatggntattgggnggagatgataacctggggggtgggcaacagcacttcatctctcaaacaaggggtatgagggtggcgattgttgatatccttggccgccgtgttttgataaacaactcgggcctggattcccttacccccataactcc

SEQ ID NO: 22789 - protein, 131 aa, Zea mays
  misc_feature: Ceres CLONE 1392756-F
  misc_feature (32)..(32): Xaa is any aa, unknown, or other
  misc_feature (62)..(62): Xaa is any aa, unknown, or other
  misc_feature (78)..(78): Xaa is any aa, unknown, or other
  misc_feature (80)..(80): Xaa is any aa, unknown, or other
  misc_feature (82)..(82): Xaa is any aa, unknown, or other
  misc_feature (84)..(84): Xaa is any aa, unknown, or other
MKMAHLITNCSFQTFSSSPNYCRNIGQLQNSXSSNLSLKSCSRETKKSYVTCASAARTGQTXTPLTGSQQAYEHSSSXLXRXWXLGGDDNLGGGQQHFISQTRGMRVAIVDILGRRVLINNSGLDSLTPIT

SEQ ID NO: 22790 - DNA, 690 bp, Zea mays
  misc_feature: Ceres CLONE 1392757-F
  misc_feature (270)..(270): n is a, c, t, g, unknown, or other
aaagctggagctccccgcggtggcggccgctctagaactagtggatcccccgggctgcaggaattcgcacgagaccattacctagaacatcctaatcgaaaaaccaacagccaatccacacctcgcttgcgttgtcctcgccgcggcctcgccctgattcggttcccccgttcctcgcctctgtcatcgtctcctctgacccaaattgagccaagcgaagccgtggccgtgatccggtccatgcgcggagcgtggtagccggattctatncgcgtcgcctcccctttcgcgctattttccagtcgccgggatcagccgagttggatctcgaggcataaagcgttgcgggcgcccggcgaggataccatgcctgcggtgctcgccgcattcgctaccctccgagccgccgctggcatcgcctccggggactcctcctttccctgttcccatcggctcaaggatcgttttaggaataaaaattttagtagtaagaattggcattaaccctttgggttccctccggtcgggaaggttcctcggattgggcctaacctttcgcattttcggttttggtcagaatgatgttcgaacaacaagataatttttgtgttcagtcgactctaccaccaagcataacgagcgtgcccgcccacatccacctatataatcaagaacacccactccctcttc

SEQ ID NO: 22791 - DNA, 645 bp, Zea mays
  misc_feature: Ceres CLONE 1392758-F
  misc_feature: Encodes the peptide sequence at SEQ ID NO. 22792
  misc_feature (467)..(467): n is a, c, t, g, unknown, or other
tccccgcggtggcggccgctctagaactagtggatcccccgggctgcaggaattcgcacgagaccattacctagaacatcctaatcgaaaaagggtggcgaaggcggagctgacctgaccggctgacccgcccaacccaacaacctctccgctggccatcttcctcccgggatccctctccctccttcgatccagctcagctctcttcctcccgccccgtacggccgtactcttcttgatccgttcactcatacttctcgagagaaaaggaagaggattcgatctgttgctaccgctagctgcggtactagcagcagcagcagcagcaggaggaggtaccgtagaagaagggaagggaatccatgaagagatggggcagcagcggacaggccgccgattccttctaccaggtccgccccgattgcagccaaaacgtccccaacaccaagttcaagatcaagggcggngaagacactgagcgttaggaaatggcatgctgcgttcacgcgtgatggatgcctggatatcgcctctgttctgagcgaaaaagaggagggggggtgtgcacccacgaccaggggggagaggggtttggggagagtctggctccggctggcttggacctggggagcaccttccgatgag

SEQ ID NO: 22792 - protein, 40 aa, Zea mays
  misc_feature: Ceres CLONE 1392758-F
MKRWGSSGQAADSFYQVRPDCSQNVPNTKFKIKGGEDTER

SEQ ID NO: 22793 - DNA, 721 bp, Zea mays
  misc_feature: Ceres CLONE 1392759-F
aaagctggagctccccgcggtggcggccgctctagaactagtggatcccccgggctgcaggaattcgcacgagaccattacctagaacatcctaatcgaaaaacctcgcgtggcctcccgttctgacttcggagtccctcggtctcaacgactagttgagagctcgcggctccgttcgggcgaggggaggaggttcatgaggctgctgtaggctccgttgcagccgccgcgggcgggagtccgtgattttggacgccccacggtggcaagatccggaagcgcggttgttgttgtgccgtgagttctagtttggccgtcctatcctctcccccttgcttcacaataccaaccggcactatttacctcctcccaccaccggcgcgggtggcctcttttcattatcatttgttctcccactgtacactttgctgtgtgttggtcgccatcaattccgtgcgggccgcttttttttcttttgtatttcgccgtcttgactatggggctggggggcccccgcggattgtgagattgaaatatattctaggcttgcccctctctaccacaccacctttgtatagggcgctctccacataagtagtcgctagcattgagcaggcgccaggaagatgaaagaaaatagatcattagccgaatagccaccacacatctatgtcggatgtggcaaatgagtagcttcccatgagagggacgtgatttggcg

SEQ ID NO: 22794 - DNA, 780 bp, Zea mays
  misc_feature: Ceres CLONE 1392763-F
  misc_feature: Encodes the peptide sequence at SEQ ID NO. 22795
  misc_feature (5)..(5): n is a, c, t, g, unknown, or other
  misc_feature (44)..(44): n is a, c, t, g, unknown, or other
  misc_feature (268)..(268): n is a, c, t, g, unknown, or other
ttttnttaattttcccccccaacccaaacaaaaaatataaacanaaaacccgccgtctcaaagctggggctccccgcggtggcggccgctctagaatagtggatcccccgggctgcaggaattcgcacgagaccattacctagaacatcctaatcaaaaaccgcacacacatacacaagcacaagcacaagcactctagcaatggcttctgaggttgtccgccctagcgacgccgagctactgcaggcacaagccgacatatggcggntcagcctctcctacctcacgcccctgtcactgaggtgcgccggggtgcttggcatccctaaggcgatctacccgccatggcggggcttgcctcagccgctgagctgatcacgggggttggccttctccccttcccgttaaactaaccgggttccctcccgcccgccctggtgggggggttcccaaaaccgcggtcgggggggggttccccccgccaacaggggcaaaaaaccccgggggggcaggaaaaaggttaccccgtattataagccccccgggtttcccaaaacctcccgggggggggaaaagggccctcccccctccccggggggcgccccctgggaaacccccccccctctttttcgggggggcacacctggggaaacctcgacccgggggtaaaataagaaacaggcggataaaaaggggcttgtggcccaagtgggggtctcggagaaaaagaagccccggcacacatcccacccgggctgggggaggggtttccagggggtg

SEQ ID NO: 22795 - protein, 57 aa, Zea mays
  misc_feature: Ceres CLONE 1392763-F
  misc_feature: SWISSPROT Homolog: EC 2.1.1.146 (Iso)eugenol O-methyltransferase
  misc_feature (23)..(23): Xaa is any aa, unknown, or other
MASEVVRPSDAELLQAQADIWRXSLSYLTPLSLRCAGVLGIPKAIYPPWRGLPQPLS

SEQ ID NO: 22796 - DNA, 676 bp, Zea mays
  misc_feature: Ceres CLONE 1392765-F
  misc_feature: Encodes the peptide sequence at SEQ ID NO. 22797
  misc_feature (275)..(275): n is a, c, t, g, unknown, or other
  misc_feature (366)..(366): n is a, c, t, g, unknown, or other
aaagctggagctccccgcggtggcggccgctctagaactagtggatcccccgggctgcaggaattcgcacgagaccattacctaaacatcctaatcgaaaaaccaacccttgtagtctcagtcaatctgtagattgagactacgatgagcctgtcaccgctcgactcctcctccccgccggccgcggctgcggctgctgctacggaggtgcccctcgccccgggcttccgcttccaccccaccgacgaggagctcgtctcctactacctccgccngcgcgtcctcggccgccgcctccgcgtcgacgccatcgccgagatcgacctctaccgcctcgagccctgggacctcccctccctctcccgnatccgcagccgcgacgcccagtggtacttcttcgcccgtctcgaccgcaagggtcgcggcgctggcgccgggggcccgggcggtccccggcacaggaacaaccgcgctacggcgaagggggtactggaaagaccacgggcaaggaaccgcgaggtgcaccaccgcggaaagcccgtcggaaatgaaaaaaaccctccgtcttcccggcgggaaggccgcctaaaggccgaaaaggaccaactggtgtcttgaacaaactaccgccctcctcgatggaaaacgacctccaggatcgggttgggggtttgaa

SEQ ID NO: 22797 - protein, 157 aa, Zea mays
  misc_feature: Ceres CLONE 1392765-F
  misc_feature (24)..(140): Pfam Name: NAM Pfam Description: No apical meristem (NAM) protein
  misc_feature (44)..(44): Xaa is any aa, unknown, or other
MSLSPLDSSSPPAAAAAAATEVPLAPGFRFHPTDEELVSYYLRXRVLGRRLRVDAIAEIDLYRLEPWDLPSLSRIRSRDAQWYFFARLDRKGRGAGAGGPGGPRHRNNRATAKGVLERPRARNREVHHRGKPVGNEKNPPSSRREGRLKAEKDQLVS

SEQ ID NO: 22798 - DNA, 726 bp, Zea mays
  misc_feature: Ceres CLONE 1392766-F
  misc_feature: Encodes the peptide sequence at SEQ ID NO. 22799
  misc_feature (609)..(609): n is a, c, t, g, unknown, or other
tccccgcggtggcggccgctctagaactagtggatcccccgggctgcaggaattcgcacgagaccattacctagaacatcctaatcgaaaaaaaagcaaattgacaccttctccgttcccgacgactcccgtgagcgtggagcggcgactaggcgaggccatggcctccggcatcggctccggccagcagcaacccccagcgccggcggcagatgctgacccgggagccgtcggcgacaagctcgtcttcgaagcgccgcctcagcccgtgagggaggactacgtccagaacgccgtcaagtttctctcccaccccaaggtcaggggctcccccgtcgtctacaggcgatccttcctcgagaagaagggccttagcaccgaggagatcgacgaggccttccgaagggttcctgatcctcaacccagcactacggctaccacttctccgcagcagcaggtcaacagccagaatcaatccgtcggggtgcaagcttatgcgccagcacaacctgtgcacccagcaaacgctggccctgtcgtccttccaacgcagcccaggtttagctggtaccaagcattcctggctgcagggctcttgcttggttttgntgctagcgctgctgtctttatcaagaaactgtccttcctaaggctcagtctggaatcccgcatggtgtagcagaaggtattggcactgaaggcacccgcttaagcctagggatgatg

SEQ ID NO: 22799 - protein, 172 aa, Zea mays
  misc_feature: Ceres CLONE 1392766-F
  misc_feature (37)..(131): Pfam Name: Pex14_N Pfam Description: Peroxisomal membrane anchor protein (Pex14p) conserved region
  misc_feature (150)..(150): Xaa is any aa, unknown, or other
MASGIGSGQQQPPAPAADADPGAVGDKLVFEAPPQPVREDYVQNAVKFLSHPKVRGSPVVYRRSFLEKKGLSTEEIDEAFRRVPDPQPSTTATTSPQQQVNSQNQSVGVQAYAPAQPVHPANAGPVVLPTQPRFSWYQAFLAAGLLLGFXASAAVFIKKLSFLRLSLESRMV

SEQ ID NO: 22800 - DNA, 686 bp, Zea mays
  misc_feature: Ceres CLONE 1392768-F
  misc_feature: Encodes the peptide sequence at SEQ ID NO. 22801
  misc_feature (299)..(299): n is a, c, t, g, unknown, or other
  misc_feature (470)..(470): n is a, c, t, g, unknown, or other
  misc_feature (507)..(507): n is a, c, t, g, unknown, or other
  misc_feature (508)..(508): n is a, c, t, g, unknown, or other
tccccgcggtggcggccgctctataactagtggatcccccgggctgcaggaattcgcacgagaccattacctagaacatcctaatcgaaaacacttcccgtgtttctaactccggtggctccaccaccagcaacccgtgcagcgagcccaccccgaccactgccatgtcgaggcgcggcgactgggtctacgagaacaacggcgggacctgcgtggccatcgccggcgccgattactgtgtcgtcgcggcggacacccgcctctctgtcggatacagcatcctcacgcgcgaccactcntagatctgcgacctggctgacaaatgtgtactagcatcttctggcttttcaggtgatattagggctctgcacaagaacctagctgccagagaattgctataccaacaccagcttaacaaaaggatgagctgccctgccatggcacagctcctctcccataccctgtactancagcgcttcttccccatatacgctttcatgtgctcgnntggcttgacagcgaggggaaaggtgtgtttccactatgatggcataggtcctaacaaaagactggtaatagggtccagggacttgatcactttgattatgccggcctggaacatcactaaatccccaagtctctattggtcctgcaagaatggttgccaccattggcggagcaaaggc

SEQ ID NO: 22801 - protein, 45 aa, Zea mays
  misc_feature: Ceres CLONE 1392768-F
  misc_feature: SWISSPROT Homolog: EC 3.4.25.1 Proteasome endopeptidase complex
MSRRGDWVYENNGGTCVAIAGADYCVVAADTRLSVGYSILTRDHS

SEQ ID NO: 22802 - DNA, 709 bp, Zea mays
  misc_feature: Ceres CLONE 1392769-F
  misc_feature: Encodes the peptide sequence at SEQ ID NO. 22803
  misc_feature (499)..(499): n is a, c, t, g, unknown, or other
tccccgcggtggcggccgctctagaactagtggatcccccgggctgcaggaattcgcacgagaccattacctagaacatcctaatcgaaaaatctataaataggacctagacgatcaatcgcaatcgcatatccactattctctaggaagcaagggaatcacatcgccatggcagccaagatgtttgcattgtttgcgctcctagctctttgtgcaaccgccactagtgctacccatatcccagggcacttgtcaccactactgatgccattggctaccatgaacccatggatgcagtactgcatgaagcaacagggggttgccaacttgctagcgtgcccgaccctgatgctgcagcaactggttggcctcaccgcttcagccgtgccagatgccaatgatgatgccaggaatgaatgccacccgatgacaatggatgcccgatgccgatatgaatgcttcgaatgatgttgccgactatgatgccccacataacgtnggtaagtaggttgccaccgaggagattgccacctgggttcccacatggatatggccaagaatgatgcctccaacgataacccgaaatttgtgcccccgttatggttgccaggtatgaccccccatagatgacccaaactgtgggccttcatggaaatggccaaaatggtggacggcgcccaagtgtatctcagttcccctcccgcattta

SEQ ID NO: 22803 - protein, 99 aa, Zea mays
  misc_feature: Ceres CLONE 1392769-F
MAAKMFALFALLALCATATSATHIPGHLSPLLMPLATMNPWMQYCMKQQGVANLLACPTLMLQQLVGLTASAVPDANDDARNECHPMTMDARCRYECFE

SEQ ID NO: 22804 - DNA, 728 bp, Zea mays
  misc_feature: Ceres CLONE 1392770-F
  misc_feature: Encodes the peptide sequence at SEQ ID NO. 22805
  misc_feature (400)..(400): n is a, c, t, g, unknown, or other
aagctggagctccccgcggtggcggccgctctataactagtggatcccccgggctgcaggaattcgcacgagaccattacctagaacatcctaatcgaaaagattaccaccacctccacctcgtcgtctcccaccaccgccgagcgcgagccctagcccgatctagccggcggcaggcaccagatcccgccgcccgcggcgtcccgggacgcgccccgccgaatccgccgctcctcgcactgcaacacgcccggaccacggtgcatttgatccgtcccggccgcctacacgatgtccaagtcgggagcgctggatcttgcttctgggctcggagggagatcaacaaggtggaagtcaagtcggccgccgatgagtatgagaaatatcatgaatactatgnagggaaggaggaaagcagggacgcccaactatactgatatgggttataaaatactatggatctgccactagcttcttatgagtatggttggggggaatcttttcccctttgctcccaggagggaatggaaaatccttacgggaaagcatcaagcgacatgagcatttttccttgccctgcaacttggtttgaaaccaggaatgaggtttttgaatggggggttggggaaaagggggaccccttgaaaaaaatgggagaatttagtcccatttccgttcccgggttggataaaccccaaatcccctatacccgggggaaagggggctcc

SEQ ID NO: 22805 - protein, 144 aa, Zea mays
  misc_feature: Ceres CLONE 1392770-F
  misc_feature (133)..(133): Xaa is any aa, unknown, or other
AGAPRGGGRSITSGSPGLQEFARDHYLEHPNRKDYHHLHLVVSHHRRARALARSSRRQAPDPAARGVPGRAPPNPPLLALQHARTTVHLIRPGRLHDVQVGSAGSCFWARREINKVEVKSAADEYEKYHEYYXGKEESRDAQLY

SEQ ID NO: 22806 - DNA, 898 bp, Zea mays
  misc_feature: Ceres CLONE 1392773-F
  misc_feature: Encodes the peptide sequence at SEQ ID NO. 22807
  misc_feature (898)..(898): n is a, c, t, g, unknown, or other
ggggctccccccccccccccccctcgccctccgcctgtcctccccccccccgcccaagctggagctccgcggcgggggggggccgctctattattagggggatcccccgggcctgcaggaattcgcaccagaccattacctagaacgtcctaatcgaacaaacctctggacgatcaccatcgccgctagcctccaccaccaacttcccatcgcctccccctcatctccccacactcctgacctcacctctccgaactgcagcacctccccctcccggcaccacacgtgctctcatggccgccaccgcgatctcaggccgcctccacccaaccggcgcgcgcagtgtggccctccgcccgccgcgcccgccctcgggggccgtgcgcgcgcagtcccgcgcccggggacggggggggggggcgcttgaaccagggacgaccgccaggcgtggaggagggggggcgcgaccccccgtcgaacaatccgaaaaaacagggaaggtgcgcctggcgctcctgaaccgggtctcccgcggatccgcctttcggacggggcatcctaggatccgggcccggcctcccgtggaccgccgggcccaaagcctcgagaaaagatacccccgggggacggggcccccaatgtcaggggtggcgacccttgcgaaggggagagggaggggacgatgtccgggtcacgccccgcgcgtcacccccggcccgcgtgaccggcgcatcgcggtgggggaggcgcgccttcgattacccatgcgggaggggccgcacgcggaggcgtcgccccccgcgaaccccccagcacccgctgcgaggacaaaggcggtcggggtgtcgacggtctctcctcactctccgcttgcggatacccccgcactgtaccacan

SEQ ID NO: 22807 - protein, 201 aa, Zea mays
  misc_feature: Ceres CLONE 1392773-F
MAATAISGRLHPTGARSVALRPPRPPSGAVRAQSRARGRGGGALEPGTTARRGGGGARPPVEQSEKTGKVRLALLNRVSRGSAFRTGHPRIRARPPVDRRAQSLEKRYPRGTGPPMSGVATLAKGRGRGRCPGHAPRVTPGPRDRRIAVGEARLRLPMREGPHAEASPPANPPAPAARTKAVGVSTVSPHSPLADTPALYH

SEQ ID NO: 22808 - DNA, 738 bp, Zea mays
  misc_feature: Ceres CLONE 1392777-F
  misc_feature: Translation starting site: 209
  misc_feature (337)..(337): n is a, c, t, g, unknown, or other
  misc_feature (353)..(353): n is a, c, t, g, unknown, or other
  misc_feature (354)..(354): n is a, c, t, g, unknown, or other
  misc_feature (454)..(454): n is a, c, t, g, unknown, or other
  misc_feature (455)..(455): n is a, c, t, g, unknown, or other
  misc_feature (461)..(461): n is a, c, t, g, unknown, or other
  misc_feature (465)..(465): n is a, c, t, g, unknown, or other
tccccgcggtggcggccgctctataactagtggatcccccgggctgcaggaattcgcacgagaccattacctagaacatcctaatcgaaaactaatcgagcatcgcagagataggcgtcttcgtactcgcctacctccgcggctcaaacctttcccccttctcccaattccctccgtcggccgccgctccatcccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattggnggaggtgatgatgctnntcacacccttctcagtgagactggtgctgggaagcacgtgccccgtgctggtttttggtgaccttgaacccactgtcatcgatgaggtgaggactggaannctacgncagntcttccaccctgagcagctcatcagtgggaaaggaggatgcagccaacaactttgccggggtcccctacacattgggaaaggaaatggtgacctatgccctgaacccatcaagaaagtttgccgaaaaatggcgggtccccaagggtttccccgttttaaaagttgttgggggagaaagggccctgggcttgggtcccccccccaaaaggcctgtgtgtgggaaacggcaaaaacccaaggtgggggtcacggggcccccctcccccccagtt

SEQ ID NO: 22809 - DNA, 735 bp, Zea mays
  misc_feature: Ceres CLONE 1392778-F
  misc_feature: Encodes the peptide sequence at SEQ ID NO. 22810
  misc_feature (403)..(403): n is a, c, t, g, unknown, or other
  misc_feature (489)..(489): n is a, c, t, g, unknown, or other
  misc_feature (536)..(536): n is a, c, t, g, unknown, or other
  misc_feature (641)..(641): n is a, c, t, g, unknown, or other
aagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcnagagcgagtgccgcgagcggcaccagcaagctgacgcgggcgaggacggcgacagcggcgtggacgcctacgtctcccgctccggnagggggcgagtgccggcgccagtgcctgcgccgccacgaggggcagncgtgggagacccaggagtgcatggaggcgtgccgccgccgcggactggccgtcgacatggagcaagagtacgggcgcggcagcgagagcgcgggcagtgcccggnagaggtgcgagcgccaccacgcggggactggtgggaagaggcagcgctgcctgatggatgaaaaaaacccggacgggaaggagaaggccgccac

SEQ ID NO: 22810 - protein, 162 aa, Zea mays
  misc_feature: Ceres CLONE 1392778-F
  misc_feature (64)..(64): Xaa is any aa, unknown, or other
  misc_feature (108)..(108): Xaa is any aa, unknown, or other
  misc_feature (143)..(143): Xaa is any aa, unknown, or other
MGKGSVGASWWAFLLLAGVLLVVAATAGAEDGVVERDRKEDLRWCKQACEWQYGKDTPRKRECXSECRERHQQADAGEDGDSGVDAYVSRSGRGRVPAPVPAPPRGAXVGDPGVHGGVPPPRTGRRHGARVRARQRERGQCPXEVRAPPRGDWWEEAALPDG

SEQ ID NO: 22811 - DNA, 735 bp, Zea mays
  misc_feature: Ceres CLONE 1392784-F
  misc_feature: Encodes the peptide sequence at SEQ ID NO. 22812
  misc_feature (349)..(349): n is a, c, t, g, unknown, or other
  misc_feature (377)..(377): n is a, c, t, g, unknown, or other
  misc_feature (402)..(402): n is a, c, t, g, unknown, or other
  misc_feature (443)..(443): n is a, c, t, g, unknown, or other
  misc_feature (462)..(462): n is a, c, t, g, unknown, or other
  misc_feature (496)..(496): n is a, c, t, g, unknown, or other
  misc_feature (563)..(563): n is a, c, t, g, unknown, or other
  misc_feature (579)..(579): n is a, c, t, g, unknown, or other
  misc_feature (595)..(595): n is a, c, t, g, unknown, or other
  misc_feature (661)..(661): n is a, c, t, g, unknown, or other
tcaccgcggtggcggccgctctagaactagtggatcccccgggctgcaggaattcgcacgagaccattacctagaacatcctaatcgaaaaatcgcaaatcctcgctcgggcaagaagagccaactgaaaagtattcatccaagaacaccaccccacccgctccaagcacaagtttcgtcttgaagagagccgccaccaccaatggcttgttacaacactgcatctttagcggcgactctgctggcgttcgcgctgacgtttcaggcctgcctcgccgggaggaggctcaccgcgctggtgcaggagccggccataaccatgaggtaccacaagggcgcgctcctgtcnggccccatcgccgtcaacttcatctggntacgcgacttctcggcgccgcagcnggcggcgatcaccgacttcgtctcgtcgctgaacggcggcngccccccggccgcgcgcanccggagccgtccgtggccacgtggttcaagacgncgcgcaagtactacgccagctcccaaggtggccgtcccgggggttggggctcgggttccagggcgtnaacggaactgcttccntcggagggccctgaangaaagggacctggctcaggtccgccgcagggaaggccagagcgcggcaattaacttgtggtcaggncccccaaaggggccgggaacagttttttgaaaccccggggggaaacaaaggggtttccccgggtccctttcggg

SEQ ID NO: 22812 - protein, 162 aa, Zea mays
  misc_feature: Ceres CLONE 1392784-F
  misc_feature (59)..(59): Xaa is any aa, unknown, or other
  misc_feature (67)..(67): Xaa is any aa, unknown, or other
  misc_feature (81)..(81): Xaa is any aa, unknown, or other
  misc_feature (87)..(87): Xaa is any aa, unknown, or other
  misc_feature (121)..(121): Xaa is any aa, unknown, or other
  misc_feature (126)..(126): Xaa is any aa, unknown, or other
  misc_feature (131)..(131): Xaa is any aa, unknown, or other
MACYNTASLAATLLAFALTFQACLAGRRLTALVQEPAITMRYHKGALLSGPIAVNFIWXRDFSAPQXAAITDFVSSLNGGXPPAARXRSRPWPRGSRRRASTTPAPKVAVPGVGARVPGRXRNCFXRRALXERDLAQVRRREGQSAAINLWSGPPKGPGTVF

SEQ ID NO: 22813 - DNA, 710 bp, Zea mays
  misc_feature: Ceres CLONE 1392785-F
  misc_feature: Encodes the peptide sequence at SEQ ID NO. 22814
  misc_feature (462)..(462): n is a, c, t, g, unknown, or other
tccccgcggtggcggccgctctagtactagtggatcccccgggctgcaggaattcgcacgagaccattacctagaacatcctaatcgaaaaacaagcagcaacgccaacgccaacccaaccctaacccgatctcaccgaggacacacagacaccagaccaccggagcggaccaagtacgagcatgggcggcgccgcggaggaggcgttgcggcgggagtacgtggtcggcgaggagatcgggcgcggccggttcgggacggtccgccgctgctacgccgccgccacgggggagccgttcgcgctcaagacgacgcccaaggcggcgctgcgggcggacccgctggacctggcgctggcggagcaggagcccaaggtgcaccacctggcgtctgccgccagccggcacgtggtcgcgctgcacgccgccttcgtggacgccgacgccgtgcacctggtgctgnacctgtgcgcgggcggggacctgttcgcgctcgtctccggcgggggcgcgctcccggaccccgaggggggcggagttccaggggggaatttcgccgaggcgttcgccgggttgccaccgccgggggggtccggcaccccggacggttaagcccgaaaaacctccttttttaaaaccccccgccgggggggggtctaaggttcgggggaattccggccccccccgctggtttcgggaaccgcaagcccc

SEQ ID NO: 22814 - protein, 142 aa, Zea mays
  misc_feature: Ceres CLONE 1392785-F
  misc_feature: SWISSPROT Homolog: EC 2.7.11.1 Non-specific serine/threonine protein kinase
  misc_feature (94)..(94): Xaa is any aa, unknown, or other
MGGAAEEALRREYVVGEEIGRGRFGTVRRCYAAATGEPFALKTTPKAALRADPLDLALAEQEPKVHHLASAASRHVVALHAAFVDADAVHLVLXLCAGGDLFALVSGGGALPDPEGGGVPGGNFAEAFAGLPPPGGSGTPDG

SEQ ID NO: 22815 - DNA, 720 bp, Zea mays
  misc_feature: Ceres CLONE 1392786-F
  misc_feature (531)..(531): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
tccccgcggtggcggccgctctataactagtggatcccccgggctgcaggaattcgcacgagaccattacctagaacatcctaatcgaaaaacaaaccaagttggctgaagtgcaaggtcagcctctacgtcgacaattagaatcctacgtagatttttccgcatttgataacgaagcagccgaggggttacagtctgcgttggatcacatggaattgcctgaaacaatcaggcggaggatccaagcagccatgcctcttcttccaccatcccgggacccttctttgcaatgtcgacctccgcagttgtcgttggctgcattaacaccactccggagcagcacatctggtgtaggtccgcaacagagaagatgttctgcgagctgcgtgtccactaacgtctcaggcagaagcaaggcggcgttgccttcgcatgatcctgacatggaggtagatccatgtaatctgctcgaagatggcacaagctgcctctcacagcatctgctagccatggcgcgagtggactgacgantgaccatgctaatctgaaagcgtgcatctggcttaagggtgctgtgaaggtgacgaggacagcactgacctacattggctctttagacgatgacgcctgacgtgtgtatgattagcnnnnnnnnnnnnnnnnnnnnnnnnnnnnnnnnnnnnnnnnnnnnnnnnnnnnnnnnnnnnnnnnnnnnnnnnn

SEQ ID NO: 22816 - DNA, 735 bp, Zea mays
  misc_feature: Ceres CLONE 1392787-F
  misc_feature: Translation starting site: 209
  misc_feature: SWISSPROT Homolog: EC 2.7.8.23 Carboxyvinyl-carboxyphosphonate phosphorylmutase
  misc_feature (370)..(370): n is a, c, t, g, unknown, or other
aaactggagctcaccgcggtggcggccgctctatactagtggatcccccgggctgcaggaattcgcacgagaccattacctagaacatcctaatcgaaaaaccgtagcacacaccagtacaccacacactcgcctttccgatcccatccctctccagccaccttcctccgctcgccgtgcttctgcttcctccgccaccaccgccggcatggctgcgcgctgcccctacttcgccgtcgaggagtcctcccgcggcatccgctcgggggagtccccggccgcggcgctccgccggatcctcgcgacgcctggtgcgcaccaggcgccctgctgctacgacgcgctcggcgcgcgcctcgtcgagcgcgcngggtttccgatcgggttcatgggcggtttctgtgtttctgccgcgcgacttggcttgcctgatgttgccctcatttcctatggagaaatggtagatcaagggcgtctcatcaatgaagctgtttcaatcccagtgattggtgatggagacaatggttaacggaaactctatgaatatcaagagaaccataaaaggatatatcaatgctgggttttgctggaattatggcttgaggaatcaggtggcccctaaagcagggggaactactggaaggaaggaaaagcttatcaggtaagaaagctgccctgcacaaaaaagctgctgaaaatgcaagaaaaaagaggggcttcgaaattggtaattgg

SEQ ID NO: 22817 - DNA, 705 bp, Zea mays
  misc_feature: Ceres CLONE 1392790-F
  misc_feature: Translation starting site: 290
  misc_feature (610)..(610): n is a, c, t, g, unknown, or other
  misc_feature (654)..(654): n is a, c, t, g, unknown, or other
tccccgcggtggcggccgctctattatagtggatcccccgggctgcaggaattcgcacgagaccattacctagaacatcctaatccaaaaacggtaaaggcacaacgaataagagagatcaactactcatgcaagcactgcggtatttaatttaggttcttaggaacaaaaacaccaagcaccaactttgtacatattaatggacgccatgcacatggtgatcgatcggtctatatagaaagacaggcgagtactagagaggttgtgtggtgtccaagctacacacgggatgctactaactagctgcaggcaagggcgaggaatgacaagcctttcatgtgctcgggcggacggtgttgtccgttccggcgctctgcccgccaagctggtgctgtgcgccagctgctgcttccctacggcggctccagtcgcggacggagaggtgcaggtgcttgcctgccgccagcatctccaccgcttgccgaggcgtcaggatctccgtcgccagcgcccgcgccgtcgccatcctcagctcgtcggcctccaccagcagccgcgacagcgcggccttgtagctgtccagcgccgcgtccacctcggcgtccgcggntcctagccgagccgccctgagtcgccgctgcgccgcgccgtcgnagcttccgctgacagagctgcagctcccatccgtgccgcggaagcgagctc

SEQ ID NO: 22818 - DNA, 709 bp, Zea mays
  misc_feature: Ceres CLONE 1392792-F
  misc_feature (362)..(362): n is a, c, t, g, unknown, or other
  misc_feature (457)..(457): n is a, c, t, g, unknown, or other
  misc_feature (469)..(469): n is a, c, t, g, unknown, or other
  misc_feature (648)..(648): n is a, c, t, g, unknown, or other
  misc_feature (664)..(664): n is a, c, t, g, unknown, or other
aagctggagctccccgcggtggcggccgctctagaactagtggatcccccgggctgcaggaattcgcacgagaccattacctagaacatcctaatcgaaaacctcccgcccgatacatttctcgtacatcgctctcgctctcgctctctctcctgctgtccacgaccgaccaaaggcgccgggcacagactcttcgtcggatccaagagaagctcgcgccctccccgaccatggtctcggcggataccatccgtacggctatcggcgtcatcggcaatggcaccgcccttgtgctcttcctctccccggtgtaagaatttatcgattctgcttctgcttgttattttttatctacaaatcanaataataaaaaaaataataaaaactagtactacgcaatccagctttctccttataaagaaatcaatggataaatttaaaaaaagcagagcatcanaccaagaagaanaactgatgtcacgaacttgacagttgacttttcgcgcaaacaaacaaacaaacactacgtactgtgctctgcttatggatacatacatgcatactagtagctcatatatgcgtacaatgccgccccgcaggcccaccttcgtgggcatctggaagaagcgtgcggtggagcagtactcngcgatcccgtacgtgncgacgctgctgaactgcatgatggggggggctgtacgggcttgcc

SEQ ID NO: 22819 - DNA, 742 bp, Zea mays
  misc_feature: Ceres CLONE 1392793-F
  misc_feature (294)..(294): n is a, c, t, g, unknown, or other
  misc_feature (314)..(314): n is a, c, t, g, unknown, or other
  misc_feature (315)..(315): n is a, c, t, g, unknown, or other
  misc_feature (353)..(353): n is a, c, t, g, unknown, or other
aagctggagctccccgcggtggcggccgctctagaactagtggatcccccgggctgcaggaattcgcacgagaccattacctagaacatcctaatcgaaaactggtcctccattcaagctccactactccacacctagacttcccaatcctccattgggcaacctgtcacacagtacgccgtcgcctgtggtttggtttgtggagtgagagagaaagagagagagagacttagactcggactcggagagaaggagatgatgtcgagggagcgcaagaaggcggctgctcttcangagaagctgaagatcctcgnntcatcactcactcccacgttctgagcaacacgtcgatnatcatggacggcgtcgcgtacatcagggactgaaccaaaagggggtgaggctgaccaagaaattgcgtggcccaagacccccttaaacacagggatcttcctatccccgggaccggggaaccccaagaggcaggggcccccttccgggaaagggttccccaaaaaattcccgggtttccccccccgttgggagcctccaaaaggggggttaagggttcaagacaccggtgtgggaacatctttcccccgagggggggggaaaaaaaagggggaacccagggaaaaccccctgaaaaaacccccctctgggcccagaaaattttcccggggggaaaccccccccaccaggggaaaatttttttttttgggggggggggggcggaaccccc

SEQ ID NO: 22820 - DNA, 714 bp, Zea mays
  misc_feature: Ceres CLONE 1392796-F
  misc_feature: Translation starting site: 437
  misc_feature (564)..(564): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (590)..(590): n is a, c, t, g, unknown, or other
  misc_feature (591)..(591): n is a, c, t, g, unknown, or other
  misc_feature (593)..(593): n is a, c, t, g, unknown, or other
  misc_feature (595)..(595): n is a, c, t, g, unknown, or other
aagctggagctccccgcggtggcggccgctctagaactagtggatcccccgggctgcaggaattcgcacgagaccattacctagaacatcctaatcgaaaaatttgaacctccaagttcagaaactgaccccctcgtccctccccaccatcgcgatggctgacgacgccgcggcggcggcgttcgcgccctctccctcgccaccgtcacccgtagcgcaacctctgcccgacctctccccgccgccgcccttctccccaccagccggcacccctgcttccggggcgcagacgccgagcctcccggacaccccggcctccctagatccggacacccccttctccgacgccaccccgacccccgccgacgcctccgacgccgccctcgcttcggacgacggcatcaccaacccgtcggggggcaccgccggcaagcacatgacgctcgcgccgcccgccccgcccgccaagaaaccgtccaagaagaagggcggcaacagcgtctggacccgcccggcctcccgcaagggcaagaagaaggcgaggcagccggcgccgccaacagntttttccgcgggggnnnnnnnngggnngncngaggctccaccctaaggccaacgccggggggggaggagaaatccctcttcggtcccggaaaccgcctcgccgacgaaggaatccaaaaaacccgccggcaggctggggcccctctcccg

SEQ ID NO: 22821 - DNA, 743 bp, Zea mays
  misc_feature: Ceres CLONE 1392798-F
  misc_feature: Encodes the peptide sequence at SEQ ID NO. 22822
  misc_feature (330)..(330): n is a, c, t, g, unknown, or other
  misc_feature (370)..(370): n is a, c, t, g, unknown, or other
  misc_feature (392)..(392): n is a, c, t, g, unknown, or other
  misc_feature (393)..(393): n is a, c, t, g, unknown, or other
  misc_feature (504)..(504): n is a, c, t, g, unknown, or other
  misc_feature (743)..(743): n is a, c, t, g, unknown, or other
aagctggagctccccgcggtggcggccgctctagaatagtggatcccccgggctgcaggaattcgcacgagaccattacctagaacatcctaatcgaaaaaatatgtaacttcattcttgcaacatcacaagcacacaggctttcacacccatcttgcattggctctccggctgctgttcttgcttcctcgctgcacacaaccaagcaaagtcacttttccaaggtaaagaagcatgcatccgagctgctctccactggcagtgcctccgggcttccggttccacccgacagacgaggagctcctctactacaacctgaggaagaaggtngcctatgagcccatagatctggatgtcataagggaggtgnacctcaacaagcttgaacatgnnacctcaaagatcgtgcaggattgggacgccgaagcctcaggacaagtgtatttcttcagcaacaggaacaggaataccctacggggaccgcaaccaacgggccacgaacgntgggttccttgaaaggagaccgaacggacaaggccatcctcctccgaaaactttgaaagaaggtccgcctagagaaaaaccttgttttttaacttgggagggcaccccctggaaaaaaaaaacgattgggtttttgtgcaagaaaccccctcaaaaaataacaaacggcaagagggccccccatattaccggaaaaaccccccgcaacaaataaattataaatttttctactaaagaan

SEQ ID NO: 22822 - protein, 93 aa, Zea mays
  misc_feature: Ceres CLONE 1392798-F
  misc_feature (10)..(94): Pfam Name: NAM Pfam Description: No apical meristem (NAM) protein
  misc_feature (46)..(46): Xaa is any aa, unknown, or other
  misc_feature (53)..(53): Xaa is any aa, unknown, or other
MHPSCSPLAVPPGFRFHPTDEELLYYNLRKKVAYEPIDLDVIREVXLNKLEHXTSKIVQDWDAEASGQVYFFSNRNRNTLRGPQPTGHERWVP

SEQ ID NO: 22823 - DNA, 776 bp, Zea mays
  misc_feature: Ceres CLONE 1392801-F
  misc_feature: Encodes the peptide sequence at SEQ ID NO. 22824
gctctataactagtggatcccccgggctgcaggaattcgcacgagaccattacctagaacatcctaatcgaaaaaaaaatttcgtttttctcctctcagtctccgacgccgccggactcatccccccagaagaccaccctcctcctcctcccccacccacctcgccggaaccctagcgccgaccgcctgccgtgcccatcgacggcgatcgcattgctgcgccccgatggggacccgcgcctccaagaattgcctctgcgcgggcagctcttcgttcgatgaccccgatgtggtcgaggtgtctccgggaaccgccgcgcctgcagggtgggccctccgggccccacaagaggaaggggagccaggttggaaccgcaagaagggcccaacaaccgatgaagaaggtcccggatgggagccataactttttgggggaacacacgcccgggggggaaaaaaaaaaaaaccaaagtggcgggattggccccattgagcaccgccccaaaggcatggcccaaagacggggctgggggtttccagggccattccccgtggcccaccgacaaataatgcctttaaaaaaaaaccccagcctcccggggagtggacacccgaaaagccgcttcacagaaccagagacagtctcacaactattttccgaggggccccccccctttggggggagttagcaaaaaaactatggttatataaggaaaaaagaactcgcggggaggaggggctactcccccccccgccaggggggagtgggagccccc

SEQ ID NO: 22824 - protein, 65 aa, Zea mays
  misc_feature: Ceres CLONE 1392801-F
MGTRASKNCLCAGSSSFDDPDVVEVSPGTAAPAGWALRAPQEEGEPGWNRKKGPTTDEEGPGWEP

SEQ ID NO: 22825 - DNA, 744 bp, Zea mays
  misc_feature: Ceres CLONE 1392802-F
  misc_feature: Encodes the peptide sequence at SEQ ID NO. 22826
  misc_feature (391)..(391): n is a, c, t, g, unknown, or other
  misc_feature (409)..(409): n is a, c, t, g, unknown, or other
  misc_feature (430)..(430): n is a, c, t, g, unknown, or other
aagctggagctccccgcggtggcggccgctctagaatagtggatcccccgggctgcaggaattcgcacgagaccattacctagaacatcctaatcaaaaagagggggaggcagagagcttgccatcccaagcaaaggttccctctccttccccacctcgcgctcaacccccctcatcctcccacatccgattgtgccctgcgctctgccgttctcttatccaagatttcgccggcggcggctcagggagcggacaaagattgtttttttttcgggctatggagacgaggcctgattcattcagccccgggcggtggagtggcttcctgaccgggtctgattcgtattggttcaaagtgatctggcggcttacttggtgcagtcgcttccancgagaatcagagctaggnctgtgttttgtggccgactgntggattcgtcggcttggtactgtgagatcctggagggttctggttcagaacagggccccaggtctgcgaaaatccctcttcaatccggggcgaattagttagggttttgggttgagccgggcggaaaaatataaaaacaaatcctggcaagcttgcccaggaaacccgggaaaggttggaaaaaaaaaagaaacctcctgctgggggaaaaggaacagaacccccaaaattccaaaggggggggggggggggctttgggcccccgggaaaaaaagggggtggaaaaaagggcaaacaacccccgcccccctcgt

SEQ ID NO: 22826 - protein, 84 aa, Zea mays
  misc_feature: Ceres CLONE 1392802-F
  misc_feature (38)..(38): Xaa is any aa, unknown, or other
  misc_feature (51)..(51): Xaa is any aa, unknown, or other
METRPDSFSPGRWSGFLTGSDSYWFKVIWRLTWCSRFXRESELGLCFVADXWIRRLGTVRSWRVLVQNRAPGLRKSLFNPGRIS

SEQ ID NO: 22827 - DNA, 714 bp, Zea mays
  misc_feature: Ceres CLONE 1392803-F
  misc_feature: Encodes the peptide sequence at SEQ ID NO. 22828
  misc_feature (259)..(259): n is a, c, t, g, unknown, or other
  misc_feature (347)..(347): n is a, c, t, g, unknown, or other
  misc_feature (397)..(397): n is a, c, t, g, unknown, or other
aaagctggagctccccgcggtggcggccgctctagaactagtggatcccccgggctgcaggaattcgcacgagaccattacctagaacatcctaatcgaaaaatccctcctcctaactccaaactacccactggttcgactcgcgttcgcatcgcaagcagcagcgttccatcgaggcaatggcggtgatggccgaagtagtgtcgaccaccggcgcggcgctccggagcccggcctcgcagcagccggcggcggcggncgcggcgaagggcaccgacgctgagaagctccagttcatcgaggacatgacctccaacgtggacgccgtgcaggagcgcgtggctggnggagatcctcgcccgcaacgcggacaccgagtacctcgccggcaggtgcnggcctcgccggcgctacggaccgcgccaccttccgcgccaaggtgccgatggcgacgtacgaggacctgcagccgtacatccggcgcatcgccgacggcgaccgctcgcccatcctgtcggggcacccggtctccgagttcctcacagctccggacgtcggggggggagcggaagctcatgcccacatcgaggacgagctcaaccgcggcagctgcggtacagctcagatgccgtcatggactgtacgtgctgggatggacaagggaaactctccatttctgttcgcaaggcggaacagaaaccgggcggcctcggg

SEQ ID NO: 22828 - protein, 89 aa, Zea mays
  misc_feature: Ceres CLONE 1392803-F
MATYEDLQPYIRRIADGDRSPILSGHPVSEFLTAPDVGGGAEAHAHIEDELNRGSCGTAQMPSWTVRAGMDKGNSPFLFARRNRNRAAS

SEQ ID NO: 22829 - DNA, 706 bp, Zea mays
  misc_feature: Ceres CLONE 1392804-F
  misc_feature: Encodes the peptide sequence at SEQ ID NO. 22830
  misc_feature (277)..(277): n is a, c, t, g, unknown, or other
  misc_feature (489)..(489): n is a, c, t, g, unknown, or other
  misc_feature (507)..(507): n is a, c, t, g, unknown, or other
  misc_feature (583)..(583): n is a, c, t, g, unknown, or other
aagctggagctccccgcggtggcggccgctctagaactagtggatcccccgggctgcaggaattcgcacgagaccattacctagaacatcctaatcgaaaatcctgctcgccgccgggtctgggctgggtgacgctgcctcggatgaggccgcgctgaccggagccgtagccggaccacccgcccacccatggcgcgcccgcagcgcgtgtatgagtcttggaaagggaacaataaattcttctttggtgggaggctcatattcggacctgacgccnagtcactgatcctgtctgtttcgctcattgtggccccggtattggtcttctgcggattcgttgctcggcatcttcgtcaccacttcccggcttacaatgctggatatgcgattcctgcggtagctgtagtgtttatgatttatgtgctagtcctgctcttgatacatcagcgcaggttcctgggatcgttccccgcgcagcccacccgccgnaggatgagtttcttatgncaacgctttgtctgggggcacgcctgggaggctacatttccccgtggtaaggaagtactggttaatgggatgcctngtgaaagtgagtattgtgacacctgcatgatttatcggcctcctcgatgctcacactggtcatatgccacaattgggtagagcgcttggaccacattgcccctgggttggacaatgcatggcg

SEQ ID NO: 22830 - protein, 157 aa, Zea mays
  misc_feature: Ceres CLONE 1392804-F
  misc_feature (30)..(30): Xaa is any aa, unknown, or other
  misc_feature (106)..(106): Xaa is any aa, unknown, or other
  misc_feature (132)..(132): Xaa is any aa, unknown, or other
MARPQRVYESWKGNNKFFFGGRLIFGPDAXSLILSVSLIVAPVLVFCGFVARHLRHHFPAYNAGYAIPAVAVVFMIYVLVLLLIHQRRFLGSFPAQPTRRRMSFLXQRFVWGHAWEATFPRGKEVLVNGMPXESEYCDTCMIYRPPRCSHWSYATIG

SEQ ID NO: 22831 - DNA, 741 bp, Zea mays
  misc_feature: Ceres CLONE 1392805-F
  misc_feature: Encodes the peptide sequence at SEQ ID NO. 22832
  misc_feature (525)..(525): n is a, c, t, g, unknown, or other
  misc_feature (526)..(526): n is a, c, t, g, unknown, or other
  misc_feature (619)..(619): n is a, c, t, g, unknown, or other
  misc_feature (646)..(646): n is a, c, t, g, unknown, or other
  misc_feature (670)..(670): n is a, c, t, g, unknown, or other
  misc_feature (671)..(671): n is a, c, t, g, unknown, or other
  misc_feature (712)..(712): n is a, c, t, g, unknown, or other
  misc_feature (713)..(713): n is a, c, t, g, unknown, or other
aaagctggagctccccgcggtggcggccgctctagaactagtggatcccccgggctgcaggaattcgcacgagaccattacctagaacatcctaatcgaaaaaccaccacagcactaaaatctgttcatctctggctccccaaattcagctggagagcactttttcccatcatggataagaactacggtgaactctacaacatcctcggatggggtgaggagtacttcgcggtgaacacggaggggcacctcagcgtgaagcctttcggccgctggacggagcccgggcaggagatcgacgtgcactcggtcatcgtggaagctctagcgacccaacccaacgacagcaccagcaaatctcagttccccatgatccttcgcttccccgacgtgctcaagaaccgtatcgagacgctccataacgcattcaacagcgccatggagtccaccgggtacacgtccaggtaccaaggcgtggtccccgatcaggtgaacagaacaagcacgtcgtgcaggacatgggtnnaggtcgccagaaatggactatgggctcgaggctggctcccaggcagaactgctcatcggcatgagctgcctccccgtcaccgaagcgagcccnagccgtacttgatctgcacggctaacnaggacgcggactactcgcgtcggnnttctcggggggggccatggggctgaacccatatcgtgttcnnaaaaggaaggaagagcttggcatcgtcc

SEQ ID NO: 22832 - protein, 174 aa, Zea mays
  misc_feature: Ceres CLONE 1392805-F
  misc_feature: SWISSPROT Homolog: EC 4.1.1.19 Arginine decarboxylase
  misc_feature (119)..(119): Xaa is any aa, unknown, or other
  misc_feature (150)..(150): Xaa is any aa, unknown, or other
  misc_feature (159)..(159): Xaa is any aa, unknown, or other
  misc_feature (167)..(167): Xaa is any aa, unknown, or other
MDKNYGELYNILGWGEEYFAVNTEGHLSVKPFGRWTEPGQEIDVHSVIVEALATQPNDSTSKSQFPMILRFPDVLKNRIETLHNAFNSAMESTGYTSRYQGVVPDQVNRTSTSCRTWVXVARNGLWARGWLPGRTAHRHELPPRHRSEPXPYLICTANXDADYSRRXSRGGPWG

SEQ ID NO: 22833 - DNA, 752 bp, Zea mays
  misc_feature: Ceres CLONE 1392806-F
  misc_feature: Encodes the peptide sequence at SEQ ID NO. 22834
  misc_feature (215)..(215): n is a, c, t, g, unknown, or other
  misc_feature (420)..(420): n is a, c, t, g, unknown, or other
cagagctggagctccccgcggtggcggccgctctagaactagtggatcccccgggctgcaggaattcgcacgagaccattacctagaacatcctaatcgaaaagtcactcgcgtgtcaggcgcattctgcctctttctttctccccctcccctcccctcccctgcgggcttctctcacgagctcccccggcctcgccgccgccgcctgctccggngggcgggacccagctcgcagcgtctcccctgcggcgaggtacacgatggagggagcgggaagagatgccaaccctttgagcggttacagaattggcaaaaccctgggaattgggtcgttcggtaaagtgaagatcgcggaacatatattgactggtcataaaggtggcgatcaagattctcaattcggcaaggaaaaatcagaanaagccatttgggattatggaaagaaaaaaggttaagagagaattccagatactggagatatttatgcatcccccaaatcaaaacgcctttaggagggggaaaaaaaaccccgggtgaaaacccggggttaagggagaattggtaaaatccggggaaagtggtttttattacctccgttggagagagggaagggttacccgaaagagagaagcccgcacctttttttttagagaaacaaaatttggggggtgaaaaattgcccaaaaaaaaaatgggttcccccccgggggaattaaaacccaaaaaatcttctttttggggatcaaaaagga

SEQ ID NO: 22834 - protein, 64 aa, Zea mays
  misc_feature: Ceres CLONE 1392806-F
  misc_feature: SWISSPROT Homolog: EC 2.7.11.1 Non-specific serine/threonine protein kinase
  misc_feature (54)..(54): Xaa is any aa, unknown, or other
MEGAGRDANPLSGYRIGKTLGIGSFGKVKIAEHILTGHKGGDQDSQFGKEKSEXAIWDYGKKKG

SEQ ID NO: 22835 - DNA, 749 bp, Zea mays
  misc_feature: Ceres CLONE 1392807-F
  misc_feature: Encodes the peptide sequence at SEQ ID NO. 22836
  misc_feature (350)..(350): n is a, c, t, g, unknown, or other
  misc_feature (407)..(407): n is a, c, t, g, unknown, or other
  misc_feature (413)..(413): n is a, c, t, g, unknown, or other
  misc_feature (486)..(486): n is a, c, t, g, unknown, or other
  misc_feature (521)..(521): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (648)..(648): n is a, c, t, g, unknown, or other
acaagctggagctccccgcggtggcggccgctctagaactagtggatcccccgggctgcaggaattcgcacgagaccattacctagaacatcctaatcgaaaagcgattaatcaactccgccacgaccaacacgtacgtaaccagcggcggttcggcagcatgcggcgacgacggtgtccgctcctcgccgccgtcctcttcctcctccccctcttccaccgccaccacgccgccagcggcaccgacacggacacggtcacgctggccgcgccgctcatggggaaccggacgctggtgtccgccggcagcgccaagtacgtgctgggcttcttcgcgccggacccggacngcacgggatcaggacgggcgtacctcgggatatggttcaacgggatccccgcgcggnacgtcntggtgggtggcaaccgcgagagcccgtcctggggcagcgtgggcgccgccgcgctcaggttcctcgcaacggnagctgggcatcgtcgtcgtggacgaaccgattacnacacgacagnnncccgggggtttggggaaaccccccccccggcaattccgggggaagaaacgccccggggaattcggggaaaagggaaccctttggggggggtcccggggcccgggggtggttggtnaaattttaaacccccccgggaacccctcgggggggagaagaagggaaatcacccccccaggggggttgaccccttttttctttggggcgcccccgagaaac

SEQ ID NO: 22836 - protein, 196 aa, Zea mays
  misc_feature: Ceres CLONE 1392807-F
  misc_feature (64)..(64): Xaa is any aa, unknown, or other
  misc_feature (83)..(83): Xaa is any aa, unknown, or other
  misc_feature (85)..(85): Xaa is any aa, unknown, or other
  misc_feature (109)..(109): Xaa is any aa, unknown, or other
  misc_feature (121)..(121): Xaa is any aa, unknown, or other
  misc_feature (124)..(124): Xaa is any aa, unknown, or other
  misc_feature (125)..(125): Xaa is any aa, unknown, or other
  misc_feature (163)..(163): Xaa is any aa, unknown, or other
MRRRRCPLLAAVLFLLPLFHRHHAASGTDTDTVTLAAPLMGNRTLVSAGSAKYVLGFFAPDPDXTGSGRAYLGIWFNGIPARXVXVGGNRESPSWGSVGAAALRFLATXAGHRRRGRTDYXTTXXRGFGETPPPAIPGEETPRGIRGKGNPLGGVPGPGGGWXNFKPPREPLGGEKKGNHPPRGVDPFFLWGAPEK

SEQ ID NO: 22837 - DNA, 714 bp, Zea mays
  misc_feature: Ceres CLONE 1392808-F
  misc_feature: Encodes the peptide sequence at SEQ ID NO. 22838
  misc_feature (565)..(565): n is a, c, t, g, unknown, or other
  misc_feature (623)..(623): n is a, c, t, g, unknown, or other
caaagctggagctccccgcggtggcggccgctctagaactagtggatcccccgggctgcaggaattcgcacgagaccattacctagaacatcctaatcaaaaaacatcgattttcctccggaatcgtaacctcagaaagccaaatctcattctccggcgctcaggcccacccaagcgtcgactctcccgatccaatcggtacctcctagttcctcgccggcggtagcggcgtcgggcgaacagcggtgacttggcgagggcgcttggccggcgacaatcatccactaggatggaaggtgaggcagagaccgtggttggttcttgttctaaaccatgtgggcctctggaggactactacattccagattacattctgaagccaggtgcccaacaagtacttgttgatcatgcggcaccctgccccgttgtagtgttcatcaactcaagatctggaggccaacttggaagtagtttaatcaaaacatatcgtgagcttctcatgaagcacaggtttttgatctctcaaaagagctcccagataggtattgcatcgtttatatgccanccttgaaaggctgaagatggaggagacatttcttgcagtcaaatttggaggaactgangctaaatggttgcaggcggtgatgtacagctagctggctggcttggggtaatcagtgaccttagctttccaccaactccggtgcaactgtt

SEQ ID NO: 22838 - protein, 93 aa, Zea mays
  misc_feature: Ceres CLONE 1392808-F
  misc_feature (92)..(92): Xaa is any aa, unknown, or other
MEGEAETVVGSCSKPCGPLEDYYIPDYILKPGAQQVLVDHAAPCPVVVFINSRSGGQLGSSLIKTYRELLMKHRFLISQKSSQIGIASFICXP

SEQ ID NO: 22839 - DNA, 663 bp, Zea mays
  misc_feature: Ceres CLONE 1392809-F
  misc_feature: Encodes the peptide sequence at SEQ ID NO. 22840
  misc_feature (569)..(569): n is a, c, t, g, unknown, or other
  misc_feature (571)..(571): n is a, c, t, g, unknown, or other
agagctggagctccccgcggtggcggccgctctagaactagtggatcccccgggctgcaggaattcgcacgagaccattacctagaacatcctaatcgaaaaactaaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaaggacgcgcgctggcgcccagcgtgtcgtactacgactacatcatcgtggggcggcgcacggccgggtgcccgctggccgccacgctgtcggagcgcttccgcgtgctgctgctggagggggggcccctcccccctacgaagaacaaccggaattcgggaacttgggccccgtttttccggaaacacctttgtttaaaaaacaacctctcccccccggtttcccccccccccacaaatttttttttgggggggaggggagggtgtttttatttccccccccccccccccgggggggtggggggggggngntttattaataaaaaacggtttttacaaaagcgggggaaaaaaaaaaaaacagggggggggtgtaaaaaaaaaaaaaacacccccccccccgg

SEQ ID NO: 22840 - protein, 171 aa, Zea mays
  misc_feature: Ceres CLONE 1392809-F
  misc_feature: SWISSPROT Homolog: EC 4.1.2.10 Mandelonitrile lyase
  misc_feature (141)..(141): Xaa is any aa, unknown, or other
MSGRSRHFTMSTLLATSFFFVLLCSSLQVRGVNYTFVKGRALAPSVSYYDYIIVGRRTAGCPLAATLSERFRVLLLEGGPLPPTKNNRNSGTWAPFFRKHLCLKNNLSPPVSPPPTNFFLGGRGGCFYFPPPPPGGVGGGXFINKKRFLQKRGKKKKTGGGCKKKKNTPPP

SEQ ID NO: 22841 - DNA, 730 bp, Zea mays
  misc_feature: Ceres CLONE 1392811-F
  misc_feature: Translation starting site: 291
  misc_feature: Pfam Name: DAGK_cat Pfam Description: Diacylglycerol kinase catalytic domain (presumed)
  misc_feature (461)..(461): n is a, c, t, g, unknown, or other
  misc_feature (587)..(587): n is a, c, t, g, unknown, or other
  misc_feature (590)..(590): n is a, c, t, g, unknown, or other
  misc_feature (697)..(697): n is a, c, t, g, unknown, or other
aaagctggagctccaccgcggtggcggccgctctagaactagtggatcccccgggctgcaggaattcgcacgagaccattacctagaacatcctaatcaaaaaaacatcgattttcctccggaatcgtaacctcagaaagccaaatctcattctccggcgctcaggcccacccaagcgtcgactctcccgatccaatcggtacctcctagttcctcgccggcggtagcggcgtcgggcgaacagcggtgacttggcgagggcgcttggccggcgacaatcatccactaggatggaaggtgaggcagagaccgtggttggttcttgttctaaaccatgtgggcctctggaggactactacattccagattacattctgaagccaggtgcccaacaagtacttgttgatcatgcggcaccctgcccccgttgtagtgttcatcaactcaagatctggaggccnacttggaagtagtttaatcaaaacatatcgtgagcttctcatgaagcacagggtttttgatctctcaaaagagctcccagataggtattgcatcgtttatatgccaccttgaaaggctgaagatgnaangagacattctttgcagtcaaatttggaggacactgagctaattgttgaaggcggtgatgtacagctagctggctgcctgggggtagtcagggacttaagctttcccnccacctccagtggaactgttcctctgggaacga

SEQ ID NO: 22842 - DNA, 713 bp, Zea mays
  misc_feature: Ceres CLONE 1392812-F
  misc_feature: Encodes the peptide sequence at SEQ ID NO. 22843
  misc_feature (362)..(362): n is a, c, t, g, unknown, or other
  misc_feature (605)..(605): n is a, c, t, g, unknown, or other
aaagctggagctccccgcggtggcggccgctctagaactagtggatcccccgggctgcaggaattcgcacgagaccattacctagaacatcctaatcgaaaaactaacctctgcatccgcatctctctctctcgcgcgcgccgcccttcccagcgccgtcggctgccgctcctcccctccaccgccgcctctgctccgcccgtcctcgcgccgtcgcgaccgctgcggcttcgtctctccccattgtctgtcccctctcaacgcactctacgacggaccgatgacttgacggatctgggggtttgtctaggggtggtgaacggaaggggatggagttcacggagtcgttcaagcagacgggnccgtgctccttctcccccgactcgcgcttccttgctattgccgtaaactaccgcctcgtcgtccgcgacgtactctcactgaaggtggtacaattattttcatgcgtggacaagataagctctggagaatgggcaccagattcagaaaatattttatgtggactttacaagccgaccatggtgcaagcttggtcattgagccaacctgattggacctgcaggaatgatgaaggcccaacaggnattgatatggctcgctggaatcctgacagccgtcatatattaactacatctgagtttcactcccgcccccaccgggtggtctctcgaaaaaacgaatgcgaacatgtc

SEQ ID NO: 22843 - protein, 128 aa, Zea mays
  misc_feature: Ceres CLONE 1392812-F
MEFTESFKQTGPCSFSPDSRFLAIAVNYRLVVRDVLSLKVVQLFSCVDKISSGEWAPDSENILCGLYKPTMVQAWSLSQPDWTCRNDEGPTGIDMARWNPDSRHILTTSEFHSRPHRVVSRKNECEHV

SEQ ID NO: 22844 - DNA, 751 bp, Zea mays
  misc_feature: Ceres CLONE 1392813-F
  misc_feature (1)..(1): n is a, c, t, g, unknown, or other
  misc_feature (513)..(513): n is a, c, t, g, unknown, or other
  misc_feature (623)..(623): n is a, c, t, g, unknown, or other
  misc_feature (678)..(678): n is a, c, t, g, unknown, or other
naaagctggagctccccgcggtggcggccgctctagaactagtggatcccccgggctgcaggaattcgcacgagaccattacctagaacatcctaatcgaaaaaccatcccggaggtaatcttgcgccgattcggtgccgatttgcgccatccgcgaccggaggctccgccgggtcttgtgttcttgcggggcgggggctcaggacaacctggcctctgcttgattggattcggggcgttcggcgcctccagctcgcgatctttcctgccggtttcgtcgaccgctggtcaacctgggccggtcggtcccgggggctcttcacctccgtgctgcctgccaccgtcgctttagtcaagtcttggccaagattttagctatctccggtcaaaaggctttaccgattcttgggattggtggcttcttgggggcgagaagccggttcctgtttcgtctcttgtgctccagcatgttctgtagcacaccggttcccatctccaagtgaaaggtgttcngtgtgctcttggttttgtgcctcccgggaatcgtcccggaaagctacttttgggcgctgcgggcgatggcgtcaagcacagccgaggatgggccgaggggaaggagaaancttgaagaggtccggcagcttgggaagcaacgataccgtatgtgcgtgccagacnagattgatcttacgagcctcggactccagctgggagaacagctcaccaagacctgggggcaaagccatcctca

SEQ ID NO: 22845 - DNA, 698 bp, Zea mays
  misc_feature: Ceres CLONE 1392814-F
  misc_feature: Encodes the peptide sequence at SEQ ID NO. 22846
  misc_feature (222)..(222): n is a, c, t, g, unknown, or other
  misc_feature (440)..(440): n is a, c, t, g, unknown, or other
  misc_feature (512)..(512): n is a, c, t, g, unknown, or other
  misc_feature (514)..(514): n is a, c, t, g, unknown, or other
  misc_feature (606)..(606): n is a, c, t, g, unknown, or other
  misc_feature (616)..(616): n is a, c, t, g, unknown, or other
aaagctggagctccccgcggtggcggccgctctagaactagtggatcccccgggctgcaggaattcgcacgagaccattacctagaacatcctaatcgaaaaatggcatctgcattgcagttgcagccacgccaacaactgggcagcggcgacatctgcatctcccacctcgtctccctcccgtatctgcaagccttgatcccgccgccagccatccatccnagggagccatgtctccatccggcgagctgctggcttccatctcctccgtcttcactgtcgccttcgtcctcctcgcctgcgtcgagctcggcgacgccgccgccgccgccgtcggcgtctaccgcctcatccagtacgacctcgccggcgctccgctcggctccccgcgccgcggtcctcaaccaccacgctgccgcgctcccgctccccgccggagnagacctctcccgctccgccctcgtcgcgccgctccttgacctcccgctctctttcctcagagagtacctggntnagaaaaaacatctgggggggattactcattctgctcccgacaataatggacagtgtggatgacaagggcaattccaaggtgactgactgaanctggaagagnttgctctgcatgaacagtttcatatcccggggacttttgctttgcatgacgaccatcttgataacctggctgggaaatatcc

SEQ ID NO: 22846 - protein, 82 aa, Zea mays
  misc_feature: Ceres CLONE 1392814-F
  misc_feature (70)..(70): Xaa is any aa, unknown, or other
MSPSGELLASISSVFTVAFVLLACVELGDAAAAAVGVYRLIQYDLAGAPLGSPRRGPQPPRCRAPAPRRXRPLPLRPRRAAP

SEQ ID NO: 22847 - DNA, 589 bp, Zea mays
  misc_feature: Ceres CLONE 1392815-F
  misc_feature (223)..(223): n is a, c, t, g, unknown, or other
  misc_feature (360)..(360): n is a, c, t, g, unknown, or other
  misc_feature (361)..(361): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
aagctggagctccccgcggtggcggccgctctagaactagtggatcccccgggctgcaggaattcgcacgagaccattacctagaacatcctaatcgaaaaatcattgcaaaagcgaagcaaagcaatcggaattctctgcgatttctctagatctcgactaccccccactagttttggttcctcctttcgttcgagagagcgattctgggtggcaatggcgnaagagggagggtccgggggatcgggaatcgaaacttcggacccaccttatttgtgggggttcgggggggtgggaaaaccccccagccggggggggggaaatatttttccccccccccgcgccgggggggggaacgannccccccccccccccccccgttattttggggggggttttccccccccacccggggggggggggtttttttttttttgggggggggggggggggtaaaaaaaaaaaagaaggggggggcgggttttgtttttagggcccccccccccaacaccctctggtggttttttgttttttggggagggggnnnaaccccccccnnnctggggtggtttcgggagggggggggggg

SEQ ID NO: 22848 - DNA, 747 bp, Zea mays
  misc_feature: Ceres CLONE 1392816-F
  misc_feature: Translation starting site: 219
  misc_feature (277)..(277): n is a, c, t, g, unknown, or other
  misc_feature (280)..(280): n is a, c, t, g, unknown, or other
  misc_feature (281)..(281): n is a, c, t, g, unknown, or other
  misc_feature (323)..(323): n is a, c, t, g, unknown, or other
  misc_feature (324)..(324): n is a, c, t, g, unknown, or other
  misc_feature (343)..(343): n is a, c, t, g, unknown, or other
  misc_feature (344)..(344): n is a, c, t, g, unknown, or other
  misc_feature (366)..(366): n is a, c, t, g, unknown, or other
  misc_feature (367)..(367): n is a, c, t, g, unknown, or other
  misc_feature (371)..(371): n is a, c, t, g, unknown, or other
  misc_feature (373)..(373): n is a, c, t, g, unknown, or other
  misc_feature (375)..(375): n is a, c, t, g, unknown, or other
  misc_feature (376)..(376): n is a, c, t, g, unknown, or other
  misc_feature (430)..(430): n is a, c, t, g, unknown, or other
  misc_feature (451)..(451): n is a, c, t, g, unknown, or other
  misc_feature (464)..(464): n is a, c, t, g, unknown, or other
  misc_feature (475)..(475): n is a, c, t, g, unknown, or other
  misc_feature (487)..(487): n is a, c, t, g, unknown, or other
aagctggagctccccgcggtggcggccgctctagaatagtggatcccccgggctgcaggaattcgcacgagaccattacctagaacatcctaatcgaaaagtttaggttgtataaaacaaaacactgacactcttttatattttgaatataaggcaaaaattctgggccggccactgcccagatcccgccgacattctccaaaccaaccgtggcggcgatgaggaaggcgggggtgacctccgcctccagcggtggaggagaaggatggccgtgcgntgnntgcctcaaccctcgtgtgaagctgaacgtgctgctactgctnngtggtgtgaccccacatcnntgtgtcctgggtacactctccnntcgngncnngcacgtgggcgcggtccttctccagcagcaacggtgacgcgacaaggatctggntcctgatcccgcagctggaangcatccggcgcgncgtgtcgcagnttgaacacctcnggtcggcgtcccctcccccggcgttttcgcggggggagtttgtcctctactcccgcctcggcccccgtggatccggctggtccggggaccgggagctcctcaccggtaaatgtcctaactccctacgggtttttgcccgaagaaccccttttccttggcagagcctccctccctcggggaggcacccctccccggggggaaggggttttccccccccggatccgattaaattcaaaactccccccgcgacccttttcccg

SEQ ID NO: 22849 - DNA, 678 bp, Zea mays
  misc_feature: Ceres CLONE 1392818-F
  misc_feature: Encodes the peptide sequence at SEQ ID NO. 22850
  misc_feature (388)..(388): n is a, c, t, g, unknown, or other
  misc_feature (393)..(393): n is a, c, t, g, unknown, or other
aaagctggagctccccgcggtggcggccgctctagaactagtggatcccccgggctgcaggaattcgcacgagaccattacctagaacatcctaatcgaaaaaatgcggcgcctccactttgcgatgcccgcgtcctcgctcccctccccatcctcctcatctaccgtgctctccattccccacccgctcccaccgccgctcgcagatgccgcccaaggtggtcgccgtcgccgcgggcgaggcccacacactcgccctcacgggtgacgggcaggtgtactcctggggcagggggccgttcggtcgcctcgggaacggccgcgaggacgacaagctggccccccaccgcggtggcgcccgcggtctctgccagcgggacaccgcggnccagnttcgtcgccgtcgcggctggtgcctaacacagccttgcgctggacgatgaaaggtcactctggtcatggggttacaatctctatggtcaacttggctatggggaacagaattccctttttccatgttcggtgagcatttcagggattaggttctcctgaaacactggatggatgagacagaacacacgtggtcggacttgtttgaagctgtcttctgtccagctgggggcatgatgtccctggcctaaacagttggggagcctttggaagggggggaaattcccc

SEQ ID NO: 22850 - protein, 78 aa, Zea mays
  misc_feature: Ceres CLONE 1392818-F
  misc_feature: SWISSPROT Homolog: EC 2.7.11.1 Non-specific serine/threonine protein kinase
  misc_feature (61)..(61): Xaa is any aa, unknown, or other
  misc_feature (63)..(63): Xaa is any aa, unknown, or other
MPPKVVAVAAGEAHTLALTGDGQVYSWGRGPFGRLGNGREDDKLAPHRGGARGLCQRDTAXQXRRRRGWCLTQPCAGR

SEQ ID NO: 22851 - DNA, 697 bp, Zea mays
  misc_feature: Ceres CLONE 1392819-F
  misc_feature (183)..(183): n is a, c, t, g, unknown, or other
  misc_feature (228)..(228): n is a, c, t, g, unknown, or other
  misc_feature (385)..(385): n is a, c, t, g, unknown, or other
  misc_feature (428)..(428): n is a, c, t, g, unknown, or other
aagctggagctccccgcggtggcggccgctctagaactagtggatcccccgggctgcaggaattcgcacgagaccattacctagaacatcctaatcgaaaaaaaataaaatccaattttctcagtctcgagcgcccgcgtccctcgccccgtcgcgactcgcgacttcgcgagtcgccccgtnccagcctcccagccgtcccggctccccgcgaccccgccctccggnagtccggcgcgggggctcctctccgatccggtgagccgaacgaggatcccaactccccgaagaaaagcgccacagccagagccaggggtggctcggctctcctctcacagactgcgccgcagcgcctagcgctcggctggcagccgctcggggcggntcgccccgcggccccgcccctgctgcctacatcggcctgcagncagaagatctggcctcagcgaccggcctgcctgccctttgggcttctggggttctggacacagcacacggacttgtccccaaacacggggggggggatgatatctcaaaaaacttcccgggaaggatctgacggtaaggaggagtcttcatcaagggggaggactcctcccgagataccctccaagaaaaaatctcccgaccgaacgaaaaaatgacaccccctcaaggggagggtgatccaaagaacgcattatcaaatacggtttcg

SEQ ID NO: 22852 - DNA, 734 bp, Zea mays
  misc_feature: Ceres CLONE 1392820-F
  misc_feature: Encodes the peptide sequence at SEQ ID NO. 22853
  misc_feature (242)..(242): n is a, c, t, g, unknown, or other
  misc_feature (249)..(249): n is a, c, t, g, unknown, or other
  misc_feature (259)..(259): n is a, c, t, g, unknown, or other
  misc_feature (504)..(504): n is a, c, t, g, unknown, or other
aagctggagctccccgcggtggcggccgctctagaactagtggatcccccgggctgcaggaattcgcacgagaccattacctaagaacatcctaatcgaaaaaggctggatttgagcctgtttagcagcgctatccgcttggcccaattcgtctactgctcctccagctcctccgctgcgccgccggtcgccgcccgacaccgccgaagaagagcagacgccgagtccaggacgtcgccgcngggctcngggaacgcgntgttgccatcgcgaggaaggtcggaaaagtcgctgtcgcccgccggatcggcaccgtcgccaccgcccatgggcaccgtcgcccccgtcgtctccgacctcgtcgacttcctcgaggcgtcgcccacggcctttcacgccgttgacggagcaaaccgccgcctgaaggcgccggggttcctgcacctgtcgaagcgggaggagtgggcggttctccaggcccgggggaagtacttcttccacggnaccactccactattgtcctttttgccatcgggccaaaaaacgttgtgggaaagggttccacattatcgggggaccccttggcaggcctttgccgaaactcaagcctggccccaaggaacacaaagggggttcccttggggggtggggtcaaaccggagggggggggggttgggggcacccttggttttgcccgggatcttttcgggggggggggaaaaggggattaaccg

SEQ ID NO: 22853 - protein, 135 aa, Zea mays
  misc_feature: Ceres CLONE 1392820-F
  misc_feature: SWISSPROT Homolog: EC 3.4.11.21 Aspartyl aminopeptidase
MGTVAPVVSDLVDFLEASPTAFHAVDGANRRLKAPGFLHLSKREEWAVLQARGKYFFHGTTPLLSFLPSGQKTLWERVPHYRGTPWQAFAETQAWPQGTQRGFPWGVGSNRRGGGLGAPLVLPGIFSGGGEKGIN

SEQ ID NO: 22854 - DNA, 747 bp, Zea mays
  misc_feature: Ceres CLONE 1392821-F
  misc_feature (366)..(366): n is a, c, t, g, unknown, or other
  misc_feature (437)..(437): n is a, c, t, g, unknown, or other
  misc_feature (454)..(454): n is a, c, t, g, unknown, or other
aaagctggagctccccgcggtggcggccgctctagaactagtggatcccccgggctgcaggaattcgcacgagaccattacctagaacatcctaatcgaaaaatatctatatctggattgttccggccctcccccttcttcgattttgtgggcggcttctctctctttttttcttcttcctgttgatgtgcgaatttagaggggataagagcttttggggggaatctgatggaatccgatcgattttctcgccgttcttggtcgatctgtcggggaaggtaggatttgttcatggtttgtgggggatttggttggatttcgaagggtttgggcggccatggtggtgactggtgagcgggatatggngatttttggtgatcgagtggggaaatcgttctgttggatgtctttaaaacgggattttgtgatactggagnaaatttttcggtggaanccatagcttttgttgcgatataccgctattggacacggatcatcatgttttaaaatctttttttttcctcagaggtatggggatgatcgagtgctaaacgctccgttaaggtctgaatctgcgcgatcttgatttcaggatgcgatctattggtaaatgacgggaggcattttcctgccatcctttgtggtgctaagccgaaatttattctgatggtaatttggtagggaaactatttgatcaggctggcttctgaagacggaacttagatgaaaacgcgtttttgatgtgat

SEQ ID NO: 22855 - DNA, 772 bp, Zea mays
  misc_feature: Ceres CLONE 1392822-F
  misc_feature (387)..(387): n is a, c, t, g, unknown, or other
  misc_feature (705)..(705): n is a, c, t, g, unknown, or other
  misc_feature (706)..(706): n is a, c, t, g, unknown, or other
aaagctggagctccccgcggtggcggccgctctagaactagtggatcccccgggctgcaggaattcgcacgagaccattacctagaacatcctaatcgaaaaaataattctagtattccaccgccgcacacctcctgtcttccttcaccttcgcgctccgccgccgccgtcgattcgtgctgctctcacccctaacctgtccaacatcgccggggagggaagcagcagaagaagctccccttacctccggctatcgcctgaggataaagtggggtctgtaagggagtcttaggggggagcaaaagggataggatagggagagatgaaagcatcaatttcttcgtcccgctttcgccctgcttacgtccccgctactaaccctaggancattctggcttttcccgtttctatcccaatctttcttcgtttattgctatcagttatggagggtgacggcttcacaagcttccctaccaaaataggggaaaaagaaacctgggtcaagttaacttgggtggaaaaaataatcccggggccggggtaatatcccaaacaaaaaaggttgcaaaaaaacaaaaatttttggggtatgtgggaaaagaaataaataatcctcaaaaaaaaggggaaacccccccttaaataaggggggggtattcccccccccctaatgggccccaaaacagggaaggtctccggtggggnntttttcttcttaaaaacccgcggagaaaaaaagtgggcccccttaacaaaagaggtttttaaaaaa

SEQ ID NO: 22856 - DNA, 726 bp, Zea mays
  misc_feature: Ceres CLONE 1392823-F
  misc_feature: Encodes the peptide sequence at SEQ ID NO. 22857
  misc_feature (679)..(679): n is a, c, t, g, unknown, or other
aaagctggagctccccgcggtggcggccgctctagaactagtggatcccccgggctgcaggaattcgcacgagaccattacctagaacatcctaatcgaaaaagcagagggccatcttctactcttctctcccagccaacccccttgtccaacggttcagcctgctcaattttagtgaccagttacggcaaatgcagccctcggcggacagcaggaagaagaagcggcggcggcggaggaggaggaggctggcggcatgctactcatcgagacctgctgccggcgccgctcaaggccagtgtcagtgcggctcctctagccccggtggcggcggcggaagcggcagcctcgtggcaagaacaccgcgcgcgttctcgagctgctccagctacgccgcctcgtctgcctggcgcgccggcggcggccgtccatctcggcacccagcacaagctgacggcgctcctcgtcgcgctcgcgctcctcctcgtcctccctcgccctcgtctcgtgggaggggtcccgggtggtgtcgccccgcaggatggcgaggatccgcagtcacgtggagaggatcaacaagacccccgtgcgctccattgagagccaggacggcgacactatcgactgcgtggcggagcacgagcagcacggcctggacacccgctcctcagggcgcagnccgtccaaacgagcgcccaagggcccaaggggggggggtgccactct

SEQ ID NO: 22857 - protein, 61 aa, Zea mays
  misc_feature: Ceres CLONE 1392823-F
  misc_feature (46)..(46): Xaa is any aa, unknown, or other
MARIRSHVERINKTPVRSIESQDGDTIDCVAEHEQHGLDTRSSGRXPSKRAPKGPRGGGAT

SEQ ID NO: 22858 - DNA, 755 bp, Zea mays
  misc_feature: Ceres CLONE 1392824-F
  misc_feature: Translation starting site: 230
  misc_feature (349)..(349): n is a, c, t, g, unknown, or other
  misc_feature (418)..(418): n is a, c, t, g, unknown, or other
aaagctggagcgccccgcggtggcggccgctctagaactagtggatcccccgggctgcaggaattcgcacgagaccattacctagaacatcctaatcgaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctcaagaccggcggtgtcgacggcctcccgccggggcctcccgggttggcgntggtggggaacctgttccaggtgatccttcagcgacggcccttcatgtacgtggtgcgcgacctccggnagaagtacgggcccatcttcaccatgcgggatggggcagggcaccctcatcggtggtcaccttcgggggagctcatccagaagggggttggtgaagcagggcccccctggttcggaggccggcccggaggaaagccccccccgcctcccttttaaggggggggaaggggaccggaaatttcggggccccagggccccctggggggggggtttgggccccaattttcgcgcccagaaaatgggcccccccccggcgaaggggtttccccgtgatccggggggggggccgggaaaaccctttttgcgccccctttgcccaaatctggggggaagggggg

SEQ ID NO: 22859 - DNA, 722 bp, Zea mays
  misc_feature: Ceres CLONE 1392825-F
  misc_feature: Encodes the peptide sequence at SEQ ID NO. 22860
  misc_feature (316)..(316): n is a, c, t, g, unknown, or other
  misc_feature (317)..(317): n is a, c, t, g, unknown, or other
  misc_feature (319)..(319): n is a, c, t, g, unknown, or other
aagctggagctccccgcggtggcggccgctctagaactagtggatcccccgggctgcaggaattcgcacgagaccattacctagaacatcctaaaaaaaaaccaaaacctccactcttcctcccaccaaggcaccaacccgacgcaaagccgccggctttccccgatggcgacgacgatgtcagtttcggcggtgtccccgcccgccgcggctgtcacgcggccccggacgatggtctgcgtgccggcgacggcgcgggcgccgcgggagatggcggctgagctggccgccgccgccgcgctcggcgccgacgtgnngnagcttcgcctcgactgcctcgccggtttcacgccgcgcagggacctgcccgtcatcctcgccaagccccgtccgctccccgccctcgtcaccttcaggcccaagtggggaaggaggcgaatacgaaggcgatgacgaatccccggtttgaggctctgctattggcaatggagctgggagctgaaatatgtggatgtcgagcttaaggtggctgacaaatttatgaaacttatttctgggaggaaacctgataactgtaaacttatagtttcatcccacaactatgagaccactccatcgtccgaggacttggaaatttggtggctcagatacaggaacggggggctgaaatcgtgaaataactaacacgctactgaaaatgtgatgtggcaaaatgttcaaaa

SEQ ID NO: 22860 - protein, 95 aa, Zea mays
  misc_feature: Ceres CLONE 1392825-F
  misc_feature (51)..(51): Xaa is any aa, unknown, or other
  misc_feature (52)..(52): Xaa is any aa, unknown, or other
MATTMSVSAVSPPAAAVTRPRTMVCVPATARAPREMAAELAAAAALGADVXXLRLDCLAGFTPRRDLPVILAKPRPLPALVTFRPKWGRRRIRRR

SEQ ID NO: 22861 - DNA, 733 bp, Zea mays
  misc_feature: Ceres CLONE 1392826-F
  misc_feature: Encodes the peptide sequence at SEQ ID NO. 22862
  misc_feature (498)..(498): n is a, c, t, g, unknown, or other
  misc_feature (562)..(562): n is a, c, t, g, unknown, or other
aaagctggagctccccgcggtggcggccgctctagaactagtggatcccccgggctgcaggaattcgcacgagaccattacctagaacatcctaatcgaaaacctccccatcgcgtctgtccgctacccctccccgaccagatcgctacgagacgccgcgcgatccgacccaggccgacgccgacgacccctctcgccgccggcggccatggcgtacggcgaccgcgtcaccaccttcgaggactccgagaatgagagcgagtacggctatgtccgcaaggtctctggacctgtggttgtggctgatggaatgggtggtgctgccatgtatgaacttgttcgtgtcggacatgataacctcattggggaaattatccgtcttgagggcgattcagctacaatccaagtttatgaggaaacagctggactgatggttaatgaccctgtattgagaacaagaaagcctctttcagttgaattgggacctggaattctggnaaacatttttgacggtatccagcgacctctaaaatcatcgctattaggtcaggagatgtgatantcctcgggggtgtttcagttcctgcccttgaccaagatgtattgtggggatttcaccaacgaagctagggggtttggagatgctcccccggggggaaatctatccgcctactgttttttggaaacccatgatgcagcacatggtgtccctccaccggggttcctatgggga

SEQ ID NO: 22862 - protein, 116 aa, Zea mays
  misc_feature: Ceres CLONE 1392826-F
  misc_feature (22)..(84): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
  misc_feature (97)..(97): Xaa is any aa, unknown, or other
MAYGDRVTTFEDSENESEYGYVRKVSGPVVVADGMGGAAMYELVRVGHDNLIGEIIRLEGDSATIQVYEETAGLMVNDPVLRTRKPLSVELGPGILXNIFDGIQRPLKSSLLGQEM

SEQ ID NO: 22863 - DNA, 740 bp, Zea mays
  misc_feature: Ceres CLONE 1392828-F
  misc_feature: Encodes the peptide sequence at SEQ ID NO. 22864
  misc_feature (560)..(560): n is a, c, t, g, unknown, or other
  misc_feature (740)..(740): n is a, c, t, g, unknown, or other
aaagctggagctccccgcggtggcggccgctctagaactagtggatcccccgggctgcaggaattcgcacgagaccattacctagaacatcctaatcgaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcatcggcatgaccaagtccgaccttgtcaacaacctcggtaccatcgccaggtccgggacgaaggagttcatggaagcccttgctgccggcgctgatgtgtccatgattgggcagttcgggcgtcggtttctactctgcctnactcgtcgccgaatagagttgtcgtgaccaccaggcacaacgatgacgagcagtaccgtgtgggagtccaaagggggggcgggtcgttcactgttactcgtggacccgtcagggggagcaaccttggcaggggcactaaaaatccccttgttccttaaagacgaatagcttggggaaccn

SEQ ID NO: 22864 - protein, 138 aa, Zea mays
  misc_feature: Ceres CLONE 1392828-F
MASETETFAFQAEINQLLSLIINTFYSNKEIFLRELISNSSDALDKIRFESLTDKSKLDAQPELFIHLVPDKATNTLSIIDSGIGMTKSDLVNNLGTIARSGTKEFMEALAAGADVSMIGQFGRRFLLCLTRRRIELS

SEQ ID NO: 22865 - DNA, 719 bp, Zea mays
  misc_feature: Ceres CLONE 1392829-F
  misc_feature: Encodes the peptide sequence at SEQ ID NO. 22866
  misc_feature (434)..(434): n is a, c, t, g, unknown, or other
  misc_feature (482)..(482): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (536)..(536): n is a, c, t, g, unknown, or other
  misc_feature (596)..(596): n is a, c, t, g, unknown, or other
  misc_feature (598)..(598): n is a, c, t, g, unknown, or other
  misc_feature (609)..(609): n is a, c, t, g, unknown, or other
caaagctggagctccccgcggtggcggccgctctagaactagtggatcccccgggctgcaggaattcgcacgagaccattacctagaacatcctaatcgaaaaagagcagagctgagctgcctccaactccgacccacacccacggcacggcagtcggcagcagccagcgttgagcgcagtgccctcttgtctgctgcctcctacctccccgcccagtctcactcacacgctcccacttccgagtctcgctcgcagcctgttctcctggggtccgatcggaggggggtgaggagatggagccagattcggcgacgacgaggctcgcattgctggcgctgcttctcctggcggcgcccgcccgcccggcctcggcggctccggtggaggatggcctgctcagcaatggtgactttgagacgcaccagccggcggntttgtaagatctgcgtctgttgctgagggtgcatcgtcaatccctggntgnnnacatcatggcacagtcgagctcatttcagcaggccagcacccaggtggncatgatcctgatttgtccacagggagaccatgctgtaaggctagggaatgatgctagcgntnggcagggtggntgaacgtcaagaagggctcgggactacgctgtcacattcagcgctgccgggacatgtgcacaactggaggcactggacgtctcccgggctaggtggccgtgtcacaaaca

SEQ ID NO: 22866 - protein, 48 aa, Zea mays
  misc_feature: Ceres CLONE 1392829-F
  misc_feature (47)..(47): Xaa is any aa, unknown, or other
MEPDSATTRLALLALLLLAAPARPASAAPVEDGLLSNGDFETHQPAXL

SEQ ID NO: 22867 - DNA, 753 bp, Zea mays
  misc_feature: Ceres CLONE 1392830-F
  misc_feature: Encodes the peptide sequence at SEQ ID NO. 22868
  misc_feature (158)..(158): n is a, c, t, g, unknown, or other
  misc_feature (273)..(273): n is a, c, t, g, unknown, or other
  misc_feature (310)..(310): n is a, c, t, g, unknown, or other
  misc_feature (325)..(325): n is a, c, t, g, unknown, or other
  misc_feature (414)..(414): n is a, c, t, g, unknown, or other
  misc_feature (415)..(415): n is a, c, t, g, unknown, or other
  misc_feature (538)..(538): n is a, c, t, g, unknown, or other
  misc_feature (606)..(606): n is a, c, t, g, unknown, or other
aagctggagctccccgcggtggcggccgctctagaactagtggatcccccgggctgcaggaattcgcacgagaccattacctagaacatcctaatcgaaaaaaaaagctggcagtgtcggtgtcggtgtcgtcgtcggcgtcggtgctggggagcggncgagcggcgcgtcgcatgattctgtcctcctgacgtggcagctaacgattccgattccctttggttgcagtgcgacgacattgacatggacatggcgcagctggagtggctgtcngggctcttcgacgacgcatccatcccgcacgagccgncgttccccggcgcgncgcccatcatcaagagctccgcgctggcggccggcgcgctgctgcccgcggacaagatggggggacgcgctgctgttccgcagctcagnnccccatctcggtggctggagcacggcagcttcaacacgccaacggcggtggcggcggctgctccgcgtccgtcggagtcgtcctcggggtcctccgtcctcggagtctttctccggcagcggnaacggcgagggccctggggggggggcggggccccgtggtcgccgccccccgggggtcgtcataccggnggcgcgggggggggaaaggcctcccgccccgtccgggttaagggggggggcggggggggaagcggccccccatccttgggggcgaggcccatggaattcggtcggggccggtcccctgcggaccccgggagggatctgtgtgatccg

SEQ ID NO: 22868 - protein, 170 aa, Zea mays
  misc_feature: Ceres CLONE 1392830-F
  misc_feature (23)..(23): Xaa is any aa, unknown, or other
  misc_feature (28)..(28): Xaa is any aa, unknown, or other
  misc_feature (57)..(57): Xaa is any aa, unknown, or other
  misc_feature (58)..(58): Xaa is any aa, unknown, or other
  misc_feature (99)..(99): Xaa is any aa, unknown, or other
MDMAQLEWLSGLFDDASIPHEPXFPGAXPIIKSSALAAGALLPADKMGGRAAVPQLXXPSRWLEHGSFNTPTAVAAAAPRPSESSSGSSVLGVFLRQRXRRGPWGGGGAPWSPPPGGRHTGGAGGGKASRPVRVKGGGGGGSGPPSLGARPMEFGRGRSPADPGRDLCDP

SEQ ID NO: 22869 - DNA, 731 bp, Zea mays
  misc_feature: Ceres CLONE 1392831-F
  misc_feature: Encodes the peptide sequence at SEQ ID NO. 22870
  misc_feature (262)..(262): n is a, c, t, g, unknown, or other
aaagctggagctccccgcggtggcggccgctctagaatagtggatcccccgggctgcaggaattcgcacgagaccattacctagaacatcctaatcgaaaactcgtgttcttgttcgtctccgcctcaggcaactccacacggtcacacctcgctcgctctcgctcccgtatcgcggtttccttttcgaagccttgctaggtttagctgggggctctgtctatcctgtcaatggccccttaggcggctgtacttcagacttncagagtgacgtgaggcgtggggacgcgcgtagctgattggttcgaggaggcggggatgggacccgacttctcgccggcgagtgggggcccgagctttgaggtcgccttcaactcggtcaacttctctgaccgggtggtgcagatcgagatcgtcgctggggatgacgccctcggggccaagggcgccaccggggagggtgctcatctctttgcgactgggcgtgccccgcaagcgacgacgggaggagctccgacgcgacaagaatctagaaatacatggcagatccagcaaactgcaaagttgaacctgaagaatgtgatgcctacgagggagggaatgagcctgtagctatgatagaaaatcctccgctgatatgaggcagatggggaggatgaaaaaacagcgactcaactggaggatggagggaccccgggtttgagaggtaatctatgtactccgttccgcatt

SEQ ID NO: 22870 - protein, 97 aa, Zea mays
  misc_feature: Ceres CLONE 1392831-F
MGPDFSPASGGPSFEVAFNSVNFSDRVVQIEIVAGDDALGAKGATGEGAHLFATGRAPQATTGGAPTRQESRNTWQIQQTAKLNLKNVMPTREGMSL

SEQ ID NO: 22871 - DNA, 707 bp, Zea mays
  misc_feature: Ceres CLONE 1392832-F
  misc_feature: Translation starting site: 283
  misc_feature (339)..(339): n is a, c, t, g, unknown, or other
  misc_feature (569)..(569): n is a, c, t, g, unknown, or other
aaagctggagctccccgcggtggcggccgctctagaactagtggatcccccgggctgcaggaattcgcacgagaccattacctagaacatcctaatcgaaaaaggatgacaaaatttcccactccactcgaattaaaaccctagcggcaaaaccttcgctctgcgccgccgtcgcctgctcccgtcccgccaccacatccgcccaggagctcgccgtcggggaggctgctcgaggagccgcgctgtctctcccgcgccgcgaccttcgccctcgccgccgccatgatctgcgcgatctccggtgaggtgccggacgagccggtggtgtcaaagaagtcngggcttctcttcgagcggcggctcatcgagcgctacattgaggaccatggcaagtgccccatcaccaaggatgagcttactatggatgatatcgtggcggtcaataccaacaggtcgtgaagcccagcctttgcaggctgcaagcattccagacttcttgggatttttcagaacgagtgggatgctctcatgctttctatttttgctttggagcagcagctaccacagcnagacaggacttagtcatgcactctaccagcatgacgctgcctggcgtgttattaccaggtttaagaaagaaagagatgaggttaaagcacttttggctcaggctgaaaaaagaatcccagatcagttggaggagtgct

SEQ ID NO: 22872 - DNA, 700 bp, Zea mays
  misc_feature: Ceres CLONE 1392833-F
  misc_feature: Encodes the peptide sequence at SEQ ID NO. 22873
  misc_feature (388)..(388): n is a, c, t, g, unknown, or other
  misc_feature (580)..(580): n is a, c, t, g, unknown, or other
  misc_feature (585)..(585): n is a, c, t, g, unknown, or other
  misc_feature (592)..(592): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
aaagctggagctccccgcggtggcggccgctctagaactagtggatcccccgggctgcaggaattcgcacgagaccattacctagaacatcctaatcgaaaaaacgcatttcgctccccacagcggctcggccacaacccacagccagacggtctcgagctggatctctaccgttcgtccgttccagcagacagcagtgcgcgctctctctctccctcgtggcgacgactgggcgaccgctgccgctgcccttgtgccccggtctccgtcggtccgttcgccaggtctcctgcgggctctttgtcgtcgacaagctccgccaggttgctgtgtgaagtccaaggttgtcacatggattcagcacaagatttccaacccaggacattcntctataaagttgtggccaccaagtgaaagcacacggatcatgcttgttgacaggatgacaaacaatctgtctacagagtccattttctctcgcaaatatcgccttttgggaaagcaagaggctcatgagaatgcaaaaacgattgaagaactttgctttgccttggctgatgagcatttcagagaggagcanatggntgatggnaagttctgctgtccagctatatgcaaaggaaacagcagatnnnttgtggaagttctgaaaaaggcccaggactactgcagaactggaggcactgtagctgacacactc

SEQ ID NO: 22873 - protein, 91 aa, Zea mays
  misc_feature: Ceres CLONE 1392833-F
  misc_feature (51)..(51): Xaa is any aa, unknown, or other
  misc_feature (53)..(53): Xaa is any aa, unknown, or other
  misc_feature (69)..(69): Xaa is any aa, unknown, or other
  misc_feature (70)..(70): Xaa is any aa, unknown, or other
MLVDRMTNNLSTESIFSRKYRLLGKQEAHENAKTIEELCFALADEHFREEXMXDGKFCCPAICKGNSRXXVEVLKKAQDYCRTGGTVADTL

SEQ ID NO: 22874 - DNA, 744 bp, Zea mays
  misc_feature: Ceres CLONE 1392834-F
  misc_feature: Encodes the peptide sequence at SEQ ID NO. 22875
  misc_feature (521)..(521): n is a, c, t, g, unknown, or other
  misc_feature (597)..(597): n is a, c, t, g, unknown, or other
aaagctggagctccccgcggtggcggccgctctagaactagtggatcccccgggctgcaggaattcgcacgagaccattacctagaacatcctaatcgaaaagtcgccagatctcccccagggacgcgctcatccttttgcctcccaactgtgctgtgcaggaacctgcggggaaggcggtcgctcgctcgctgagaggatgcctctggggctgacgctgggctcgctggggcggtcgatgcgccggaagcggctgtcctcgctcgacatcctctcctccaagcgggcgccgcgggattactacaagggcaagaactgcaagcccaccgggttccacacccgcaaaggtggatatgtgattgttgatgaaaagttgccaagatttgtggtccctgacttgactgatttcaagctgaaggcatacgtgtcacaatgcgccagggacctcacagcgtcgacagcatcctctacttcagcagaaagtactgaaagcaagagctgatctgatctttgcttgcggngaggcagcccaactctgaaagtatgtttccctagactgcccatgttccccgagatagcatcagcattctagctacnaacatttcagatatcttttcttgtaagggcaaacattatggcatacctagattcacttttcctggcttgagaggatgctctcgacgttgtcccttgtcggaaatcacccttttcaataatcaggtgaatgggtcaattccagagctc

SEQ ID NO: 22875 - protein, 100 aa, Zea mays
  misc_feature: Ceres CLONE 1392834-F
MPLGLTLGSLGRSMRRKRLSSLDILSSKRAPRDYYKGKNCKPTGFHTRKGGYVIVDEKLPRFVVPDLTDFKLKAYVSQCARDLTASTASSTSAESTESKS

SEQ ID NO: 22876 - DNA, 762 bp, Zea mays
  misc_feature: Ceres CLONE 1392836-F
  misc_feature (1)..(1): n is a, c, t, g, unknown, or other
  misc_feature (561)..(561): n is a, c, t, g, unknown, or other
  misc_feature (587)..(587): n is a, c, t, g, unknown, or other
  misc_feature (592)..(592): n is a, c, t, g, unknown, or other
  misc_feature (593)..(593): n is a, c, t, g, unknown, or other
  misc_feature (606)..(606): n is a, c, t, g, unknown, or other
  misc_feature (666)..(666): n is a, c, t, g, unknown, or other
  misc_feature (672)..(672): n is a, c, t, g, unknown, or other
  misc_feature (702)..(702): n is a, c, t, g, unknown, or other
natagctggagctccccgcggtggcggccgctctagaactagtggatcccccgggctgcaggaattcgcacgagaccattacctagaacatcctaatcgaaaaaagctcagtctgcagtttacaaatgctttgagtcctgcgctcctgtcctgctgttcttgtctagcagtaaacaagtcatttcctttgttgtcacatggtggctcgccgagtgctggtgcacacattctctcctcgttccaccttgctgctgctgctgcagttcttggcacggccttgtattgtataatatgattgtatcacatgccatgtgactatgtgagtagctgaccacggctcaccgcgaggcgcacaggtacagcagcgcaggcgcggcggcagcccgccgctggatctctcccgaggctccggcgatggagcggtcctgctacttcccgctgcggtgggagagcacgggcgaccagtggtggtacgcgtcgccgatagaactgggcggcggccgacggccactacgacatcgtccgccagctgctgcacctcgaccccaacctgctcatcangctcaccctccccccgccggatccgncgctnncgaggcgctggtnggacgacgacgccctgcttcgccgacgcggcccggaaacccgcgcgtccgtcgcccgcanccttgntggttgggaatgcaagtgcaagaaccacgnccccgggcgccggggaagacacgctgcttccgggccgggtaacggggggctggtggtcct

SEQ ID NO: 22877 - DNA, 745 bp, Zea mays
  misc_feature: Ceres CLONE 1392838-F
  misc_feature: Encodes the peptide sequence at SEQ ID NO. 22878
  misc_feature (377)..(377): n is a, c, t, g, unknown, or other
aaagctggagctccccgcggtggcggccgctctagaactagtggatcccccgggctgcaggaattcgcacgagaccattacctagaacatcctaatcgaaaaatgtaaaccacactccactccagcactgaacacttgattgattcagtgggtagctagctagctgaatcacaatggatcctaccaagttccgtccgtccagtagccacgacacgacggtgacgacgacgaacgctggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggngcctccgccaagggcttcttcgagtgcacccacgacgtgacgtcgctgacgtgcgccgacttcctgcgcgcgcccggcgtgcggacgcccgtgatcgtgcgcttctcgacggtgatccacgagcggggttccccggagacgatccgcgacccgcgcgggttcggcgtggagttctacacccgcgagggcaactgggacctgctgggcaacaacttccccgtcttcttcatccgcgacgggatcaaggtccccgacgtgatccacgcgttcaagcccaacccgcggtcgcacgggcaggagtactggcgggtgttcaacttcctggtcgcactccccgagaggctggacaccttcttcttcctcttcga

SEQ ID NO: 22878 - protein, 190 aa, Zea mays
  misc_feature: Ceres CLONE 1392838-F
  misc_feature (18)..(190): Pfam Name: Catalase Pfam Description: Catalase
  misc_feature: SWISSPROT Homolog: EC 1.11.1.6 Catalase
MDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFGVEFYTREGNWDLLGNNFPVFFIRDGIKVPDVIHAFKPNPRSHGQEYWRVFNFLVALPERLDTFFFLF

SEQ ID NO: 22879 - DNA, 716 bp, Zea mays
  misc_feature: Ceres CLONE 1392839-F
  misc_feature: Translation starting site: 229
  misc_feature (659)..(659): n is a, c, t, g, unknown, or other
aaagctggagctccccgcggtggcggccgctctagaactagtggatcccccgggctgcaggaattcgcacgagaccattacctagaacatcctaatctaaaagacaaccagacgcgccagggtttcaggcttccacgaatctccccgccgccctcaattcccctcggcgccgccgcctcctcccctcgcttcggtcctcggttagttaaccatccaggttctgtcaagatgtctgatagccatgagactgacaggaacattgagatttggaaaattaagaaactgatcaaggcattggaatcagccagaggcaatggcacaagcatgatctctctgatcatgcctccacgtgatcaggttgctcgagtggctaagatgttaggtgatgaatatggtactgcttcgaacatcaagagtagagttaatcgtcaatctgtgttggctgccatcacctcagctcagcagaggttgaagctctacaacaaagtgcctcctaacggattggttctgtacactggaactattgttactgaagacggaaaggaaaagaaagttactaattgattttgagccattcaagcctatcaatgatcactcctacctttgtgacaacaagttccacactgaggctttaaatgagctcttggatctgatgaacnagtttgggtcattggtatgggatgggatgggaactctttttggacactagtggaaaa

SEQ ID NO: 22880 - DNA, 742 bp, Zea mays
  misc_feature: Ceres CLONE 1392840-F
  misc_feature: Encodes the peptide sequence at SEQ ID NO. 22881
  misc_feature (315)..(315): n is a, c, t, g, unknown, or other
  misc_feature (338)..(338): n is a, c, t, g, unknown, or other
  misc_feature (490)..(490): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
aaagctggagctccccgcggtggcggccgctctagaactagtggatcccccgggctgcaggaattcgcacgagaccattacctagaacatcctaatcgaaaaaaagctcctcctcctctcctccctacacactccagagccagaggcagcacgtgctgccgtgctcgagcacagctaggccgcagctgcatcaccatggcgggcgcgccgctgcggagatcggaccttgacttcgccgacgtctttggcggcccgccgcgccgcgtgtctgggaacgagcaccgctcgcagcgcggctcgcaggacacctcgtcngtcgagtccgcgacgagggcggngaagcgcggaccggacacgcccgttttttcgggaccgggggagctccgaccgaagaagcagctcgggggaggagttctacaaggacatattccccgggagcgaggcagcgtcccccaggcggagcggcgcccgggatttggggggaattgtnccnnnggcgaaggcttccgcctgtctcaacggcccggccgcgatcgagcttcctccattcgggtcaacaggagggatgggacaggtcaatggcctacttcctccctctcagaaaatgtcaaacagaaaacggatgatggcccatcttaatgcttataggggttccaaactccccccatggcttccatgaaacattaatcctgggtcagggggcaccccgacaagaattccaaaaaaaaatccctcctcaggg

SEQ ID NO: 22881 - protein, 147 aa, Zea mays
  misc_feature: Ceres CLONE 1392840-F
  misc_feature (48)..(48): Xaa is any aa, unknown, or other
  misc_feature (99)..(99): Xaa is any aa, unknown, or other
  misc_feature (100)..(100): Xaa is any aa, unknown, or other
MAGAPLRRSDLDFADVFGGPPRRVSGNEHRSQRGSQDTSSVESATRAXKRGPDTPVFSGPGELRPKKQLGGGVLQGHIPRERGSVPQAERRPGFGGNCXXGEGFRLSQRPGRDRASSIRVNRRDGTGQWPTSSLSENVKQKTDDGPS

SEQ ID NO: 22882 - DNA, 714 bp, Zea mays
  misc_feature: Ceres CLONE 1392841-F
  misc_feature (410)..(410): n is a, c, t, g, unknown, or other
  misc_feature (477)..(477): n is a, c, t, g, unknown, or other
  misc_feature (478)..(478): n is a, c, t, g, unknown, or other
  misc_feature (497)..(497): n is a, c, t, g, unknown, or other
  misc_feature (581)..(581): n is a, c, t, g, unknown, or other
  misc_feature (587)..(587): n is a, c, t, g, unknown, or other
  misc_feature (591)..(591): n is a, c, t, g, unknown, or other
  misc_feature (686)..(686): n is a, c, t, g, unknown, or other
  misc_feature (700)..(700): n is a, c, t, g, unknown, or other
agagctggagctccccgcggtggcggccgctctagaatagtggatcccccgggctgcaggaattcgcacgagaccattacctagaacatcctaatcgaaaaaaaaattaaaacaaaccacattctctattctctcatcgaaagaccgccctctcgctctcgctctccaccgccgctagggtttccaccgcccccggcgatgggcgccctcactgacagccggaagcgtctctcggcggaccgctgcctctcggccgaccatcgcctcccctatccctcgttccccccaccgccccttacccctccctccaagcggaccaagctcgccccattccctgaactcgatccctccacctccgccgtcccgcctatccgtccttctccccaaatcatccactccgccgccgcggnatccgcctccttcacgccgggcccttcctccctcttcacatcgcttccaccccgcttccgcacaggnngcgactcccgccgccgccngcattgccgcgcccgatccacggcccacagcggatcctccgcgtcttccggcttggtggggctgcacggacccacggctgcggncgctcngtgntctccccgtcatcacccctgccttgttctctcggatcccagcaggacgtagagctcgtcaacagcgtctcccaccggggggcatccactcccggncggcacaacgatgntacgaggcaggcgg

SEQ ID NO: 22883 - DNA, 686 bp, Zea mays
  misc_feature: Ceres CLONE 1392843-F
  misc_feature: Encodes the peptide sequence at SEQ ID NO. 22884
  misc_feature (364)..(364): n is a, c, t, g, unknown, or other
  misc_feature (490)..(490): n is a, c, t, g, unknown, or other
  misc_feature (505)..(505): n is a, c, t, g, unknown, or other
  misc_feature (537)..(537): n is a, c, t, g, unknown, or other
tggagctccccgcggtggcggccgctctagaactagtggatcccccgggctgcaggaattcgcacgagaccattacctagaacatcctaatcgaaaagctgaactgctgacgcttcgcgcgggtccgaggtcaggcggcagcagcacggagtagcaccagggcgaccgcccaggttatcgtcggccgccggcgacctgtaccccggcgagaagatgcatctgagcgcgaacgaggggatcgagggtctgcgattcgcggtgacgggcgggcagggcttcgtcggagctgcccttcagctcgagctgctccgccgctgtgcccgcgaggtccggtccctcgatctccgcgcctcctcctcctggntccagcagctcctcgacgccggcgtccgaatcatccaaggggacataagaaaagaaggatgatgtgcgaaaggctttccggggagtggactgtgttttccaccttgcttcttatggcatgtcaggnaaggagatggtgcanactgggagatctgatgaggtaatataaatggnacctggcatgtactggacgcttgccatgaacaggatgtcaaaagggtttgggtatgtaaccaataacaatggggtattcggaggaaagccaattgcaaccgaaatgaggcgttcgcttattttcgattgaaaaacattggtgaggtttt

SEQ ID NO: 22884 - protein, 70 aa, Zea mays
  misc_feature: Ceres CLONE 1392843-F
  misc_feature (51)..(51): Xaa is any aa, unknown, or other
MHLSANEGIEGLRFAVTGGQGFVGAALQLELLRRCAREVRSLDLRASSSWXQQLLDAGVRIIQGDIRKEG

SEQ ID NO: 22885 - DNA, 750 bp, Zea mays
  misc_feature: Ceres CLONE 1392847-F
  misc_feature: Encodes the peptide sequence at SEQ ID NO. 22886
  misc_feature (362)..(362): n is a, c, t, g, unknown, or other
  misc_feature (391)..(391): n is a, c, t, g, unknown, or other
  misc_feature (401)..(401): n is a, c, t, g, unknown, or other
aaagctggagctccccgcggtggcggccgctctagaactagtggatcccccgggctgcaggaattcgcacgagaccattacctagaacatcctaatcgaaaaaaactcacagcacaaacgttcctctcctcttccatcgtcgtcctcgctcccggccccgcctgtctagtctagtcccctcttctcgcgtgcaacccctgtactgtacgtgctaggcacacagctagctgcagctacagcagggcagcaaatggtttctggtgcgggtcatggtgggtacggcggcggcgacgacgggcaggccgtcgacttcccgggcaacccggcggacaagtcgaggaccggagggctggctggcgccnggctgatccctggcacggagcttggcgancgcgtgtgcntgatgggcatctccatgaagctggtgacgtacctcgtcggggagctgccctctccaactccaggccgccaacggtgtgaccacttcatgggaacgctcaactggtcgccctcgtgggggtttcctcccaaggccaatttgggcggtacctcccaatggccattcccgcaaaattcccgccaggggggggttttgttagggggaaaacaaggggcccaaattggccccccccgggggttggaacccccgggcccgcgcgcgaaaatatggggcgccgcccccgggggaaaattgtgctcttttttcacccttttataaaaaggggggggggggccccggggtataaagga

SEQ ID NO: 22886 - protein, 155 aa, Zea mays
  misc_feature: Ceres CLONE 1392847-F
  misc_feature (38)..(38): Xaa is any aa, unknown, or other
  misc_feature (47)..(47): Xaa is any aa, unknown, or other
  misc_feature (51)..(51): Xaa is any aa, unknown, or other
MVSGAGHGGYGGGDDGQAVDFPGNPADKSRTGGLAGAXLIPGTELGXRVCXMGISMKLVTYLVGELPSPTPGRQRCDHFMGTLNWSPSWGFPPKANLGGTSQWPFPQNSRQGGVLLGGKQGAQIGPPRGLEPPGPRAKIWGAAPGGKLCSFFTLL

SEQ ID NO: 22887 - DNA, 713 bp, Zea mays
  misc_feature: Ceres CLONE 1392852-F
  misc_feature: Encodes the peptide sequence at SEQ ID NO. 22888
  misc_feature (114)..(114): n is a, c, t, g, unknown, or other
  misc_feature (257)..(257): n is a, c, t, g, unknown, or other
  misc_feature (302)..(302): n is a, c, t, g, unknown, or other
  misc_feature (565)..(565): n is a, c, t, g, unknown, or other
aagctggagctccccgcggtggcggccgctctagaactagtggatcccccgggctgcaggaattcgcacgagaccattacctagaacatcctaatcgaaaactctcgatccggnaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaggnagatcttcctccgcgagcttatctccaactcttccgatgcgctgnacaagatcaggttcgagagtctcactgacaagagcaagctcgatgcgcagcctgagcttttcatccaccttgtcccagacaagggcacgaacacgctctccatcatcgacagcggcatcggcatgaccaagtccgaccttgtcaaacaactcggtaccatcggcaggtccggaacgaggagttcatgggaaccccttgctgcccggcgctgatgtgtccatgattgccagttcggggtcgggttctactctgcctacctcgtncgcgatagagttgtcttgccaccaaccacacgatgacgaggcagacctgtgggagtcccaagggggggggtcttcccttgtactcgtgaccctcgggggaccacttgggaggggaataaaatccccctgttccttaggaggatcggtg

SEQ ID NO: 22888 - protein, 114 aa, Zea mays
  misc_feature: Ceres CLONE 1392852-F
  misc_feature (30)..(30): Xaa is any aa, unknown, or other
  misc_feature (45)..(45): Xaa is any aa, unknown, or other
MASETETFAFQAEINQLLSLIINTFYSNRXIFLRELISNSSDALXKIRFESLTDKSKLDAQPELFIHLVPDKGTNTLSIIDSGIGMTKSDLVKQLGTIGRSGTRSSWEPLAARR

SEQ ID NO: 22889 - DNA, 666 bp, Zea mays
  misc_feature: Ceres CLONE 1392863-F
  misc_feature: Encodes the peptide sequence at SEQ ID NO. 22890
  misc_feature (620)..(620): n is a, c, t, g, unknown, or other
aaacttggactccaccgcggtggcggccgctctagaactagtggatcccccgggctgcaggaattcgcacgagaccattacctagaacatcctaatcgaaaaatattctcccaaaaaacccaacactccagtggcggcaaagacctaacatttcaaaatcaatggccaagaaccccaaggcgcccgacacccgcagtggccgttctcccaccagaaggccccgaccacgccgcgccaaggcggtgccagaagcctcctccgcagctgatatcgaagacctggctccctcagtgcctggggccgctgcccctggcgctgccgcacccacggccctgcgcgcacagctgctccggtggtatgacgcgcaccgtagggacctgccgtggcgatgcgtaagcggcagcgaggaagagagggcgtacgcggtgtgggtgtccgaggtgatgctgcagcagacgcgggtgcccgtggtcgtcgcttactacgagcggtggatggcgcggtggccgaccgtacgaagcctcgccgccgctacgcaggaggaggtgaacgagatgtgggcgggtcttggctactaccgtagggctcgatttctgctggagggagcaaagcaatcatcngaaaaggggttgtttccttgcacggcgttagcccttcggtgaggtt

SEQ ID NO: 22890 - protein, 166 aa, Zea mays
  misc_feature: Ceres CLONE 1392863-F
MAKNPKAPDTRSGRSPTRRPRPRRAKAVPEASSAADIEDLAPSVPGAAAPGAAAPTALRAQLLRWYDAHRRDLPWRCVSGSEEERAYAVWVSEVMLQQTRVPVVVAYYERWMARWPTVRSLAAATQEEVNEMWAGLGYYRRARFLLEGAKQSSEKGLFPCTALALR

SEQ ID NO: 22891 - DNA, 635 bp, Zea mays
  misc_feature: Ceres CLONE 1392869-R
  misc_feature: Encodes the peptide sequence at SEQ ID NO. 22892
ccgggccccccctcgaggtcgacggtatcgatattttttttttttttttttctttttttttttttttttttttttttttttttttttttttttttttttttttttttttttttttttttttttttttccccccaagaaggaaatgtttaaatgaatgggggccccttttgaaaccaatggtcctttttaaaaaaaaaaaacaacaaacctttttaaggggggggggggggcaattaaacccaaaaggggggccccccccaaaaacgggagtttgccactttttgccccccccccccccggggccccaggggagggcccaattccccgccctggaaccagccccaaactttgggccccgggcggaaaaagctttaccccccgcccaaccaataaaccgggaaacattgaagcccccgcccttcccaaaaattgcccaggattccgggcaattccccgcgaaattggacagggtttccccccgggaaaggggaaacctttttccccccccgggggtgttgtgggggacaactgaaccccagcaaattccccttttgggccaaaaagttgggcacatgacccttgacatgggtgaacaaaaattggtggcccatcaggggaggctgggtgatttcccc

SEQ ID NO: 22892 - protein, 50 aa, Zea mays
  misc_feature: Ceres CLONE 1392869-R
RAPPRGRRYRYFFFFFFFFFFFFFFFFFFFFFFFFFFFFFFFPPKKEMFK

SEQ ID NO: 22893 - DNA, 632 bp, Zea mays
  misc_feature: Ceres CLONE 1392869-F
  misc_feature: Encodes the peptide sequence at SEQ ID NO. 22894
tccccgcggtggcggccgctctagaactagtggatcccccgggctgcaggaattcgcacgagaccattacctagaacatcctaatcaaaaaccaaaccagcgaggcagctaccgttttgtcgccatagcactcccgccgaccccctcgccgccgcctggaatggagaccagcaccaagaagcttagcagccttcgtatcacctccctggacgacgatgacgacgagaccgagatcccgcaccagccccctcaagcaggcctctccaccgctgaagcggattatgaggacgacgacgatgaggaggaagaagccgaagtgactcttggtgtccttagcaaaccgaagcacccaggcctcctcctccgccacttgttccccagcaaggccggtggcatcccggcgtggctagacccggtgaacttgccgtcgggaaagtccagctactgtggtttctgtggcgagcctctgcagttcgtcctccaggtgttttctttgtgtgcaatgaagttgccacactcgactgcttattgtttggatatcgacttggtcacagttaggcttggttgtgtttagatttatgcaccaattgaagataatgtagcagccttccaccgaacgctgttcatgttca

SEQ ID NO: 22894 - protein, 137 aa, Zea mays
  misc_feature: Ceres CLONE 1392869-F
METSTKKLSSLRITSLDDDDDETEIPHQPPQAGLSTAEADYEDDDDEEEEAEVTLGVLSKPKHPGLLLRHLFPSKAGGIPAWLDPVNLPSGKSSYCGFCGEPLQFVLQVFSLCAMKLPHSTAYCLDIDLVTVRLGCV

SEQ ID NO: 22895 - DNA, 750 bp, Zea mays
  misc_feature: Ceres CLONE 1392871-F
  misc_feature: Encodes the peptide sequence at SEQ ID NO. 22896
  misc_feature (530)..(530): n is a, c, t, g, unknown, or other
  misc_feature (600)..(600): n is a, c, t, g, unknown, or other
tttgtgccaccccccccggggcgccccccctacaccctcccggaataaataacacctgaactcaccgcggtggcggccgctctataatagtggatcccccgggctgcaggaattcgcacgagaccattacctagaacatcctaatcgaaaattgttgattgattgatcctccccgcctcactcctttgtctcctcgcctcgtgctcgctcgctcccctcgccctggcgaggagggcagcagaaaccctagcggctcaggccgggcgggggttagatgctccaaggttcgagagggaagggtaggttagtggtgcgccatcgactatgggctgcgtcttcggccgggcggctgcgtcgtcctctgcagcgccgaagaagaagtgggggaaggggaggtcgtccccgcagcccgaagcggggtcgccctccgcagtcgccgccaccgacggtgacgggaggccgcggtggcggctcgggggccgcagggcgtcgggaacccagcagggttgcgtccccgctggtgccgcgcnggaagaggtcccccgccggttggcccacgggggactcctccccttcgcccggggagggcccctccgcggnttgggagaacggggcccgaggcccgaaccctttcgggaaaaggcttttatacaaagaacagactccgggtaaaccgtaaccaggaaaaaagcgataaaccgggcgggaaaggtgtaaaccccggccccacatgggaggcccacggacccc

SEQ ID NO: 22896 - protein, 115 aa, Zea mays
  misc_feature: Ceres CLONE 1392871-F
  misc_feature (69)..(69): Xaa is any aa, unknown, or other
MGCVFGRAAASSSAAPKKKWGKGRSSPQPEAGSPSAVAATDGDGRPRWRLGGRRASGTQQGCVPAGAAXEEVPRRLAHGGLLPFARGGPLRGLGERGPRPEPFREKAFIQRTDSG

SEQ ID NO: 22897 - DNA, 685 bp, Zea mays
  misc_feature: Ceres CLONE 1392872-F
  misc_feature (426)..(426): n is a, c, t, g, unknown, or other
aagctggagctccccgcggtggcggccgctctagaactagtggatcccccgggctgcaggaattcgcacgagaccattacctagaacatcctaatcgaaaagtcatagagagccacaggccacaggcaagacaggcaggaggatcggacgagtcggcgaggaagctgcctgcttttcagatagagttattaagatggcgttgcttcggctgcttgccctgatctccctgctcttcgcagtggccactcctgtcagggacatcgcccacgatgcctgctcgtcagaagtgaaggatttccagcacctgaacaacagctcggggctccacctgacgctgcaccacccgcagagcccctgctccccggcgccgctgcccgccgacctccccttctccgcggtgctcgcccacgacggcgcgcgcatcgngtcgttcgccgcgcgcctcggccagacgccgtcctctcggccccctttgctgaccagagcggcgcggggtcgtcgtcgtcgccccccgatgacaagtccctcgcgtccgtgcccgttcggcccaggacagtccgccggcggggggcaattacctcacccccaaggggcccccggaacccccgggcaaagtcttaacgctttggggccggggaacaccgggtcccccccctccccccgggtccccacggggccccccccg

SEQ ID NO: 22898 - DNA, 665 bp, Zea mays
  misc_feature: Ceres CLONE 1392875-F
  misc_feature: Encodes the peptide sequence at SEQ ID NO. 22899
  misc_feature (369)..(369): n is a, c, t, g, unknown, or other
  misc_feature (370)..(370): n is a, c, t, g, unknown, or other
  misc_feature (410)..(410): n is a, c, t, g, unknown, or other
  misc_feature (411)..(411): n is a, c, t, g, unknown, or other
  misc_feature (427)..(427): n is a, c, t, g, unknown, or other
  misc_feature (486)..(486): n is a, c, t, g, unknown, or other
tggcggccgctctagaactagtggatcccccgggctgcaggaattcgcacgagaccattacctagaacatcctaatcgaaaacctttcgggcagaaagagccagagagagagagagagagaggtcggggctggggagcacacacccatcacccatggcctgactgacctccggactctccctgcttccgtcgccgccgcgggccgcccagctgactgctcctgccctccgcccgccctccatggcgtccgtcaagctcggctccaagcctgacgccttcaagcggcaaggccaggcatggttctgcacaacaggacttcctagcgatgtcaccgttgaggttggggatatgtctttccaccttcacaanngtcctttactttcaaaaagtgccttttctgaacggtcaanntgagaaaatctgaccnagaagaatgcatcatcaaactaaatgacattcctgggggggccagtcatttgagctagntgccaggtcctgctatggtgggaaaataaagcttccccctgccaaaggtgcctacctaacggggggccccaaagctttcaaaaaaggccggaaaaaaatccttggggaaaccccgggttgcccgcccaaaaaggtccccaaaccaggggggtccccggaaaagggaaaaattcccttga

SEQ ID NO: 22899 - protein, 56 aa, Zea mays
  misc_feature: Ceres CLONE 1392875-F
  misc_feature (43)..(43): Xaa is any aa, unknown, or other
  misc_feature (44)..(44): Xaa is any aa, unknown, or other
MASVKLGSKPDAFKRQGQAWFCTTGLPSDVTVEVGDMSFHLHXXPLLSKSAFSERS

SEQ ID NO: 22900 - DNA, 639 bp, Zea mays
  misc_feature: Ceres CLONE 1392885-F
  misc_feature: Encodes the peptide sequence at SEQ ID NO. 22901
ggcggccgctctagaactagtggatcccccgggctgcaggaattcgcacgagaccattacctagaacatcctaatcgaaaaatcattgcaaaagcgaagcaaagcaatcggaattctctgcgatttctctagatctcgactaccccccactagttttggttcctcctttcgttcgagagagcgattctggtggcaatggcgaagagcgagggtccggcgatcgggatcgacctcggcaccacctactcgtgcgtcggcgtgtggcagcacgaccgggtggagattatcgccaacgaccaggggaaccgcaccacgccgtcctatgtcggcttcaccgacaccgagcggctcatcggcgacgctgccaagaaccaggtcgccatgaaccccaccaacaccgtcttcgatgccaagcggttgatcggcaggaggttctctgatccgtcagtgcagagtgacatgaagctatggccgttcaaggtcatcccagggcctggtgacaagcccatgattgtagtgaactacaagggcgaggagaagcagtttgctgctgaggagatctcctccatggtcctcatcaagatgaaggagattgctgaagcctaccttggttccaccatcaagaacgcagtggtgaca

SEQ ID NO: 22901 - protein, 148 aa, Zea mays
  misc_feature: Ceres CLONE 1392885-F
MAKSEGPAIGIDLGTTYSCVGVWQHDRVEIIANDQGNRTTPSYVGFTDTERLIGDAAKNQVAMNPTNTVFDAKRLIGRRFSDPSVQSDMKLWPFKVIPGPGDKPMIVVNYKGEEKQFAAEEISSMVLIKMKEIAEAYLGSTIKNAVVT

SEQ ID NO: 22902 - DNA, 650 bp, Zea mays
  misc_feature: Ceres CLONE 1392886-F
  misc_feature: Encodes the peptide sequence at SEQ ID NO. 22903
  misc_feature (573)..(573): n is a, c, t, g, unknown, or other
cgcggtggcggccgctctagaactagtggatcccccgggctgcaggaattcgcacgagaccattacctagaacactaatcgaaaaatcttcaccattggtgccaagttcataaatatcagatctggtgataaaccatgaccggaaaaaagaccacggtctcctctgtcggccgcactcgaaagaaggccaaggtggtgttggaggatgaggaagaggcagggttggaagatgaggaagaggtgactgtgacattatccgtggagaaggacgcgctggagtgcgacatctgctgcctacccttccagtccgaagttttcgtgtgcaagaacgggcattctggatgtgcaaaatgctgcatccgcacggacggtaagtgctggacctgttccgagcgcattgacgacatgcgttaccgtccgctcgagaagctcctggcggcggcgaccacctcctgcatgttcaagagcaacggctgctacgacgccatcagctacctggagaaggtgacccacgaggagacatgccagcgcgcgccgtacaagtgccccgtcgacggctgcgcctatagcggnctgcggctcggctaccacgtcgcacaggaccacggccacgacgacgacggcctcgcctccgtcgtctttatctacgg

SEQ ID NO: 22903 - protein, 171 aa, Zea mays
  misc_feature: Ceres CLONE 1392886-F
MTGKKTTVSSVGRTRKKAKVVLEDEEEAGLEDEEEVTVTLSVEKDALECDICCLPFQSEVFVCKNGHSGCAKCCIRTDGKCWTCSERIDDMRYRPLEKLLAAATTSCMFKSNGCYDAISYLEKVTHEETCQRAPYKCPVDGCAYSGLRLGYHVAQDHGHDDDGLASVVFIY

SEQ ID NO: 22904 - DNA, 603 bp, Zea mays
  misc_feature: Ceres CLONE 1392887-F
  misc_feature: Encodes the peptide sequence at SEQ ID NO. 22905
  misc_feature (456)..(456): n is a, c, t, g, unknown, or other
  misc_feature (466)..(466): n is a, c, t, g, unknown, or other
  misc_feature (523)..(523): n is a, c, t, g, unknown, or other
  misc_feature (603)..(603): n is a, c, t, g, unknown, or other
tccccgcggtggcggccgctctagaactagtggatcccccgggctgcaggaattcgcacgagaccattacctagaacatcctaatcgaagtatctgaccacgtcacacgacaccaccaccagccctccccttcatcaattggagcacggcgcccgttcattcccctcttctccgctgcttgcctccggctccccaattccacgagatctccaattccaccgcgtcgtctctgcatccggaccccataccccgatcgatccctaaggcccatggttttctccgccgccgcgtcgcctctagtagccaccgctgctgactctgcttcctcctgcgtcgcccacctccgctgctgctgtcgcgttagttgctgccgttgttgaagacgcgtagctctttagggttcgcgatttctcgctgatcggttcgagaattggtaagctatggatctctcgcggnccacatcgtncgacctctcgctcgggctccactctcacggtcacgcccacgcccacggtcgaagggnacgcgtaagcgccgcgctgcgcctgttcgacgacgcgaaggaaccaaaacccgaacgcgtcctgccccgaaaggccgacn

SEQ ID NO: 22905 - protein, 54 aa, Zea mays
  misc_feature: Ceres CLONE 1392887-F
  misc_feature (6)..(6): Xaa is any aa, unknown, or other
  misc_feature (9)..(9): Xaa is any aa, unknown, or other
  misc_feature (28)..(28): Xaa is any aa, unknown, or other
MDLSRXTSXDLSLGLHSHGHAHAHGRRXRVSAALRLFDDAKEPKPERVLPRKAD

SEQ ID NO: 22906 - DNA, 758 bp, Zea mays
  misc_feature: Ceres CLONE 1392888-F
  misc_feature (28)..(28): n is a, c, t, g, unknown, or other
  misc_feature (29)..(29): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (36)..(36): n is a, c, t, g, unknown, or other
  misc_feature (37)..(37): n is a, c, t, g, unknown, or other
  misc_feature (59)..(59): n is a, c, t, g, unknown, or other
  misc_feature (60)..(60): n is a, c, t, g, unknown, or other
  misc_feature (546)..(546): n is a, c, t, g, unknown, or other
  misc_feature (547)..(547): n is a, c, t, g, unknown, or other
  misc_feature (577)..(577): n is a, c, t, g, unknown, or other
  misc_feature (642)..(642): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
tttgttgttgctcctccctgttgcccgnngnnnngnngtgccgggcggccccccccccnntgttttttttcaaactgaagctccccgcggtggcggccgctctataactagtggatcccccgggctgcaggaattcgcacgaaccattacctagaacatcctaatcgaaaaaatcagtgctcgctagcccaccacgccctgaacctagcccggacaccagccagaacaggccatgtccatgggctccccggtgcagttcaggcgcctgaaagctctgtaccaggtccggggtgaacaaaatcctggccaacgggggccggggccgttcccccccgggggccctggttcaggggggtccccccctcgggcccccaaagaaaatttggggggttccggggggggacactttgtttttgggggggggtttttttcgggggggggggggaaaaaaggtgttttttactttaagttccccccccccccccccccgggggggccccgggggggaaaaaaaaaaggggttgtcctccccaccaccccccccanncaggggccgcgccccccccccttcggcgtnttttttgtgggggagacccccccccgccgggggggggggggggttttttttctaaaaaaaaaaanacggtcccactatataaaacacccccctcctccacgtgagagggcgccgcgcccccccccgagtgnnnagagaaagacaagaggggggtgccccacaaaaaaaaaacaaccacacg

SEQ ID NO: 22907 - DNA, 658 bp, Zea mays
  misc_feature: Ceres CLONE 1392893-F
tggagctccaccgcggtggcggccgctctagactagtggatcccccgggctgcaggaattcgcacgagaccattacctagaacatcctaatcgaaaaattccgcgccgcatctgggaaggtctcgtcttgctcggctccgtccgtcgccgcacactggtgcctcgtccggcctatgaatatggatgtccgccgcaggcttccaccgccgcacgtgagcgtccctaggcgccagcaggcgaccaggcccgagtgaaagtgggtgccggggcacgcgaaagatgcgctaccgatgctgatccgggacatgaacctcttcttctcggtgctgatggccgcgtcgctggtgcacctgatgcttctacgccccccctaagagcggcgcgtgcacccccatgcactcgctcctctacggcaggagttgcgaaatgcgagctgctctgcctctccagtacctcgacccggctgtcggagcggctaagtaattgcgggcgaccccgcagccaacacgcccgaggataaatggtcccactccgacgacggcgcgggcggccaaatcgagaacgactgaccacatcggccgcaggagtggtgggcaccccctgacacacgatggcagcccacagtggagccaggcgcccgaggtgagccccacccaca

SEQ ID NO: 22908 - DNA, 675 bp, Zea mays
  misc_feature: Ceres CLONE 1392898-F
  misc_feature (356)..(356): n is a, c, t, g, unknown, or other
  misc_feature (385)..(385): n is a, c, t, g, unknown, or other
  misc_feature (386)..(386): n is a, c, t, g, unknown, or other
tccccgcgggtggcggccgctctagaactagtggatcccccgggctgcaggaattcgcacgagaccattacctagaacatcctaatcgaaaaaatgaccattgcgtgatagatcgcaccggtctcggtctccgtgtctcactctcaagttgcagcagccagtcatttcgttggcaaccagggcagaaataaatatccgtggataagagctgcgctgtgtgctgctgagatatcaagaacggtagggtggaagacaaggccccgttctcgattaacccaagccaaagagtcagagggagagagagagagagagtcgtattggtcgtcacctgtcgaaggttttcggtgtctcctganccacagctgctgctgctgctgaaccatgnnagatgaggccgtgaagtcccacggggcgccggtcgccggacgccaaagagggatcgcggaatctcctgggcctggggctcattctgggaggaacttgttccaagtctttgcctaaattcccgggggcgacgaaccgggggaattacctcaaggccccctggcccaagggaaaaaacccgcggagagggggcccaaaaggggggtggggaagggggtatatccggggtttggggccgctttttcgcgagggttttttttgggaaaaaaggagaacacccctctcttggtg

SEQ ID NO: 22909 - DNA, 679 bp, Zea mays
  misc_feature: Ceres CLONE 1392900-F
  misc_feature: Encodes the peptide sequence at SEQ ID NO. 22910
  misc_feature (493)..(493): n is a, c, t, g, unknown, or other
  misc_feature (496)..(496): n is a, c, t, g, unknown, or other
  misc_feature (497)..(497): n is a, c, t, g, unknown, or other
  misc_feature (514)..(514): n is a, c, t, g, unknown, or other
  misc_feature (641)..(641): n is a, c, t, g, unknown, or other
aagctggagctccccgcggtggcggccgctctagaactagtggatcccccgggctgcaggaattcgcacgagaccattacctagaacatcctaatcgaaaaactcttcccttcctgcatttcctcctctgtctcatcggggacccctgtccctcgtggcgacggccggtcgaccgccgctgccgaggacttcgccggcgacgaccacccccacgcccactacattatatgttgaagaatggcttggagctaacagtactgacaccaacttttggttatgatcagaagcgactggagtgcagtaatgaatctctaattgtttgcaatataagaaccagatacctcattcaaatggtttttccatgttacagattggtagccaagaacaaagagaaaaacacacaacagtaatgggtcacgaccatatgtctcgtataaagatgcatatggcagaaggttcttttggtgacagggatccggtgccagcaactggntgnnaatggaggtgtcgatanaaaagggtagtgttactgcaaaatcacaggggggaagaggtgtcatgcccaaacagttcagttccctcccagagccggatgggaaaaggtccagggtttatcttgggcgccctgttaacgacgggcnatttttaaggggatctggttccaatttgcaagcagtgc

SEQ ID NO: 22910 - protein, 95 aa, Zea mays
  misc_feature: Ceres CLONE 1392900-F
  misc_feature (45)..(45): Xaa is any aa, unknown, or other
  misc_feature (46)..(46): Xaa is any aa, unknown, or other
  misc_feature (51)..(51): Xaa is any aa, unknown, or other
  misc_feature (94)..(94): Xaa is any aa, unknown, or other
MLQIGSQEQREKHTTVMGHDHMSRIKMHMAEGSFGDRDPVPATGXXWRCRXKRVVLLQNHRGEEVSCPNSSVPSQSRMGKGPGFILGALLTTGXF

SEQ ID NO: 22911 - DNA, 653 bp, Zea mays
  misc_feature: Ceres CLONE 1392901-F
  misc_feature: Encodes the peptide sequence at SEQ ID NO. 22912
  misc_feature (599)..(599): n is a, c, t, g, unknown, or other
tccccgcggtggcggccgctctagaactagtggatcccccgggctgcaggaattcgcacgagaccattacctagaacatcctaatcaaaaagcaattgtttccaggtaatctcgcatcagcaaacagcaccggtctccgttcaccgccttgccttctcttctccggttcctcccccgcgcgttcgctcgctctcgtggcgcaactcgtagaccgccgccgcctccgctctacgccaggtgcctaggtctagcttcgtcggtcccttcgccaacgacgagcacccacccgaagttcagctaggagtgcatcttgtttacctgttgcttaatcatggacaactctcagaatcaaccaccaccacctggtgttggaacatggacgcaggcacctcctagtcacccgccacaatgccatgctgatccacagtcttatcatccacaatttgctgctagacctgacaatgctagtgccaataaatagtggtagttcagcaaacattgagtcagctgtccaggaggctgttctatcacgcgcaggacattgagactcagcaagtcatacagaatcaaagacatgcaaacacaacaagtgaactacnaaattatggggaaagacttactttcgaaaccgccgtgacctaaaatgcattgga

SEQ ID NO: 22912 - protein, 49 aa, Zea mays
  misc_feature: Ceres CLONE 1392901-F
MDNSQNQPPPPGVGTWTQAPPSHPPQCHADPQSYHPQFAARPDNASANK

SEQ ID NO: 22913 - DNA, 641 bp, Zea mays
  misc_feature: Ceres CLONE 1392902-F
  misc_feature: Encodes the peptide sequence at SEQ ID NO. 22914
  misc_feature (324)..(324): n is a, c, t, g, unknown, or other
tggagctccccgcggtggcggccgctctagaactagtggatcccccgggctgcaggaattcgcacgagaccattacctagaacatcctaatcgaaaatctctatgacacgtgccccttcccccctcttaagctaagggacccttgggcagcccggcatcttctccaatctccaccctctgcccctctcgatttcttcttcccatctcccgatccatcgcaacccaaaccctactccaggcagatctccgtctccgccgacgctgccggcgtgagcacagcatcagatccgctgtgatggcgttccgccgcatcctatccaccgncggtgcgccgccgctcggccgtggccgccgcggcggccgggaacgcgcgcgaggcctccacggccgtcgctgcggcgccaggtgtgctcgcccccgatgcgaccgcggtgcgcgctcccgtgatgccgtatgaccgcatcgccgaggccgtcaacgtcaggctccggcggctcgagcacccagacccgcgcttcctccgatacgccgggcccgtggcgtcccacgccggacacatgtgcatccttgctgcgcgggagacgcgggtcaccacactgcccaacgggctgggcatcgccacggagtcttccctcgccgcg

SEQ ID NO: 22914 - protein, 65 aa, Zea mays
  misc_feature: Ceres CLONE 1392902-F
MPYDRIAEAVNVRLRRLEHPDPRFLRYAGPVASHAGHMCILAARETRVTTLPNGLGIATESSLAA

SEQ ID NO: 22915 - DNA, 682 bp, Zea mays
  misc_feature: Ceres CLONE 1392904-F
  misc_feature: Translation starting site: 238
  misc_feature (260)..(260): n is a, c, t, g, unknown, or other
  misc_feature (414)..(414): n is a, c, t, g, unknown, or other
  misc_feature (457)..(457): n is a, c, t, g, unknown, or other
  misc_feature (458)..(458): n is a, c, t, g, unknown, or other
  misc_feature (491)..(491): n is a, c, t, g, unknown, or other
  misc_feature (494)..(494): n is a, c, t, g, unknown, or other
  misc_feature (585)..(585): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
aaagctggagctccccgcggtggcggccgctctagaactagtggatcccccgggctgcaggaattcgcacgagaccattacctagaacatcctaatcgaaaagtcccacccgcttcggcctctccctcctcctcgctcgctcgatcgctcccacgtcctcgcctccctccacaaaccaccaccaccatccaggatcgcagcgcggcgcgcgagagaggggtgagcaggtcgggcaagatgagggagatcctgcacatccngggcggccagtgcggcaaccagatcggcgccaagttctgggaggtgatctgcggcgagcactgcgttgactccacgggccgctactcggggacctcctcgcagcagctcgagctcgagcggatcaacgtctacaccacgagggctgggggtggncgctatgtgcccccgcggcgtgctcatggacctggagcccggnnacatggaaatccatccgcgcgggccccttcggnggnatcttcccgccccgacactttgtctacgggcaggtccgggcgcggggaacaactgggggcaagggcacttaacacggaggggcggcgagtncatcgactcccnnncccttggacggcccgggggcaagggaaggccgaaaaactgcactggccctccaaggggttccaagtatgcaccctcccccggg

SEQ ID NO: 22916 - DNA, 602 bp, Zea mays
  misc_feature: Ceres CLONE 1392909-F
  misc_feature: Translation starting site: 181
  misc_feature: Pfam Name: DCP1 Pfam Description: Dcp1-like decapping family
  misc_feature (222)..(222): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (501)..(501): n is a, c, t, g, unknown, or other
  misc_feature (534)..(534): n is a, c, t, g, unknown, or other
  misc_feature (576)..(576): n is a, c, t, g, unknown, or other
tccccgcggtggcggccgctctagaactagtggatcccccgggctgcaggaattcgcacgagaccattacctagaacatcctaatcgaaaaacccgaatcccttcgatccaatctccaaaccctaggcagcccgctatcagattgttaggttctccttccttaaaccgcggcggccggccatgtcccacggcggcttcggcgggagggcgaaagtgacgcgnaacctggcggtggacggcgagggcacgcggacgctcaatctcaccgtgctgcagcgcctcgaccacgccgttgaggacatcctcatcaccgcggctcacgtcacgctctacgacttcgacaccgacatcaaccagtggagccggaggaacggtggaggnnntcgctctttgtcgtcaagaggaatgctcaacccagattcccagttcattgtcatgaatcgcaggaatacagataatctagttgaagatctttttgggagattttgaataccaactacnagctccttatataatgtaccgcaatgctgctcnagaagtataggaaatctggttttacatttcccaggagtgtcnacaggttgcaaatctttcagcaggat

SEQ ID NO: 22917 - DNA, 709 bp, Zea mays
  misc_feature: Ceres CLONE 1392916-F
  misc_feature: Encodes the peptide sequence at SEQ ID NO. 22918
  misc_feature (403)..(403): n is a, c, t, g, unknown, or other
  misc_feature (416)..(416): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (433)..(433): n is a, c, t, g, unknown, or other
  misc_feature (434)..(434): n is a, c, t, g, unknown, or other
  misc_feature (436)..(436): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (502)..(502): n is a, c, t, g, unknown, or other
  misc_feature (503)..(503): n is a, c, t, g, unknown, or other
  misc_feature (594)..(594): n is a, c, t, g, unknown, or other
tggagctccccgcggtggcggccgctctagaactagtggatcccccgggctgcaggaattcgcacgagaccattacctagaacatcctaatcaaaaaaaagcgatgcgcagctccgtaaccacttcgtcctcacttctcagtccaccttcccaccgcaaccacttcaccacctcctcacagtcccagcaatggagctagtagcgtggctcgtcatcgtgtcctcagtatccctcgctgggctcctgccagtggtctcggcgtcgacgacgacaccgcagcagcaatgtggcggcaataatgtcggacctgccggagtgagagcaggctacctggtcgccgtcctcgaacgctttactccgcggtcggcagcattcgaacgcgtccctgtacacgcacctcacntaacagcgcgggnaccatcgacgaannnanntngtgggcgggtcgcgccgccttccgcgaaaagggccggaggnnngccctcgctgctcgcccgccttnntcttggggggggggtaagggtccggggaggcccgtcccacagggaaccggtggctggtccgttgggcacggaccaagaaacgggggtgggnccgagtccaaacggcgcctttctccagggaatggcggtccgaacggcggccctccccgggcgggtggttcaatcacctccctcccctgggacctgggccccgcgcccaagggctt

SEQ ID NO: 22918 - protein, 173 aa, Zea mays
  misc_feature: Ceres CLONE 1392916-F
  misc_feature (72)..(72): Xaa is any aa, unknown, or other
  misc_feature (76)..(76): Xaa is any aa, unknown, or other
  misc_feature (80)..(80): Xaa is any aa, unknown, or other
  misc_feature (81)..(81): Xaa is any aa, unknown, or other
  misc_feature (82)..(82): Xaa is any aa, unknown, or other
  misc_feature (83)..(83): Xaa is any aa, unknown, or other
  misc_feature (97)..(97): Xaa is any aa, unknown, or other
  misc_feature (105)..(105): Xaa is any aa, unknown, or other
MELVAWLVIVSSVSLAGLLPVVSASTTTPQQQCGGNNVGPAGVRAGYLVAVLERFTPRSAAFERVPVHAPHXTARXPSTXXXXGRVAPPSAKRAGGXPSLLARLXLGGGVRVRGGPSHREPVAGPLGTDQETGVGPSPNGAFLQGMAVRTAALPGRVVQSPPSPGTWAPRPRA

SEQ ID NO: 22919 - DNA, 650 bp, Zea mays
  misc_feature: Ceres CLONE 1392925-F
  misc_feature: Encodes the peptide sequence at SEQ ID NO. 22920
tggagctccccgcggtggcggccgctctagaactagtggatcccccgggctgcaggaattcgcacgagaccattacctagaacatcctaatcgaaaaaccttggcttgctatttcgccaacaacctcctccctctttaccgcggcgtgccgcgtgcggcgggcgcggatgaaaacggccgcctccgcctccccctcccccggcgcgttcgtcgccaaaacccctgtcccagcccgtgtgctgagcacgcacccggtcctgaccccgagccccgcattcgcgaggtcttcgtcgcgcacccccgcctgcggcaggtcctgcgccagtctccacatcggaggcctgggctcgaccagcagcagcatcgcccgcagcggcaggaacggaaccgttctccacgtgcccccacggtcgcgccgctcgtcgtgactaagatgggcggctccatgaagacccataagaaggtcctgctcttctactgcgaggagatgcggcacctcgctgcagcaggtgttccgcccgcaacaatgacatcgaactgcgatccatctcatgtaggacaattcccggacgaatacccggattctgtgcatctcgaatgacaataaaaattcgggggccagcccggttgccttttttggctccgttgaa

SEQ ID NO: 22920 - protein, 86 aa, Zea mays
  misc_feature: Ceres CLONE 1392925-F
  misc_feature: SWISSPROT Homolog: EC 2.7.6.1 Ribose-phosphate diphosphokinase
MKTAASASPSPGAFVAKTPVPARVLSTHPVLTPSPAFARSSSRTPACGRSCASLHIGGLGSTSSSIARSGRNGTVLHVPPRSRRSS

SEQ ID NO: 22921 - DNA, 664 bp, Zea mays
  misc_feature: Ceres CLONE 1392926-F
  misc_feature: Encodes the peptide sequence at SEQ ID NO. 22922
  misc_feature (339)..(339): n is a, c, t, g, unknown, or other
  misc_feature (472)..(472): n is a, c, t, g, unknown, or other
  misc_feature (532)..(532): n is a, c, t, g, unknown, or other
  misc_feature (564)..(564): n is a, c, t, g, unknown, or other
  misc_feature (645)..(645): n is a, c, t, g, unknown, or other
  misc_feature (664)..(664): n is a, c, t, g, unknown, or other
ggagctccccgcggtggcggccgctctagaactagtggatcccccgggctgcaggaattcgcacgagaccattacctagaacatcctaatcgaaaaaaaaatcccagccttttgtttgcttctctgtctcctgctgattggtgtccccgggtccaggactcttgatttgctcctcgcgggggttcggtcccatggcggcagctgcgctggcaatggcagagcaggtggtggccgagctccgagtgaggtgtgagacgccgccgtcgatgctgcgcgaggtggccgtggagatggcccgcgagatgggcgcggggctggagaaggacggcgggagcaggntcaagatgctcctctcctacgtcgataagctccccacagggagagaggaaggattattctatggattggacctaagaggaacgaatttccgcgtcttgaaagtgcaactaagtgggaatgcgaagcatgtcgntgaccgtgactccagagaagtcggcattccgccacatctgatgtcagggagctcctcggnagctttttggtttcattgcttctgaattgggncaagtttgttgacgatgatgagaagtgcgctaacatttcgaatgggcagagcgagaataagggttcacgttttcgttcaangggaagcagcgttctgtan

SEQ ID NO: 22922 - protein, 121 aa, Zea mays
  misc_feature: Ceres CLONE 1392926-F
  misc_feature (3)..(121): Pfam Name: Hexokinase_1 Pfam Description: Hexokinase
  misc_feature: SWISSPROT Homolog: EC 2.7.1.1 Hexokinase
  misc_feature (50)..(50): Xaa is any aa, unknown, or other
  misc_feature (94)..(94): Xaa is any aa, unknown, or other
  misc_feature (114)..(114): Xaa is any aa, unknown, or other
MAAAALAMAEQVVAELRVRCETPPSMLREVAVEMAREMGAGLEKDGGSRXKMLLSYVDKLPTGREEGLFYGLDLRGTNFRVLKVQLSGNAKHVXDRDSREVGIPPHLMSGSSSXAFWFHCF

SEQ ID NO: 22923 - DNA, 661 bp, Zea mays
  misc_feature: Ceres CLONE 1392931-F
  misc_feature: Encodes the peptide sequence at SEQ ID NO. 22924
  misc_feature (269)..(269): n is a, c, t, g, unknown, or other
  misc_feature (371)..(371): n is a, c, t, g, unknown, or other
  misc_feature (372)..(372): n is a, c, t, g, unknown, or other
  misc_feature (594)..(594): n is a, c, t, g, unknown, or other
aaagctggagctccccgcggtggcggccgctctagaactagtggatcccccgggctgcaggaattcgcacgagaccattacctagaacatcctaatcgaaaagtcgcctcatcaattcaagatccaatctttgctgctgccactcggcgatccgatcgttctcgagcaaggtcggtggccatggcacgctgccgccatcacctcctcctcctttccgtcttacttgccttggctgctgctgctgcgcggcaggcgcagagtcatggaanagcctccgccgtcttcatcgatgcctcgtcgcaccgctaccttcgggaccagcaagccgaccaccaggacgcttcaatgtcgttaaatgagttttcctgggnntgtttctgtctttgcttggtttcgcaccgtcaacatccctaccagctattcctttcttcgaagttgaacaaagttcttcttcctaatccatttgatagacccgcgtgctgttttcctcgtgcaaattgatggggttcaatgttcctagcttcgtatctgaaggcagcaacattttcaagaccaaggattgaaggtgcaaacatcgctgatacagggcttaangataaggatggacttatttgtcattcattcagaggaatctctagatctctctcgatcagattatctt

SEQ ID NO: 22924 - protein, 106 aa, Zea mays
  misc_feature: Ceres CLONE 1392931-F
  misc_feature (30)..(30): Xaa is any aa, unknown, or other
  misc_feature (64)..(64): Xaa is any aa, unknown, or other
MARCRHHLLLLSVLLALAAAAARQAQSHGXASAVFIDASSHRYLRDQQADHQDASMSLNEFSWXCFCLCLVSHRQHPYQLFLSSKLNKVLLPNPFDRPACCFPRAN

SEQ ID NO: 22925 - DNA, 653 bp, Zea mays
  misc_feature: Ceres CLONE 1392932-F
  misc_feature: Encodes the peptide sequence at SEQ ID NO. 22926
  misc_feature (561)..(561): n is a, c, t, g, unknown, or other
  misc_feature (634)..(634): n is a, c, t, g, unknown, or other
tggagctccccgcggtggcggccgctctagaactagtggatcccccgggctgcaggaattcgcacgagaccattacctagaacatcctaatcaaaaaatcccaaatagttactccactcccctcacccctcccgactcccgtgctctctctctctctctctctcggatccgaattgccagcgcaccagtcgagctcgcgggaactcgccggcaccggcgatggcctccgccctactggcgggacagggcggggcgcgccaccacggctgtggggagacgcgcgccccactcgcgcccatacctcccaaccctaaccccagccagccccacccgcgcgccgacgggtccaagtccaagccgcgggcggcagcctcctcgccggcggacggatacgtgacgttccgcccgacgtccctgggcccgcgcgaggcccgcgcgctccgtgaccgcctcgcgggggagctcacccaggtgcgcgccctcctctcccgcatcgacacctggcagcagaagggcccgccgcccgcggggctccgcggggaagtgcggaagcggtgcggncagatcctcaccaggctgcacaggaccagggggaacgtgtggttcacgcgcccggcgaggggggacccccccnccctccaagaataacccgt

SEQ ID NO: 22926 - protein, 142 aa, Zea mays
  misc_feature: Ceres CLONE 1392932-F
  misc_feature (139)..(139): Xaa is any aa, unknown, or other
MASALLAGQGGARHHGCGETRAPLAPIPPNPNPSQPHPRADGSKSKPRAAASSPADGYVTFRPTSLGPREARALRDRLAGELTQVRALLSRIDTWQQKGPPPAGLRGEVRKRCGQILTRLHRTRGNVWFTRPARGDPPXLQE

SEQ ID NO: 22927 - DNA, 661 bp, Zea mays
  misc_feature: Ceres CLONE 1392933-F
  misc_feature: Translation starting site: 177
  misc_feature: SWISSPROT Homolog: EC 2.3.1.15 Glycerol-3-phosphate O-acyltransferase
  misc_feature (426)..(426): n is a, c, t, g, unknown, or other
  misc_feature (486)..(486): n is a, c, t, g, unknown, or other
  misc_feature (532)..(532): n is a, c, t, g, unknown, or other
tggagctccccgcggtggcggccgctctagaactagtggatcccccgggctgcaggaattcgcacgagaccattacctagaacatcctaatagaaaaactgccaactcgcacgcagcagtacgacgtctctcctctgggtctggggccgagacaccgagcacgtactaccagcaagatggtggcgtctcccagattcaagcccatcgaggagtgctgctcggaggggcggtcggagcagacggtggccgccgacctggacggcacgctgctcatctccaggagcgcgttcccctactacctcctcgtggctctcgaggccggcagcgtcctccgcgccgcgctgctgctcctgtccgtgccgttcgtctacgtcacctacgccttcttctccgagtcgctggccatcagcacgctggtgtacatcntccgtggcggggctcaaggtgcgcagcatctagatggtggcgcgctccgtgctccccagnttctacgcgggcgacgtgcacccggagagctttggagggtgttcanctccttcggcaggcgctacgtcgtcacggccagccccaggggtcatggtcgagcccttcgccagggccctcctaggcgccgacaaggtcgtcgggaccgaagctggaggtccgcagggacggcaagccc

SEQ ID NO: 22928 - DNA, 693 bp, Zea mays
  misc_feature: Ceres CLONE 1392934-F
  misc_feature (205)..(205): n is a, c, t, g, unknown, or other
  misc_feature (228)..(228): n is a, c, t, g, unknown, or other
  misc_feature (229)..(229): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (239)..(239): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (243)..(243): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (247)..(247): n is a, c, t, g, unknown, or other
  misc_feature (248)..(248): n is a, c, t, g, unknown, or other
  misc_feature (249)..(249): n is a, c, t, g, unknown, or other
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (256)..(256): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (277)..(277): n is a, c, t, g, unknown, or other
  misc_feature (278)..(278): n is a, c, t, g, unknown, or other
  misc_feature (279)..(279): n is a, c, t, g, unknown, or other
  misc_feature (281)..(281): n is a, c, t, g, unknown, or other
  misc_feature (283)..(283): n is a, c, t, g, unknown, or other
  misc_feature (284)..(284): n is a, c, t, g, unknown, or other
  misc_feature (285)..(285): n is a, c, t, g, unknown, or other
  misc_feature (286)..(286): n is a, c, t, g, unknown, or other
  misc_feature (287)..(287): n is a, c, t, g, unknown, or other
  misc_feature (288)..(288): n is a, c, t, g, unknown, or other
  misc_feature (289)..(289): n is a, c, t, g, unknown, or other
  misc_feature (290)..(290): n is a, c, t, g, unknown, or other
  misc_feature (291)..(291): n is a, c, t, g, unknown, or other
  misc_feature (292)..(292): n is a, c, t, g, unknown, or other
  misc_feature (293)..(293): n is a, c, t, g, unknown, or other
  misc_feature (294)..(294): n is a, c, t, g, unknown, or other
  misc_feature (296)..(296): n is a, c, t, g, unknown, or other
  misc_feature (297)..(297): n is a, c, t, g, unknown, or other
  misc_feature (313)..(313): n is a, c, t, g, unknown, or other
  misc_feature (323)..(323): n is a, c, t, g, unknown, or other
  misc_feature (327)..(327): n is a, c, t, g, unknown, or other
  misc_feature (328)..(328): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (334)..(334): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (387)..(387): n is a, c, t, g, unknown, or other
  misc_feature (402)..(402): n is a, c, t, g, unknown, or other
  misc_feature (404)..(404): n is a, c, t, g, unknown, or other
  misc_feature (407)..(407): n is a, c, t, g, unknown, or other
  misc_feature (408)..(408): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (436)..(436): n is a, c, t, g, unknown, or other
  misc_feature (440)..(440): n is a, c, t, g, unknown, or other
  misc_feature (478)..(478): n is a, c, t, g, unknown, or other
  misc_feature (487)..(487): n is a, c, t, g, unknown, or other
  misc_feature (489)..(489): n is a, c, t, g, unknown, or other
  misc_feature (495)..(495): n is a, c, t, g, unknown, or other
  misc_feature (496)..(496): n is a, c, t, g, unknown, or other
  misc_feature (507)..(507): n is a, c, t, g, unknown, or other
  misc_feature (508)..(508): n is a, c, t, g, unknown, or other
  misc_feature (530)..(530): n is a, c, t, g, unknown, or other
  misc_feature (565)..(565): n is a, c, t, g, unknown, or other
  misc_feature (566)..(566): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (579)..(579): n is a, c, t, g, unknown, or other
  misc_feature (581)..(581): n is a, c, t, g, unknown, or other
  misc_feature (590)..(590): n is a, c, t, g, unknown, or other
  misc_feature (591)..(591): n is a, c, t, g, unknown, or other
  misc_feature (610)..(610): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (627)..(627): n is a, c, t, g, unknown, or other
  misc_feature (648)..(648): n is a, c, t, g, unknown, or other
  misc_feature (651)..(651): n is a, c, t, g, unknown, or other
  misc_feature (653)..(653): n is a, c, t, g, unknown, or other
  misc_feature (666)..(666): n is a, c, t, g, unknown, or other
tggagctccccgcggtggcggccgctctagaactagtggatcccccgggctgcaggaattcgcacgagaccattacctagaacatcctaatcgaaaaactgcagtctccagagtctagagacctccaccgtccactccaaagacgagcagcgggcaaacccaagcacccgcccaatccggttcgccttccttctcaccccgcccnggacttcccttgtgccggggggnnannnaaaggnnnnnnnnnnnnnnnnangggggggggggggggggnnnnnngngnnnnnnnnnnnngnnggggggggggccgccngccccccccncccnncnnncncnnngggggggggggggggggggggnnnnnnncnnnnnnnnnnnnnncnnncnccccccccccccccncnccnncnnnccccggcgcggggggggggggggngggngggcccggccgcggcccccccggccccggcgggggggnggggggggngngggggnnggggggggggnnccccgccggccggggcgggccncggggggcggggggcggggggcgggggggcggggnncgggnnnnnnccncnccccccggnnccccccccccccccccccnccgcccnnnggccgggnccggcgggggggcgccggcgnccncnggggggcgggccnccccgggcggggggggggggggcgggg

SEQ ID NO: 22929 - DNA, 611 bp, Zea mays
  misc_feature: Ceres CLONE 1392938-F
  misc_feature: Translation starting site: 282
  misc_feature: Pfam Name: Adaptin_N Pfam Description: Adaptin N terminal region
  misc_feature (215)..(215): n is a, c, t, g, unknown, or other
  misc_feature (289)..(289): n is a, c, t, g, unknown, or other
  misc_feature (335)..(335): n is a, c, t, g, unknown, or other
  misc_feature (388)..(388): n is a, c, t, g, unknown, or other
  misc_feature (556)..(556): n is a, c, t, g, unknown, or other
  misc_feature (611)..(611): n is a, c, t, g, unknown, or other
aagctggagctccccgcggtggcggccgctctagaactagtggatcccccgggctgcaggaattcgcacgagaccattacctagaacatcctaatcaaaaaattcgtcgctaatcacaatcccgatctccaagcaaacccacctcccgtcagttccctactcgccgatccagatctcctacagctttccactccgccactccaaccggacgcctncgccgtcgccggcggcggtcgagccacgcgcgcacgccgctgaggaacccggagagggcggcggcaatggagangctgcggacgttcgggcgggagctggcgatggggtcgcagggcggntgggggcagtccaaggatttcctcgacctcgtcaagtctatcggcgaggcgcngctccaggcggaggaggaccgcatcatcgcgcgcgagcttgagcacctcaagcgccgcctggcccgaccccgacgtgccacgccgcaagatgaaggagcttctcctccgcctagtctacgccgagatgctcggccacgacgcttccttcggccacatccacgccgtcnagatgacccacgacgagtcgctaccgctcaagcgtaccggctacctcgccgtcgn

SEQ ID NO: 22930 - DNA, 641 bp, Zea mays
  misc_feature: Ceres CLONE 1392939-F
tggagctccccgcggtggcggccgctctagaactagtggatcccccgggctgcaggaattcgcacgagaccattacctagaacatcctaatcaaaaatcgagctgagctgagcatcatggggtagtgtgtgtgtgaggcgatagagaagctagtgctcataaccaaccaccactcagtcctcctcctctaccctttcccttccgccgcgttcctacttggtcctagagggagagagatctcgaactccaagggcggcatgctccggttgctagctacgatgccgtgtgcgtagctgcggcagcccttgatcgatcaatcgatcgcttgtgcggaatgagccggatcgagtggagtcagctagtagaatattccggtgggcggtcggtcgtcgttggacgtacgcccagaagagggagctagagaagaataccgtacagctgctttccacatggcagctggctcgtctgcccaactggtcggactcggcgacgggcaaatggagatgcagccgcaccagcaggcaggcgccgccctccttcctcttgggaaaaaacccggggcggggccgccgccaaaaaaaaaaaagggaaaccaccccgggggaacccaaaaacccctgggtgtaaaagggggggggggg

SEQ ID NO: 22931 - DNA, 659 bp, Zea mays
  misc_feature: Ceres CLONE 1392947-F
  misc_feature: Encodes the peptide sequence at SEQ ID NO. 22932
  misc_feature (434)..(434): n is a, c, t, g, unknown, or other
  misc_feature (447)..(447): n is a, c, t, g, unknown, or other
aaagctggagctccccgcggtggcggccgctctagaactagtggatcccccgggctgcaggaattcgcacgagaccattacctagaacatcctaatcgaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggccgggacgccggctcgcgggccttctcggtgcgcgtgcgccggcgcctgccggacttcctgcagtcggtgaaccctcagtacgtgcgcctcgggtaccactacctcatcaggccacggggtggacctggccaccatccccgtcatcgttggtggtgtgcggnccccccacttggncaggctcagccggcgacgaggtgtggcgcaagggggtgggggggaaggccaccttaggaccccgcgaccgggggtccgcctttctcggcgggcctcggctttccccatttcccgttaaattagggggcagggcccaggcccgggtacctccttcggattgtgaatggtaaaaggccggcgaaaagatttagggggtcccaggggggggtttc

SEQ ID NO: 22932 - protein, 98 aa, Zea mays
  misc_feature: Ceres CLONE 1392947-F
  misc_feature (76)..(76): Xaa is any aa, unknown, or other
MAREEQALLSTEIVNRGVEPSGRDAGSRAFSVRVRRRLPDFLQSVNPQYVRLGYHYLIRPRGGPGHHPRHRWWCAXPPLGQAQPATRCGARGWGGRPP

SEQ ID NO: 22933 - DNA, 675 bp, Zea mays
  misc_feature: Ceres CLONE 1392949-F
  misc_feature (173)..(173): n is a, c, t, g, unknown, or other
  misc_feature (197)..(197): n is a, c, t, g, unknown, or other
  misc_feature (223)..(223): n is a, c, t, g, unknown, or other
  misc_feature (224)..(224): n is a, c, t, g, unknown, or other
  misc_feature (273)..(273): n is a, c, t, g, unknown, or other
  misc_feature (278)..(278): n is a, c, t, g, unknown, or other
  misc_feature (583)..(583): n is a, c, t, g, unknown, or other
  misc_feature (585)..(585): n is a, c, t, g, unknown, or other
  misc_feature (586)..(586): n is a, c, t, g, unknown, or other
  misc_feature (598)..(598): n is a, c, t, g, unknown, or other
  misc_feature (619)..(619): n is a, c, t, g, unknown, or other
  misc_feature (625)..(625): n is a, c, t, g, unknown, or other
  misc_feature (626)..(626): n is a, c, t, g, unknown, or other
  misc_feature (631)..(631): n is a, c, t, g, unknown, or other
  misc_feature (632)..(632): n is a, c, t, g, unknown, or other
  misc_feature (636)..(636): n is a, c, t, g, unknown, or other
  misc_feature (637)..(637): n is a, c, t, g, unknown, or other
  misc_feature (639)..(639): n is a, c, t, g, unknown, or other
  misc_feature (645)..(645): n is a, c, t, g, unknown, or other
  misc_feature (646)..(646): n is a, c, t, g, unknown, or other
  misc_feature (648)..(648): n is a, c, t, g, unknown, or other
  misc_feature (649)..(649): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (670)..(670): n is a, c, t, g, unknown, or other
tggagctccccgcggtggcggccgcttctagaactaagtggatcccccgggcttgcaggaattcgcacgagaccattacctaagaacattcctaaatcgaaaaaaaagctggcagtgtcggtgtcggtgtcgtcgtcggcgtcggtgctggggagcgggcgagcggcgcgtcncatgattctgtcctcctgacgtgncagctaacgattccgattccctttgnntgcagtgcgacgacattgacatggacatggcgcagctggagtgggctgncgggnctcttcgacgacgcatccatcccgcacgagccggggtttcccggggccggggcccatcatcaagaggctccccgcttgggggccggggggctttttgccgccggaaaaaagagggggcacccttttttttttcccaattccagccccctattcggggggtggggaacgggaaattttttcaaagccccaagggggggggggggggggggtggtcccccgctttctgaaaaatttcccccggggggcctctgcccccgaaagtttttttccccgggggggggagggggaaaaaacctctggggggncnncccccccctttnccccccccccccttgtttttntaatannggggnngggnngnaaaaanncnnccccccccccccccnnnnntnaaggt

SEQ ID NO: 22934 - DNA, 684 bp, Zea mays
  misc_feature: Ceres CLONE 1392954-F
  misc_feature: Encodes the peptide sequence at SEQ ID NO. 22935
  misc_feature (299)..(299): n is a, c, t, g, unknown, or other
  misc_feature (305)..(305): n is a, c, t, g, unknown, or other
  misc_feature (373)..(373): n is a, c, t, g, unknown, or other
  misc_feature (380)..(380): n is a, c, t, g, unknown, or other
  misc_feature (383)..(383): n is a, c, t, g, unknown, or other
  misc_feature (394)..(394): n is a, c, t, g, unknown, or other
  misc_feature (408)..(408): n is a, c, t, g, unknown, or other
  misc_feature (530)..(530): n is a, c, t, g, unknown, or other
  misc_feature (543)..(543): n is a, c, t, g, unknown, or other
  misc_feature (611)..(611): n is a, c, t, g, unknown, or other
tggagctccccgcggtggcggccgctctagaactagtggatcccccgggctgcaggaattcgcacgagaccattacctagaacatcctaatcgaaaagatccgatggcccgcgccgccgctcgcctcctccccatcttcctcccatggcggcgtcctcccccgccctgcctcctccgccggggcttcctaaaccctagcagccccagaacctccgcgcgcgtcgacaccctcgttctccctggagacgagcgcttgcccttcccctcgcccccacgcctcccgaaccagctgcgtctgnactacnggagtggggcggcggaggcggcgctccctcgaccatcgcggccatcgtcccctcactcggcgaggccntgcagcnggntggggaaatcntgcggatctccggncccgtggggccgtcgggcgtcgccgggaacggcggttttccgcccagccggggacccaggagggcggtccgacgcccgtggcaaccgcgcagcccaccttttgttggagtaacggactcgcngctccgacgcggnacggcagcgttaaatggacgaaggtttttgggtggtgcccaatgttcctccccggaggtcctacacgncgaagagggatggttgtgggacctttcagggccctggccaacgaatctctgctttgcgcccgcgtggctcaga

SEQ ID NO: 22935 - protein, 138 aa, Zea mays
  misc_feature: Ceres CLONE 1392954-F
  misc_feature (66)..(66): Xaa is any aa, unknown, or other
  misc_feature (68)..(68): Xaa is any aa, unknown, or other
  misc_feature (93)..(93): Xaa is any aa, unknown, or other
  misc_feature (94)..(94): Xaa is any aa, unknown, or other
  misc_feature (102)..(102): Xaa is any aa, unknown, or other
MARAAARLLPIFLPWRRPPPPCLLRRGFLNPSSPRTSARVDTLVLPGDERLPFPSPPRLPNQLRLXYXSGAAEAALPRPSRPSSPHSARPCSXXGKSCGSPXPWGRRASPGTAVFRPAGDPGGRSDARGNRAAHLLLE

SEQ ID NO: 22936 - DNA, 665 bp, Zea mays
  misc_feature: Ceres CLONE 1392955-F
  misc_feature (363)..(363): n is a, c, t, g, unknown, or other
  misc_feature (387)..(387): n is a, c, t, g, unknown, or other
  misc_feature (392)..(392): n is a, c, t, g, unknown, or other
  misc_feature (405)..(405): n is a, c, t, g, unknown, or other
  misc_feature (430)..(430): n is a, c, t, g, unknown, or other
  misc_feature (431)..(431): n is a, c, t, g, unknown, or other
  misc_feature (515)..(515): n is a, c, t, g, unknown, or other
tccccgcggtggcggccgctctagaactagtggatcccccgggctgcaggaattcgcacgagaccattacctagaacatcctaatcaaaagctaagatgttatacttcatgcttaaatatgcaatggagattatcaacaaaaaatgcaatagtgattttgctttcagagtcaaatgttacgagcagttactatttcagctggaatacaacaacaatggcaacatttctagcaatccttgggattcacggttcttcctgttggaacataaattagcaaaatgtttgatgcgaacacaaggttgacttggtcccttggtggttcgagttgatgaatgagtgattgtcaatgggtagcattctaangggtagtcagtggactgactaagntgagnattatgtttgtgnaaaccatgtcggtcgaacttgtggnnggtgccaggtgtggagcacaaggaacgggtggtcgaatggctgaaggtgaatgtcattggcggctccgtggctgatggactggnaaccgatgaaaggaagcattgctggatctttgactggatgggatcaaagcagccaggtgaaccaaccggcggtggcttgacacctaggaaacgcacctggtaccaagggccgtggggggaaaaaaaccctggttgccgccttggttccaa

SEQ ID NO: 22937 - DNA, 656 bp, Zea mays
  misc_feature: Ceres CLONE 1392956-F
  misc_feature: Encodes the peptide sequence at SEQ ID NO. 22938
tggagctccccgcggtggcggccgctctagaactagtggatcccccgggctgcaggaattcgcacgagaccattacctagaacatcctaatcgaaaaactgattccgagtccatctttccccgccgccggccgtgatccctcctcgccgctgaccgccccgcctgccccggcattctcccgctccagatccagggccctcatagagcctccgctcgatctgccccccggatcggattggccgccgcacatctcatgggtgaggaagctgtccacttcagcgtcgtcgacgccaacgactgcaaacagagtgcctttgaagtcggcgataagacgtatgttatttgtagatcagatgatgatttgaaaacatctgctgttaaaattcacgacaagctcactcagacttgggtctcacccacaatacttggggaacagccacttctaaccaagtcacagtctgtgaattcctgtcagtgatgagaagatattagttatcggagaaggttgttcccttgaatgagtccatctggttccttgagatagacaccccctttgttaagcaacaacggaaatcaggaaaacagaagttgtttcttggagcaagggagtaatcggcgtcggcaaaaaccgtggtggttaggggcccttctggggt

SEQ ID NO: 22938 - protein, 74 aa, Zea mays
  misc_feature: Ceres CLONE 1392956-F
MGEEAVHFSVVDANDCKQSAFEVGDKTYVICRSDDDLKTSAVKIHDKLTQTWVSPTILGEQPLLTKSQSVNSCQ

SEQ ID NO: 22939 - DNA, 668 bp, Zea mays
  misc_feature: Ceres CLONE 1392957-F
  misc_feature: Translation starting site: 152
  misc_feature: SWISSPROT Homolog: EC 2.7.7.13 Mannose-1-phosphate guanylyltransferase
  misc_feature (348)..(348): n is a, c, t, g, unknown, or other
  misc_feature (606)..(606): n is a, c, t, g, unknown, or other
  misc_feature (607)..(607): n is a, c, t, g, unknown, or other
aaagctggagctccccgcggtggcggccgctctagaactagtggatcccccgggctgcaggaattcgcacgagaccattacctagaacatcctaatcgaaaagtgtctcttccccccaccactccgccaccggcgccgaagcagagcagccatggccggctccgagcagcgcgtcgtcgccgtcatcatggtcggcggccccaccaaagggacgcggttccggccgctgtcgctgaacgtgcccaagccgctcttccctatcgccggccagcccatggtgcaccaccccatctccgcctgcagccggatcccccacctggcacagatatacctcatcgggttctatgnaggagcgggagttcgcgctctatgtctcgtctatctcccacgagctcaggatccctgtcaggtacctacgagaggataagcctcacgggtcagctggagggctctacagctttagagatacatcatggaagacagtcggtcacacatagttctgctggattggcgacgtctggtctagcttccctcttcagacatgctagaggccataaaaagtatgggagggatgggtactttactagtcaacaggtatcagcaagnncagcaaaccagtttcggggagttggtagctgatcctgaaacaaatgaactgctgcactata

SEQ ID NO: 22940 - DNA, 689 bp, Zea mays
  misc_feature: Ceres CLONE 1392958-F
  misc_feature: Encodes the peptide sequence at SEQ ID NO. 22941
  misc_feature (371)..(371): n is a, c, t, g, unknown, or other
  misc_feature (451)..(451): n is a, c, t, g, unknown, or other
  misc_feature (467)..(467): n is a, c, t, g, unknown, or other
  misc_feature (494)..(494): n is a, c, t, g, unknown, or other
  misc_feature (503)..(503): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (512)..(512): n is a, c, t, g, unknown, or other
  misc_feature (513)..(513): n is a, c, t, g, unknown, or other
  misc_feature (518)..(518): n is a, c, t, g, unknown, or other
  misc_feature (529)..(529): n is a, c, t, g, unknown, or other
  misc_feature (530)..(530): n is a, c, t, g, unknown, or other
  misc_feature (557)..(557): n is a, c, t, g, unknown, or other
  misc_feature (558)..(558): n is a, c, t, g, unknown, or other
  misc_feature (610)..(610): n is a, c, t, g, unknown, or other
aagctggagctccccgcggtggcggccgctctagaactagtggatcccccgggctgcaggaattcgcacgagaccattacctagaacatcctaatcgaaaaaatgatgaagttggcgattctttgcatcgaagcatccagccgaggaaatcaacggttacaattggatggttggtccgaccacaatcaatcttagtcgcacaacgcgcctccctgctccagttttccattccttgcgcccccttcagatccgatctgatccacgccggcgagacaccggaggaccgccatgacgctcagcctccgtcgcaagcagctcgatgttatcgtgcggatgctgcacctgaaccagcagcagttgccgaacggcgncgagggacagggagaggacgatgcgtacaagatccctggttatggatccgccctgtatctcatccctctcgcctgtgctncagctcggcgactccncccaccaaggtgtcaccctcacctcgncatcgatgntcgnnnggnnagcgntgcccgatggnnccggccgtttataattcgtcggccacnncccccgggaaacggggaccccggggtaaccgccgaaccccccgccggggggnccttcaagggtgttttttccaaggtaaaattttttcccaacctccgtcccggggaccccgtgttttagagcggcctcgc

SEQ ID NO: 22941 - protein, 129 aa, Zea mays
  misc_feature: Ceres CLONE 1392958-F
  misc_feature (28)..(28): Xaa is any aa, unknown, or other
  misc_feature (55)..(55): Xaa is any aa, unknown, or other
  misc_feature (60)..(60): Xaa is any aa, unknown, or other
  misc_feature (69)..(69): Xaa is any aa, unknown, or other
  misc_feature (72)..(72): Xaa is any aa, unknown, or other
  misc_feature (74)..(74): Xaa is any aa, unknown, or other
  misc_feature (75)..(75): Xaa is any aa, unknown, or other
  misc_feature (77)..(77): Xaa is any aa, unknown, or other
  misc_feature (81)..(81): Xaa is any aa, unknown, or other
  misc_feature (90)..(90): Xaa is any aa, unknown, or other
  misc_feature (108)..(108): Xaa is any aa, unknown, or other
MTLSLRRKQLDVIVRMLHLNQQQLPNGXEGQGEDDAYKIPGYGSALYLIPLACAXARRLXPPRCHPHLXIDXRXXSXARWXRPFIIRRPXPPGNGDPGVTAEPPAGGXFKGVFSKVKFFPNLRPGDPVF

SEQ ID NO: 22942 - DNA, 681 bp, Zea mays
  misc_feature: Ceres CLONE 1392961-F
  misc_feature: Encodes the peptide sequence at SEQ ID NO. 22943
  misc_feature (390)..(390): n is a, c, t, g, unknown, or other
  misc_feature (403)..(403): n is a, c, t, g, unknown, or other
  misc_feature (404)..(404): n is a, c, t, g, unknown, or other
  misc_feature (450)..(450): n is a, c, t, g, unknown, or other
  misc_feature (489)..(489): n is a, c, t, g, unknown, or other
  misc_feature (510)..(510): n is a, c, t, g, unknown, or other
  misc_feature (543)..(543): n is a, c, t, g, unknown, or other
tggagctccccgcggtggcggccgctctagaactagtggatcccccgggctgcaggaattcgcacgagaccattacctagaacatcctaaaaaaaaaggaattctgccttcttctctcatcttcctgctcaacatcagtagcagctttagctgtagcagcgccaccggccaccgccacgctatggccaccacgttgcacaagcccctgggggcgatcaccgttgacgacctcgccgcggcggcgcctgggtcggacgccaccgcgctccacgcagcgctccggcgcgcgctcgactcgcacggacccaccgaagtgtggggcgagctcctgccggtccgtgctcctgtccgtctgccccccttcgcgtccaccggatgctctactacggntgctttcgcccgnnttccccgtctcccacgccgcccgcctggacgcccgacccccaaggnaggctgtcttgaccaatggtcggccgtgtccttcgaggncgcgtggtaggggacttcatncggcgacgccgtacaagggatcccatcaccagncttcccagaacctcccacaagttctccaacgagaaacccagagggcgtactggaaagatggaattttgaggatatgggtatcccatttcagcggagaggcatcctgcatctggagagaggacactgcatatcctgggg

SEQ ID NO: 22943 - protein, 105 aa, Zea mays
  misc_feature: Ceres CLONE 1392961-F
  misc_feature (70)..(70): Xaa is any aa, unknown, or other
  misc_feature (75)..(75): Xaa is any aa, unknown, or other
  misc_feature (90)..(90): Xaa is any aa, unknown, or other
  misc_feature (103)..(103): Xaa is any aa, unknown, or other
MATTLHKPLGAITVDDLAAAAPGSDATALHAALRRALDSHGPTEVWGELLPVRAPVRLPPFASTGCSTTXAFARXPRLPRRPPGRPTPKXGCLDQWSAVSFEXAW

SEQ ID NO: 22944 - DNA, 668 bp, Zea mays
  misc_feature: Ceres CLONE 1392966-F
  misc_feature (171)..(171): n is a, c, t, g, unknown, or other
  misc_feature (235)..(235): n is a, c, t, g, unknown, or other
  misc_feature (236)..(236): n is a, c, t, g, unknown, or other
  misc_feature (258)..(258): n is a, c, t, g, unknown, or other
  misc_feature (270)..(270): n is a, c, t, g, unknown, or other
  misc_feature (280)..(280): n is a, c, t, g, unknown, or other
  misc_feature (353)..(353): n is a, c, t, g, unknown, or other
  misc_feature (359)..(359): n is a, c, t, g, unknown, or other
  misc_feature (603)..(603): n is a, c, t, g, unknown, or other
tggagctccccgcggtggcggccgctctagaactagtggatcccccgggctgcaggaattcgcacgagaccattacctagaacatcctaatcgaaaaaaaacgccccacagcgcaagcgagcagatcctcctccctttctgcttcctggcatcctctctggcctcccgcgncgatctcgagcacctggggagaccgcgagacgtgcgcctgatttttctcatcgcagcagccctnncagtccccaccctcttttttcntgcagctttcantaaatctggntatttagctacatctttattttacttttcatttacccttaaacccggttaagtcccatggcatcctcggcggntgcggnaaaaaatgggggggtccttggccccgggggctctgggccttttgggcccaaacggggggggcggggaaaccctccccctctcctctaaaaaaaaagcccccggggggggggggggcgggccccccttttttggaggggagggggattcggcgccaaatgtggggggggggagaaaaaagaaaccccacaaccccctggccaaagggttctggggaaaaattttccccccgcggggggggggggngggagaaaataaaatagtgggggaacacctttctcgggggggcccccggggggaaaaaaagaaaa

SEQ ID NO: 22945 - DNA, 658 bp, Zea mays
  misc_feature: Ceres CLONE 1392967-F
  misc_feature: Encodes the peptide sequence at SEQ ID NO. 22946
  misc_feature (524)..(524): n is a, c, t, g, unknown, or other
  misc_feature (608)..(608): n is a, c, t, g, unknown, or other
tggagctccccgcggtggcggccgctctagaactagtggatcccccgggctgcaggaattcgcacgagaccattacctagaacatcctaatcgaaaaaagggctctacacgaagttaggcggccaagtgttcgcaaccaacccctcttcctcgcccactgaaaggttcagaggctcccgttttagcatagcgaccgagacgaaggagtgggggggcggagagctttgggccctggccaggatgaagtttatgagactcggcacccggccggacaccttcttcaccgccgccgactccgtgaggtctgtctgcacggaggtggccacggacctgcagatcctcgtggataactgcctctaccatctccacaaggtaattagctcaaggatcgtcagagatcgtgcccaccctttggcctttattcaggaatttgatctttagtttaggatcgttcattacagtgggatcccgtctaggcttttgttcggtttttcacggattggagacccagaataattcctagncggattacttctctaatttatataaattttgatgagttggaacgaaaccggggtttattccataagaaacgaacgccccctagnaaaagggagaagccccccccgggcgatcttgagattaaggactctttctg

SEQ ID NO: 22946 - protein, 66 aa, Zea mays
  misc_feature: Ceres CLONE 1392967-F
MKFMRLGTRPDTFFTAADSVRSVCTEVATDLQILVDNCLYHLHKVISSRIVRDRAHPLAFIQEFDL

SEQ ID NO: 22947 - DNA, 658 bp, Zea mays
  misc_feature: Ceres CLONE 1392969-F
  misc_feature: Translation starting site: 203
  misc_feature: Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
  misc_feature (252)..(252): n is a, c, t, g, unknown, or other
  misc_feature (265)..(265): n is a, c, t, g, unknown, or other
  misc_feature (479)..(479): n is a, c, t, g, unknown, or other
tggagctccccgcggtggcggccgctctagaactagtggatcccccgggctgcaggaattcgcacgagaccattacctagaacatcctaatcgaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcgncgtggagccgcgnggcccggacgccggctcgcgtgccttctcggtgcgcgtgcgccgccgcctgccggacttcctgcagtcggtgaacctcaagtacgtgcgcctcgggtaccactacctcatcagccacggagtgtacctggccaccatccccgtcatcgtggctggtgtgcggcgccgagctgggcagcctcagtcgcgacgagctgtggcgcagggtgtagggntcgaggccacctacgacctcgccagcgtgctcgccttcctcgccgtcctcgcctgcaccatcgtacgtctacatcatgtccaggcccaggcccgtgtacctcatcgacttcgcatgctacaagccgggcgacgagctctaggtgtccaagggaggaattcatcgacttggcgcgcaagg

SEQ ID NO: 22948 - DNA, 660 bp, Zea mays
  misc_feature: Ceres CLONE 1392973-F
  misc_feature (209)..(209): n is a, c, t, g, unknown, or other
  misc_feature (214)..(214): n is a, c, t, g, unknown, or other
  misc_feature (215)..(215): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (475)..(475): n is a, c, t, g, unknown, or other
  misc_feature (502)..(502): n is a, c, t, g, unknown, or other
  misc_feature (503)..(503): n is a, c, t, g, unknown, or other
tggagctccccgcggtggcggccgctctagaactagtggatcccccgggctgcaggaattcgcacgagaccattacctagaacatcctaatcgaaaacggtttcattttgtagctcaaagctcaaaggtgaggctagggtttctttgcgccaaaccagcgaggcagcgactgttttgtcgccacaacactcccgccgaccccctcgccngccgnnccgggaaaatgggaagnnnnacccagcactaagaagcttagcagcccttcgtatcacctccctggatgacgatgacgaagagaccgagatcccgcaccagccccctcaaggaggcctctccccccgctggaggcggatttatggaggaaccgaccgaaccaattgaagggaaggaagaacgccgaagtgactcttggtgtctttaggaaaccggagcaccccagggctcccctccctccgcccactttgtttcccccacnaaagagcccggcacgccccccggggtnnttaaaagcccgggaaaattgccccgccgaaaagcccaaatatggggctttttttgggggggaccctcccgaagggccccccccaatatttggccccccatggaaaaaaagatggccccccctcctccccccaaagagggggttttttttttttgccc

SEQ ID NO: 22949 - DNA, 666 bp, Zea mays
  misc_feature: Ceres CLONE 1392979-F
  misc_feature: Encodes the peptide sequence at SEQ ID NO. 22950
  misc_feature (291)..(291): n is a, c, t, g, unknown, or other
  misc_feature (460)..(460): n is a, c, t, g, unknown, or other
  misc_feature (528)..(528): n is a, c, t, g, unknown, or other
  misc_feature (529)..(529): n is a, c, t, g, unknown, or other
  misc_feature (571)..(571): n is a, c, t, g, unknown, or other
aaagctggagctccccgcggtggcggccgctctagaactagtggatcccccgggctgcaggaattcgcacgagaccattacctagaacatcctaatcgaaaaattccccccgcgggcgacgaagaacatcactgtagactgaccaaattccccgcgggcttgcggccaaacctttcaccatcggtcggcgaggccgcaccctcccgtgcatgtcactcctgccggcgccgggcgtcctatggtagagactcgccgctcagcgcggaggagcggcagcggttcgctcccggncgacggagcgccgtccgagccggcatccagctcccctgcaacctccctccccccgcgggagaataatggcttggttatctctaatggacacacattgaagcagaccgtggaggtaaaaaaacaggagaggcaaggtaagggagtcttagtggttcatgaattggatgangtgaatgaggattctgggtcactggatgagccgccgggttggcttcctgacgggtggactatggaggnnttgtcaagaaggacatggctccatctacaagtactacacttnccccgagtgtccgatacatgttcacatcaaagatggagacattgcattatcttttctcaggggtgggagaacgtatgtttgagttgcaggagtca

SEQ ID NO: 22950 - protein, 142 aa, Zea mays
  misc_feature: Ceres CLONE 1392979-F
  misc_feature (18)..(18): Xaa is any aa, unknown, or other
  misc_feature (74)..(74): Xaa is any aa, unknown, or other
  misc_feature (97)..(97): Xaa is any aa, unknown, or other
  misc_feature (111)..(111): Xaa is any aa, unknown, or other
MVETRRSARRSGSGSLPXDGAPSEPASSSPATSLPPRENNGLVISNGHTLKQTVEVKKQERQGKGVLVVHELDXVNEDSGSLDEPPGWLPDGWTMEXLSRRTWLHLQVLHXPRVSDTCSHQRWRHCIIFSQGWENVCLSCRS

SEQ ID NO: 22951 - DNA, 664 bp, Zea mays
  misc_feature: Ceres CLONE 1392982-F
  misc_feature: Encodes the peptide sequence at SEQ ID NO. 22952
  misc_feature (405)..(405): n is a, c, t, g, unknown, or other
  misc_feature (494)..(494): n is a, c, t, g, unknown, or other
  misc_feature (536)..(536): n is a, c, t, g, unknown, or other
  misc_feature (658)..(658): n is a, c, t, g, unknown, or other
aagctggagctccccgcggtggcggccgctctagaactagtggatcccccgggctgcaggaattcgcacgagaccattacctagaacatcctaatcgaaaagtgtcgtcttcctctccgccgcttctcctgtccaccctcgactgcttgcgcgtgacctgagccgccgccgcctacatccgctcatccccgcgcccgcctcaaccacgccgccaccgaccacgtataatcctgcctccccttcgcgcggtttcgaggctcgtttcctttgggatcgttcgtctgccccgaccgcgtgggcgcttcttcttcgggatctcgctggaccgagcggcccagggctagggattcaggcccatggcgtggcggcgcgtcctcacccagattgcaaggcatcgaccagcanaagcaatctacaatgaactagttgcttcctccccctttgggggttcttcgaagtgacatcacttcaggtgccaggattagacatttacnagagaggaacccagtcagttacattggtagctttgcacgccngggtccgagacttagaatcaccaagcggaacttctctgctttaagagaatttacagaagtgaacccagagcgtgtcatacaaaatatttgaaaagccaccttcattacattctaatctgcanaactgt

SEQ ID NO: 22952 - protein, 34 aa, Zea mays
  misc_feature: Ceres CLONE 1392982-F
  misc_feature (17)..(17): Xaa is any aa, unknown, or other
MAWRRVLTQIARHRPAXAIYNELVASSPFGGSSK

SEQ ID NO: 22953 - DNA, 655 bp, Zea mays
  misc_feature: Ceres CLONE 1392983-F
  misc_feature (576)..(576): n is a, c, t, g, unknown, or other
  misc_feature (577)..(577): n is a, c, t, g, unknown, or other
aaagctggagctccccgcggtggcggccgctctagaactagtggatcccccgggctgcaggaattcgcacgagaccattacctagaacatcctaatcgaaaacgtatatgaatcttctcagacagaattccagggaggggatgttcagaaggtgcttatttcgttgttgaaaatattgtgccaacactatggaaagcttcgttcatcctttgggtctgacccgtcacaagagggtatagatggcccagagatggcagtgacgaaacttttctcatcttgtaagagcagtgctaatatgaaagggtatggagctgttgtccattgcatgagaaatcttccctcagaaagccagattcagactactgcccaggaggttcaaagtctcttggtttctggtagaaggaaagaggcccttcaccaggcacaagaaggtcacctttggggccctgcactgatccttgctttacaacttggtgataagttttatgcggatactgtgaagaaaatggcccactgccattttgtttctggatcacccttgaggacactgtgccttcttattgctggacaactgannatgttttcagttttgagatcctgttaaccaggggtttgtcttctccccacagcctgtagagctgctcctaaaggtatg

SEQ ID NO: 22954 - DNA, 663 bp, Zea mays
  misc_feature: Ceres CLONE 1392993-F
  misc_feature (155)..(155): n is a, c, t, g, unknown, or other
  misc_feature (336)..(336): n is a, c, t, g, unknown, or other
  misc_feature (417)..(417): n is a, c, t, g, unknown, or other
  misc_feature (537)..(537): n is a, c, t, g, unknown, or other
aagctggagctccccgcggtggcggccgctctagaactagtggatcccccgggctgcaggaattcgcacgagaccattacctagaacatcctaatcgaaaaaatttcaaagcgtgaagctctgctcacgtcgtcgcctccgcgtccgccacccantcaacaacgcggcggcgaatcgcgggcggttcgccgccgaccgccgccgcctttccctcgccagccccccgctcctgaagcaatggtactggaccacgccatcaggggctcggcggcccgcagggctgagacccaaaccctagcgccagtgctgctcatgggcccgccgcctccaccgccngatcccaccgacgacggggatgttacccttcccggggcccccaccccccgggacgctcctgccgcacccgatgcacatggncgctcccgcgtgaggtcatcatttacatggggacgagtgtcggagccgctccctcctcaagttcatttccgaccgcggggattgtgccttcgctagaggacgagcggagggaggagcggntagtacgcgagctcggcagataagtaatggattggggcaaagagggtggcctacgagcagggcactggcactggatcgcttcagccacgtgtttgaccttcggttctatgccctggggggggatga

SEQ ID NO: 22955 - DNA, 690 bp, Zea mays
  misc_feature: Ceres CLONE 1392995-F
  misc_feature: Encodes the peptide sequence at SEQ ID NO. 22956
  misc_feature (287)..(287): n is a, c, t, g, unknown, or other
  misc_feature (314)..(314): n is a, c, t, g, unknown, or other
  misc_feature (317)..(317): n is a, c, t, g, unknown, or other
  misc_feature (354)..(354): n is a, c, t, g, unknown, or other
  misc_feature (365)..(365): n is a, c, t, g, unknown, or other
  misc_feature (366)..(366): n is a, c, t, g, unknown, or other
  misc_feature (398)..(398): n is a, c, t, g, unknown, or other
  misc_feature (433)..(433): n is a, c, t, g, unknown, or other
  misc_feature (434)..(434): n is a, c, t, g, unknown, or other
  misc_feature (443)..(443): n is a, c, t, g, unknown, or other
  misc_feature (519)..(519): n is a, c, t, g, unknown, or other
  misc_feature (596)..(596): n is a, c, t, g, unknown, or other
  misc_feature (597)..(597): n is a, c, t, g, unknown, or other
caaagctggagctccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtnggtggcgtcggtgctccaaggaccggnggntgtcgacggcctcccgccggggccctccgggttgggncgggtggtggnngaacctggttccaggtgatccttgcagcgacnggccttccatggtacgtggtgcgcgaccttccggnnaagaagtancgggcccatcttcacccatggcgggatgggggcagcgcacccctcatcgtgggtcaccctcggcggagctcatcancgaggcgctgggtgaagcaggggccccatggttcgcgagcccggcccgaggacagccccacccgcctcctcttcagnngtcggcaagtgcaccgtcaactcggcgcctacggccccccctgtggcgtgctctgcgccgcaacttcctcgcccgagatcgtgtcccgcaccc

SEQ ID NO: 22956 - protein, 50 aa, Zea mays
  misc_feature: Ceres CLONE 1392995-F
  misc_feature (19)..(19): Xaa is any aa, unknown, or other
  misc_feature (28)..(28): Xaa is any aa, unknown, or other
  misc_feature (29)..(29): Xaa is any aa, unknown, or other
  misc_feature (45)..(45): Xaa is any aa, unknown, or other
MDVNDVLLVVLAAALAAMXVASVLQGPXXVDGLPPGPSGLGRVVXEPGSR

SEQ ID NO: 22957 - DNA, 663 bp, Zea mays
  misc_feature: Ceres CLONE 1392996-F
  misc_feature: Encodes the peptide sequence at SEQ ID NO. 22958
  misc_feature (361)..(361): n is a, c, t, g, unknown, or other
  misc_feature (556)..(556): n is a, c, t, g, unknown, or other
  misc_feature (557)..(557): n is a, c, t, g, unknown, or other
  misc_feature (568)..(568): n is a, c, t, g, unknown, or other
aaagctggagctccccgcggtggcggccgctctagaactagtggatcccccgggctgcaggaattcgcacgagaccattacctagaacatcctaatcgaaaaagggaagccgcaggcagcatctgcatctctcgcccacctccgctccgcctactgctgctggtggtagggaggcggagaaggaggcccttgcgcccgcccgccggccggatcagagccgtagcaaccaccacccatggcggacgtgcacgaacctttggtgcgccgtaagaggaagaaggttttggtggactacttggtgaagttccgatggatcctcgtgatcttcgtggtccttcctatttcaactctgatctacttncacatcttcctgggtgacatggtgggtccgccatgaagtcggagaagaaagcgcagaagcagcacgacgagaacgtgcagaaggtcgtgaagcggctcaggcagaggaaccgaaagagggacggtcttgtttgcacggccaggaagccctggatcgctgttggcatgcggcacgtggactacaagcgtgcgaggnnatttcgagggncgacctttcctccttcaggaacatccttgagatcgacaaaggaggaggatgggtggccaaggtcgagcccctttggcaaattgggtcagataccc

SEQ ID NO: 22958 - protein, 53 aa, Zea mays
  misc_feature: Ceres CLONE 1392996-F
  misc_feature (42)..(42): Xaa is any aa, unknown, or other
MADVHEPLVRRKRKKVLVDYLVKFRWILVIFVVLPISTLIYXHIFLGDMVGPP

SEQ ID NO: 22959 - DNA, 665 bp, Zea mays
  misc_feature: Ceres CLONE 1392997-F
  misc_feature: Encodes the peptide sequence at SEQ ID NO. 22960
  misc_feature (379)..(379): n is a, c, t, g, unknown, or other
  misc_feature (530)..(530): n is a, c, t, g, unknown, or other
  misc_feature (532)..(532): n is a, c, t, g, unknown, or other
  misc_feature (590)..(590): n is a, c, t, g, unknown, or other
  misc_feature (600)..(600): n is a, c, t, g, unknown, or other
  misc_feature (651)..(651): n is a, c, t, g, unknown, or other
  misc_feature (652)..(652): n is a, c, t, g, unknown, or other
aagctggagctccccgcggtggcggccgctctagaactagtggatcccccgggctgcaggaattcgcacgagaccattacctagaacatcctaatcgaaaaacttgcgcatcggatcgcatcagctgctgcttttgtccaccaagcaacgattccctttccttccgccgcccaaatgccagtggccaccttcctcctcgtcgcgcttctctcgtgcggcgcacgagccatccggacgcacggcggctatgtctccgcggtcggggaccccggcatgcggcgcgacggcctccgcgtggcatgggaggcgtggaacttctgcaacgaggtcggccaggaggcccccggcatgggcagcccccgcggtgccgattgcttcnatcttctcggtccgtccattccatctctttctctccctttccgccggggtgggttggagtgggttgccaccaagaattaggtttttgaggaagcgtggattctctgttccgttccgcagagacgactccgacgaaggagggggccggcggngntactcggtggcgcacctggtgagcgacgccgacaacgccctgggcgcgggcgacccgnttcccggggntccccgcccgggcgcggcccgggtcacggacgccgacctctacgcgccggnncaaggagctgtac

SEQ ID NO: 22960 - protein, 94 aa, Zea mays
  misc_feature: Ceres CLONE 1392997-F
  misc_feature (69)..(69): Xaa is any aa, unknown, or other
MPVATFLLVALLSCGARAIRTHGGYVSAVGDPGMRRDGLRVAWEAWNFCNEVGQEAPGMGSPRGADCFXLLGPSIPSLSLPFRRGGLEWVATKN

SEQ ID NO: 22961 - DNA, 641 bp, Zea mays
  misc_feature: Ceres CLONE 1393002-F
  misc_feature (155)..(155): n is a, c, t, g, unknown, or other
  misc_feature (160)..(160): n is a, c, t, g, unknown, or other
  misc_feature (163)..(163): n is a, c, t, g, unknown, or other
  misc_feature (397)..(397): n is a, c, t, g, unknown, or other
  misc_feature (430)..(430): n is a, c, t, g, unknown, or other
  misc_feature (447)..(447): n is a, c, t, g, unknown, or other
  misc_feature (448)..(448): n is a, c, t, g, unknown, or other
  misc_feature (559)..(559): n is a, c, t, g, unknown, or other
aaagctggagctcaccgcggtggcggccgctctagactagtggatccccgggctgcaggattcgcacgagaccattacctagaaatcctaatcgaaaaattcgccttcacctcgccgcttcctccttgacgccaccgttgacgtcgtcttccggngaggnagntcgccggaagacctcacctggacttttccgacgcaccctccacacactctttaaccctccggaatggccgcctgcttctagctcgtcgacgccccaatctccgcttgcttcctcgacagccccatccgcctcttctcgctctcgctacggctcctctgcctgttcgccatggcgatccggatcaccggctcctactccgggtaggggggggagaacctcccgggtggctggggnaccggctccccccccccccgcccccggacagcnccccccccgtgaggggnncgggggcctattgggagggggtggtgtcccccccttccggggggggtcgccgcccccccccccccaccccgggcgcggaggcagagaaaattcgtcccccccgggggggancccgcagggggaggtgcgtcccggcccccccacggaggggggtggggggatggagtttatgtggcccccccgaagggtggct

SEQ ID NO: 22962 - DNA, 665 bp, Zea mays
  misc_feature: Ceres CLONE 1393004-F
  misc_feature: Translation starting site: 564
  misc_feature: SWISSPROT Homolog: EC 3.4.23.1 Pepsin A
  misc_feature: SWISSPROT Homolog: EC 3.4.23.15 Renin
  misc_feature (239)..(239): n is a, c, t, g, unknown, or other
  misc_feature (247)..(247): n is a, c, t, g, unknown, or other
  misc_feature (257)..(257): n is a, c, t, g, unknown, or other
  misc_feature (258)..(258): n is a, c, t, g, unknown, or other
  misc_feature (274)..(274): n is a, c, t, g, unknown, or other
  misc_feature (280)..(280): n is a, c, t, g, unknown, or other
  misc_feature (323)..(323): n is a, c, t, g, unknown, or other
  misc_feature (346)..(346): n is a, c, t, g, unknown, or other
  misc_feature (542)..(542): n is a, c, t, g, unknown, or other
  misc_feature (618)..(618): n is a, c, t, g, unknown, or other
  misc_feature (637)..(637): n is a, c, t, g, unknown, or other
aaagctggagctccccgcggtggcggccgctctagaactagtggatcccccgggctgcaggaattcgcacgagaccattacctagaacatcctaatcgaaaaaccagctttccccttctctccggtccgggaatcggaagctcagggcagaagccttggggcagacgcatcttttgttgctcgcttgtttctgggtccctgtcacatgctccttgctacttgatgcttcctccgatggnactgttanaatcaacctnngacagaagagactggnacaggnagctttgactgctgcgaaattggcgagaaagagagccaccttncgaggtctgtgggtgctgaccantatctcagtgcctcaactgatgacatagtccctttgggacactacctggacacccagtactttggacagatcagcatcggcacgccacacagaactcacagtgatattcgacactggaagctccaactttgtggttccctcatcagagtgctacttttcgatagcgtgctacttacacacagatacaagtcacccnagtcgaagacttacacaaagaatggaggatctggtacgaatacattatggttctgggcaatcgctggttccttcanggaggacagtggggttggntggcaaactttgtggggaaaatcaaaat

SEQ ID NO: 22963 - DNA, 922 bp, Zea mays
  misc_feature: Ceres CLONE 1393006-R
  misc_feature (922)..(922): n is a, c, t, g, unknown, or other
gtggggtgtgggggggaggaagcccaacctgtatgttctatgaataagctgccggagataataatcttaaagcctccgttttttgaaatttgaatatatgtataatatatgaataagccgctggagataataatcttaaagctaccgcgcgttacatatgggccaactattttttttctaaaataacctgctatttcttttattttcttttctcttccactcggaatatcggtttgaaaagctttcacctcgctgtcagcttgccgggcagcatcaatagcttcattggtgccgtatagtcccaatagtttatgaaacgacggctttttatgcatggtagtccaatagatttgttctaataagacgggaagaacttatggaacccatgcatgagcaccaaacaagaaatctaacctctatcatggaagatatatgtgttctcagcaagaactctgattgtttctccttaggttcttcagatctacagtcttcctcctctcctttcttgttccatggtagcctccatagacaaaggataaccttcgtgaggtctacattgccccttgggatcgcccactttctcttgcatcaaattaacttcccggtggcggggggaaatattccagcagtactttttttatgtaccgagggtgaaggccggaaaaaatttctcttctcgtggcaaaaaaaaaccaggttccatattattcgcggtaacccccagccttaaggttggtctcgtcattcaagctccgcttcgttgggacttctttaggtcggaagcgtaaaccccggtggagaatttgcccgcggtgcacaatggggggcgcacgggaagcgccggcggaatgttgggtgggagaccgtaacctttcaaaaagaatgctgatgaggtttgtgttattgagcgagccgcgtgctn

SEQ ID NO: 22964 - DNA, 688 bp, Zea mays
  misc_feature: Ceres CLONE 1393013-F
  misc_feature: Encodes the peptide sequence at SEQ ID NO. 22965
  misc_feature (395)..(395): n is a, c, t, g, unknown, or other
  misc_feature (414)..(414): n is a, c, t, g, unknown, or other
  misc_feature (416)..(416): n is a, c, t, g, unknown, or other
  misc_feature (422)..(422): n is a, c, t, g, unknown, or other
  misc_feature (427)..(427): n is a, c, t, g, unknown, or other
  misc_feature (431)..(431): n is a, c, t, g, unknown, or other
  misc_feature (445)..(445): n is a, c, t, g, unknown, or other
  misc_feature (465)..(465): n is a, c, t, g, unknown, or other
  misc_feature (470)..(470): n is a, c, t, g, unknown, or other
  misc_feature (503)..(503): n is a, c, t, g, unknown, or other
aagctggagctccccgcggtggcggccgctctagaactagtggatcccccgggctgcaggaattcgcacgagaccattacctagaacatcctaatcgaaaaatcccaagaagagccgccctacctattccttctccccgccgtcgagctgcccaacccagagcaccagcagccctcacctccttcctctcggccggtccttccaacgagcccgctggtcttggagccgccaccgttctcgttctggacgaacgttcaaggagattgcatttgtggatgctctaatggagtcgaaaggtggcaagaagtctagtagtagtagtagtaatttcatgtacgaagctccccttggctacaagatcgagggacgtcgcccagccggaggaaatcagaagntccagactgctgctttatncnactgcngtcgncagncatcctgatatcgncctccatggcaatccggggnagagnaggatttttaatccagttttcctcttggggcgnaagttttcccgttggctctgggtgccctccccctgcttcgagaattccaattgggctgggccaatccccctttttccccccaaccctccctttttggaaaggaaccaaaggggggggggcttcacaaaaaatttggggggcccctcccggcccccccaaatgggttttgaggggttaaaaaaacc

SEQ ID NO: 22965 - protein, 51 aa, Zea mays
  misc_feature: Ceres CLONE 1393013-F
  misc_feature (1)..(51): Pfam Name: AdoMetDC_leader Pfam Description: S-adenosyl-l-methionine decarboxylase leader peptide
  misc_feature (38)..(38): Xaa is any aa, unknown, or other
  misc_feature (44)..(44): Xaa is any aa, unknown, or other
  misc_feature (45)..(45): Xaa is any aa, unknown, or other
  misc_feature (47)..(47): Xaa is any aa, unknown, or other
  misc_feature (50)..(50): Xaa is any aa, unknown, or other
MESKGGKKSSSSSSNFMYEAPLGYKIEGRRPAGGNQKXQTAALXXCXRQXS

SEQ ID NO: 22966 - DNA, 658 bp, Zea mays
  misc_feature: Ceres CLONE 1393017-F
  misc_feature: Encodes the peptide sequence at SEQ ID NO. 22967
  misc_feature (216)..(216): n is a, c, t, g, unknown, or other
  misc_feature (219)..(219): n is a, c, t, g, unknown, or other
  misc_feature (303)..(303): n is a, c, t, g, unknown, or other
  misc_feature (306)..(306): n is a, c, t, g, unknown, or other
  misc_feature (476)..(476): n is a, c, t, g, unknown, or other
agagctggagctccccgcggtggcggccgctctagaactagtggatcccccgggctgcaggaattcgcacgagaccattacctagaacatcctaatcgaaaagtacacaagctcgtctcgcaccagaaacccgcgaatcaatcccgaatcccgatcgaccggcggcgcgggaggcgatgccggacaaggcggtggacgacgtcatggaggccgcgntgnggcccacttcagcggcctccgcctcgaggggctgcgcctctccacctctgcgccctcttccccttcctccctccccccgcgcgnggngcacacgcactccaacggagccgtctacgccaacggcaccaccgagcttccctctcctgggcgctgccggcaggcattcgtcatcggggtttctggagggacggcgtcggagaagacgacggtgtgcgacatgatcatccagcagctgcacgaccaccgtgtcgtgctcngtaaccaggattcgttttaccgtggccttactgctggagagtctgcacacgcacaagactataattttgatccccctgaggcatttgatacagaggcacttctagaatgcatggggcagctgaaatgtgctcaacctgtaaatggtcctatatatgatttccagaagcattcgagggggtct

SEQ ID NO: 22967 - protein, 74 aa, Zea mays
  misc_feature: Ceres CLONE 1393017-F
  misc_feature: SWISSPROT Homolog: EC 2.7.1.48 Uridine kinase
  misc_feature (14)..(14): Xaa is any aa, unknown, or other
MIIQQLHDHRVVLXNQDSFYRGLTAGESAHAQDYNFDPPEAFDTEALLECMGQLKCAQPVNGPIYDFQKHSRGS

SEQ ID NO: 22968 - DNA, 655 bp, Zea mays
  misc_feature: Ceres CLONE 1393018-F
  misc_feature: Encodes the peptide sequence at SEQ ID NO. 22969
  misc_feature (463)..(463): n is a, c, t, g, unknown, or other
  misc_feature (534)..(534): n is a, c, t, g, unknown, or other
  misc_feature (554)..(554): n is a, c, t, g, unknown, or other
  misc_feature (588)..(588): n is a, c, t, g, unknown, or other
  misc_feature (603)..(603): n is a, c, t, g, unknown, or other
aaagctggagctccccgcggtggcggccgctctagaactagtggatcccccgggctgcaggaattcgcacgagaccattacctagaacatcctaatcgaaaactgttttgttctccttctcattcgactctgatgatgacgagacggttatcgttccccttctggttcggtggagatcgccgccgttggcgtttcgatcgccatatttaaccaagtctccaaggtctgcatctaccctctcgttagcgtcacaacgtcgttcgtcgcggaggaagacgcgatcatcagtaaggccgtccgaggaaacagcagccaggaggaggacgtggagaaagcctcccacgtgggctttgatccggagaccagcaatctgcatgcatctggccctgcaggtatggcagaatgcgtgaactcgtgtatccctacggagtgcgcagcagatccctctggcaggccagggcgntgcgagaagaggtacgtgccgtcggtcacgtcggcgctaatagtcggttccatttctcggctgcttcaggncgtcttcctgggtctttcgncagatcgtgctcacatcatgggtggtaagtccgnatccccgatgcaggncctgcggtgcgctacctacgataggtcccttggtgccccgctgtgctgctgc

SEQ ID NO: 22969 - protein, 87 aa, Zea mays
  misc_feature: Ceres CLONE 1393018-F
  misc_feature (47)..(47): Xaa is any aa, unknown, or other
  misc_feature (54)..(54): Xaa is any aa, unknown, or other
  misc_feature (65)..(65): Xaa is any aa, unknown, or other
  misc_feature (70)..(70): Xaa is any aa, unknown, or other
MAECVNSCIPTECAADPSGRPGRCEKRYVPSVTSALIVGSISRLLQXVFLGLSXDRAHIMGGKSXSPMQXLRCATYDRSLGAPLCCC

SEQ ID NO: 22970 - DNA, 630 bp, Zea mays
  misc_feature: Ceres CLONE 1393019-F
  misc_feature (364)..(364): n is a, c, t, g, unknown, or other
  misc_feature (392)..(392): n is a, c, t, g, unknown, or other
  misc_feature (393)..(393): n is a, c, t, g, unknown, or other
  misc_feature (434)..(434): n is a, c, t, g, unknown, or other
aaagctggagctcaccgcggtggcggccgctctagaactagtggatcccccgggctgcaggaattcgcacgagaccattacctagaacatcctaatcgaaaaaacgcatttcgctccccacagcggctcggccacaacccacagccagacggtctcgagctggatctctaccgttcgtccgttccagcagacagcagtgcgcgctctctctctccctcgtggcgacgactgggcgaccgctgccgctgcccttgtgccccggtctccgtcggtccgttcgccaggtctcctgcgggctctttgtcgtcgacaagctcccgccaggtgctgtgtgaagtccaagggtgtcacatggattcagcancagatttccaagccaggacattctctanntaagtgtgggccaccaaggtgaagcacacggatcatgcttngtgacaggatgaccaacaatctggctacagaggtcatttttctctcgcaaatatccgccttttgggaaggcaagaggctcatgagaatgcaaaaacgatgggaggactttggctttgcttgggctgatgagcatttcagagaggaaccagatggggatggggagttcttgctggcagttatatggcaagggaaacg

SEQ ID NO: 22971 - DNA, 637 bp, Zea mays
  misc_feature: Ceres CLONE 1393020-F
  misc_feature: Translation starting site: 156
agagctggagctccccgcggtggcggccgctctatactagtggatcccccgggctgcaggaattcgcacgagaccattacctagaacatcctaatcgaaaaaattcctgtctgtgcgcgcgcgcgcgtggcgccggccgagcggccgttgacccgatgaccggcgcggcggccgtcaatcccccggtgcctcggccgcggcggctcacggtcctcccgctcatcgcgctcatcttctacgacgtctcgggaggccccttcgcatcgaggactcggtccgcacgggcggcggcgcgctgctcccgatccttggcttcatcgtcctcccagtcctctggtcgctcccggaggcgctggtcacggccgagctcgtatcggttttcctcaccaacggcgggtacgtggactgagtgtccgccgtcttcggccccgccgtggcgttcctcgccgggttctccaagtgggcgtcgggggactctcgacaacgcgctctacccgggggctgttcctcaactacctccggctccggcgttgggctggagctgtcggccgaccgactcggtcactagggggtcctcgcggatcacgggccggcggtcacctaccctcagcttaccggggagcttccttattgtttg

SEQ ID NO: 22972 - DNA, 640 bp, Zea mays
  misc_feature: Ceres CLONE 1393023-F
  misc_feature: Encodes the peptide sequence at SEQ ID NO. 22973
aagctggagctccccgcggtggcggccgctctagaactagtggatcccccgggctgcaggaattcgcacgagaccattacctagaacatcctaatcgaaaaagtttcgacagtcgtcgtcccctctactctcccggcttccgcagaatcccagcttctctggccctctcactccaaacatcgggctccaggccgtctcccgccaacccaaattcgcttcccgccgctccccattaaacccgcttgaaaggtcgcgccctcgagcagagcaacccctgaccacaaatccgatccgtagccgccgtgcctcgatttcgtctcttcccctctgctcgagtacgagcggctactcccggcggcggcggcggcggcggcgatgagcgcggtgagctcgaccatatcaaggagctgatcaagtggggaacagactacatcctcaaaaccttcaattcatctgctgacacgatagacaggattgtcgctcaggtgggtgtaggtgacacctctaaaggcagcagtcagcctaatgaccattactgctggatgagaccagaggacatcgactacaaaaggccagtcaccgagtgtcactcttgctcagatctagcgtctgaaatggctgctgccctggctgcagcttc

SEQ ID NO: 22973 - protein, 32 aa, Zea mays
  misc_feature: Ceres CLONE 1393023-F
  misc_feature: SWISSPROT Homolog: EC 3.2.1.4 Cellulase
MRPEDIDYKRPVTECHSCSDLASEMAAALAAA

SEQ ID NO: 22974 - DNA, 622 bp, Zea mays
  misc_feature: Ceres CLONE 1393026-F
  misc_feature: Encodes the peptide sequence at SEQ ID NO. 22975
aaagctggagctcaccgcggtggcggccgctctagaactagtggatcccccgggctgcaggaattcgcacgagaccattacctagaacatcctaatcgaaaaatatttcgatcgtggtgtgagtctccgctttcccacttggcgctagggtttcccccctctcatttcccctcctcctcccgctccccctggctccccaagcctcgacgcccggctagggttttgcctccttcccgccgccgctgtttcagcgagcgagaccgaggggtagagaaagagcggtgcttagccacccatgtcgctgcgtccgagcgagcgggtcgaggtacggcggaaccgctacaaggtggcggttgacgcggaggaggggcggcggcggcgcgaggacaatatggtggagatccgcaagagccgccgtgaggagagcctcctcaagaggcgccgtgaggggctccaagcccaggtccctgcccctccctccggggtcgagaagaagcttgaaagcctcccagctatggttagtggggtttattcggatgataataaccttcagcttgaggccaccacacagttccgcaaattgctctctatagagaggagtccccccatcgaagaagtatca

SEQ ID NO: 22975 - protein, 109 aa, Zea mays
  misc_feature: Ceres CLONE 1393026-F
  misc_feature (4)..(92): Pfam Name: IBB Pfam Description: Importin beta binding domain
MSLRPSERVEVRRNRYKVAVDAEEGRRRREDNMVEIRKSRREESLLKRRREGLQAQVPAPPSGVEKKLESLPAMVSGVYSDDNNLQLEATTQFRKLLSIERSPPIEEVS

SEQ ID NO: 22976 - DNA, 500 bp, Zea mays
  misc_feature: Ceres CLONE 1393031-F
  misc_feature (271)..(271): n is a, c, t, g, unknown, or other
aaagctggagctccccgcggtggcggccgctctagaactagtggatcccccgggctgcaggaattcgcacgagaccattacctagaacatcctaatcaaaaaaatgagctcgctctcctgctcctacaggctgcagttgcgctgtgcctgtgcttccagttccatcgctttcccctcctccccagtccccactcccagatgcgatttccctctccaccgccacagcgcctagcttagccagccagccggcggccatcgccgccgcaatggncgaccgcgtccggaggaacgaaggcccgcctttcggaaccgttgcaagggggaaacttaaaggcccccaggggccgaaagtttaagggggagccccaaaaacccccccaggggggttggggttcccggggcccaccaccaaggggggggggggttgcgcccccccccccccccccccccccgggggggcccccccccccacacaccgggttttcccccccccccctttg

SEQ ID NO: 22977 - DNA, 631 bp, Zea mays
  misc_feature: Ceres CLONE 1393046-F
  misc_feature: Encodes the peptide sequence at SEQ ID NO. 22978
  misc_feature (600)..(600): n is a, c, t, g, unknown, or other
aaagctggagctccccgcggtggcggccgctctagaactagtggatcccccgggctgcaggaattcgcacgagaccattacctagaacatcctaatcgaaaaaacccaacccaaccgcgctttttgtcacctctcacctggaaagggaagacaagtcgagattcgagaaggcaaatcgaattcgccatgggcatggctgctccgcgcgcgccgctgcctctcccccaactgctgctcctcctcgttgctgcgctcctcgccgccgctcccctccctagggcggccggggcggacgagttcgacgtccgccgccacctctccaccgtcaccaggtatgatgtggccagggagtccagtagtgtcatctccatgccgtcaatcccagacgggtgccgtgtcattcacctcaatctagtggcaagacatgggactcgtgctcctaccaagaagcgcatcaaggagctggatagattggcagttcgactggaagcccttctgaaagaggcaaatcaggtccttgatagtgattctctgaagaaaattccatcctggattaaaggctgggaatcacgctggaagggtaggactaaaggtggtgangctgattagtgaaggggaagaggagctgtac

SEQ ID NO: 22978 - protein, 140 aa, Zea mays
  misc_feature: Ceres CLONE 1393046-F
  misc_feature: SWISSPROT Homolog: EC 3.1.3.8 3-phytase
  misc_feature (138)..(138): Xaa is any aa, unknown, or other
MGMAAPRAPLPLPQLLLLLVAALLAAAPLPRAAGADEFDVRRHLSTVTRYDVARESSSVISMPSIPDGCRVIHLNLVARHGTRAPTKKRIKELDRLAVRLEALLKEANQVLDSDSLKKIPSWIKGWESRWKGRTKGGXAD

SEQ ID NO: 22979 - DNA, 638 bp, Zea mays
  misc_feature: Ceres CLONE 1393048-F
  misc_feature: Encodes the peptide sequence at SEQ ID NO. 22980
  misc_feature (526)..(526): n is a, c, t, g, unknown, or other
  misc_feature (562)..(562): n is a, c, t, g, unknown, or other
  misc_feature (573)..(573): n is a, c, t, g, unknown, or other
  misc_feature (583)..(583): n is a, c, t, g, unknown, or other
  misc_feature (604)..(604): n is a, c, t, g, unknown, or other
  misc_feature (605)..(605): n is a, c, t, g, unknown, or other
  misc_feature (616)..(616): n is a, c, t, g, unknown, or other
  misc_feature (619)..(619): n is a, c, t, g, unknown, or other
  misc_feature (624)..(624): n is a, c, t, g, unknown, or other
  misc_feature (625)..(625): n is a, c, t, g, unknown, or other
aaagctggagctccccgcggtggcggccgctctagaactagtggatcccccgggctgcaggaattcgcacgagaccattacctagaacatcctaatcgaaaaaactcgaaccgaagggacgaccgagcggagtctagactcgagagcaacctcgacctcccggatctctctcccacccacgcctcgtcggcgccgtcgtctgctgcagcgatggcctcccccgacctgctcttcaatctgcggaacctcttctacctgggcgcctaccaggcagccatcaacaacagcgacgtcccgggcctcgacgccgacgccgccgctgagcgcgacgccatcgtcttccgctcctacatcgccctcggctcctaccagctggtgatcagcgagatcgactcgtcagccgctacctcgctgcaggccgtgaagctgctcgcgctgtacctcactggagacaaggaaggtgctatctccagtctcaaggaatggttgagtgattcagcaattggaaagcatcctgttctgcggntgattgctgaatctctctcccccaactacccctcgncagcgcccggngatgtgcccnacgaaagccgatcgccctggnncagccgccggncgntccgnngagaagagctggg

SEQ ID NO: 22980 - protein, 142 aa, Zea mays
  misc_feature: Ceres CLONE 1393048-F
  misc_feature (3)..(142): Pfam Name: Coatomer_E Pfam Description: Coatomer epsilon subunit
  misc_feature (106)..(106): Xaa is any aa, unknown, or other
  misc_feature (118)..(118): Xaa is any aa, unknown, or other
  misc_feature (125)..(125): Xaa is any aa, unknown, or other
  misc_feature (132)..(132): Xaa is any aa, unknown, or other
  misc_feature (136)..(136): Xaa is any aa, unknown, or other
  misc_feature (137)..(137): Xaa is any aa, unknown, or other
  misc_feature (139)..(139): Xaa is any aa, unknown, or other
MASPDLLFNLRNLFYLGAYQAAINNSDVPGLDADAAAERDAIVFRSYIALGSYQLVISEIDSSAATSLQAVKLLALYLTGDKEGAISSLKEWLSDSAIGKHPVLRXIAESLSPNYPSXAPGDVPXESRSPWXSRRXXRXEEL

SEQ ID NO: 22981 - DNA, 635 bp, Zea mays
  misc_feature: Ceres CLONE 1393057-F
  misc_feature: Encodes the peptide sequence at SEQ ID NO. 22982
  misc_feature (531)..(531): n is a, c, t, g, unknown, or other
aaagctggagctccccgcggtggcggccgctctagaactagtggatcccccgggctgcaggaattcgcacgagaccattacctagaacatcctaatcgaaaaatcgcactcgtagtcgtagctcaagcatcagcggcaggagctctgggcagcgtgcgcacgtggggtacctagctcgctctgctagcctaccatggctgatcaccaccggggcgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcagcccgggcgctggtgccggccgccatcgcgctggcgctcatggcgggcggggtcgtcacctccgggcggctcggggtcgttgcgctggcttatcgatacgccnacctcaaggggggggcccggacccaattcgccctaaagggagcccaatacccgcgctccatggcccgcgtttaacacggccggatgggaaaaacccgggggtac

SEQ ID NO: 22982 - protein, 147 aa, Zea mays
  misc_feature: Ceres CLONE 1393057-F
  misc_feature (36)..(113): Pfam Name: Oleosin Pfam Description: Oleosin
  misc_feature (113)..(113): Xaa is any aa, unknown, or other
MADHHRGATGGGGGYGDLQRGGGMHGEAQQQQKQGAMMTALKAATAATFGGSMLVLSGLILAGTVIALTVATPVLVIFSPGAGAGRHRAGAHGGRGRHLRAARGRCAGLSIRXPQGGGPDPIRPKGSPIPALHGPRLTRPDGKNPGV

SEQ ID NO: 22983 - DNA, 641 bp, Zea mays
  misc_feature: Ceres CLONE 1393060-F
  misc_feature: Encodes the peptide sequence at SEQ ID NO. 22984
aaagctggagctccccgcggtggcggccgctctagaactagtggatcccccgggctgcaggaattcgcacgagaccattacctagaacatcctaatcgaaaaaacacaacaatctctctcccctcactccctctctgcagcgcgcagctttcaaagcgttgggagagatggcagaggagacgcaaccagaggccgcagccgccgccgcgcccgccgcggccgaggtagtcgtgaccgaagctgcgccggcggaggcggaggtgcctgcggcggcggaagctgaagccgaggccaaggatgagaagaaaggtgacgaggcggagctcaccgccgatgacgcgggggtggggaccggctcgttcaaggaggaaagcaacctggtggaagacctgcccgacccggagaagaaggcgctcgacgagttcaagcagctgatcgctgctgccctcgccgccggtgagttcaacctgcctcccccgccgccgccgccgaaggccaaggaaacaaaggtggaggaagccaaggcccaggtggctgcggatgccccggttgaggaggtcaagacggaggtgccgccggccgaggaggccaaggctgagacactggctgaggaagccaagccttccgagcccgagccgcag

SEQ ID NO: 22984 - protein, 158 aa, Zea mays
  misc_feature: Ceres CLONE 1393060-F
MAEETQPEAAAAAAPAAAEVVVTEAAPAEAEVPAAAEAEAEAKDEKKGDEAELTADDAGVGTGSFKEESNLVEDLPDPEKKALDEFKQLIAAALAAGEFNLPPPPPPPKAKETKVEEAKAQVAADAPVEEVKTEVPPAEEAKAETLAEEAKPSEPEPQ

SEQ ID NO: 22985 - DNA, 631 bp, Zea mays
  misc_feature: Ceres CLONE 1393066-F
aaaagtggagctccccgcggtggcggccgctctagaactagtggatcccccgggctgcaggaattcgcacgagaccattacctagaacatcctaacgaaaaattccaccgccgcacacctcctgtcttccttcaccttcgcgctccgccgccgccgtcgattcgtgctgctctcacccctaacctgtccaacatcgccggggagggaagcagcagaagaagctccccttacctccggctatcgcctgaggataaagtggggtctgtaggggagtcttaggggggagcaaaagggataggatagggagagatgaagcaatcaatttcttcgtccgccttcgcccctgcttacgtccccgctactaaccctaggatcattctgtcttttctcgtttcttatccgactcttcttcgttttatgcctatcagttatgaggttgaacgccttcagaagcttctctactagattagtgtaaatagtagacttgttcgagtttagcttggctggaagaattagtctctggtccgtgtttatatctgctagcaataatggctgcgatgaacggagaggtattgggtgaatgtggaaggaacataaatagtctcaagagaaagcgggagagccccgctgc

SEQ ID NO: 22986 - DNA, 635 bp, Zea mays
  misc_feature: Ceres CLONE 1393068-F
  misc_feature: Encodes the peptide sequence at SEQ ID NO. 22987
aaagctggagctccccgcggtggcggccgctctagaactagtggatcccccgggctgcaggaattcgcacgagaccattacctagaacatcctaatcgaaaatctcgattttcgtctcactcacatctcccatcgatccagctcgcccccgcccgttttctcctgaaaacaaaacgaaaggctccgccatccgaaaaaaaaaaccccacacaaaacccataccccctgcggcggcggcgatggacccgtcctcgtcgggctccggcggcaactccctcccgtccgttggccccgacggacagaagcggcgcgtgtgctactactacgacccggatgtgggcaactactactacgggcagggccatccgatgaagccgcaccgcatccggatgacgcactcgctgctggcgcgctacggcctcctcaaccagatgcatgtgtaccgccccagcctggccagccaacgcgacctctgtcgcttccacgccgacgactacatcaaattcctgcgctccgtcacgcccgacacgcagcaggagcagacccgcctgctcaagcgcttcaacgtcggcgaggactgccccgtcttcgacggcctctacagcttctgccagacctactcgggcgcctcagtc

SEQ ID NO: 22987 - protein, 132 aa, Zea mays
  misc_feature: Ceres CLONE 1393068-F
MDPSSSGSGGNSLPSVGPDGQKRRVCYYYDPDVGNYYYGQGHPMKPHRIRMTHSLLARYGLLNQMHVYRPSLASQRDLCRFHADDYIKFLRSVTPDTQQEQTRLLKRFNVGEDCPVFDGLYSFCQTYSGASV

SEQ ID NO: 22988 - DNA, 689 bp, Zea mays
  misc_feature: Ceres CLONE 1393079-F
  misc_feature: Encodes the peptide sequence at SEQ ID NO. 22989
  misc_feature (12)..(12): n is a, c, t, g, unknown, or other
  misc_feature (13)..(13): n is a, c, t, g, unknown, or other
  misc_feature (15)..(15): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (23)..(23): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (34)..(34): n is a, c, t, g, unknown, or other
  misc_feature (40)..(40): n is a, c, t, g, unknown, or other
  misc_feature (54)..(54): n is a, c, t, g, unknown, or other
  misc_feature (60)..(60): n is a, c, t, g, unknown, or other
  misc_feature (61)..(61): n is a, c, t, g, unknown, or other
  misc_feature (63)..(63): n is a, c, t, g, unknown, or other
  misc_feature (64)..(64): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (131)..(131): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (416)..(416): n is a, c, t, g, unknown, or other
ctgggttgggtnncntnnnnntnttnnnnnnttnttcatnttttttgttctccnaaaaanntnnannngcaccacccgtcccacccgcgcgctgtgtcccacccagaaccgcgccaccccccccctttctntttnnnnnnntcagagctggactccccgcggtggcggccgctctagaatagtggatcccccgggctgcaggaatcgcacgagaccattacctagaacatcctaatcgaaaaactgatgtcgtaacacaaggctgaatttttgttcggtctagccgacccgacgatggcgtccagcgacgggaaaccactgccaaccccggcctctgtgggcggcggcggggagcagcaccgcgccgcccgggcagccgaccacggtagcgtccaaggtgctggacatgggcgcgncggcgatgcagtcgttgcgccccgtgaagcaggcgaagcagcacatgtgcacggtcgcgctgtacgcggacggaccccaaagcggcaggggggagaacccccccactaacgtcccccccgccttcaaccaagaaattcccccccagggggggcccggcttatggaactcccgaaaaaaagcccaagcgggggggtttccaatggggggggggaaaaaaaatcccgggggccgagggaaaaaaatttttccaaatccccgggggccgggggggg

SEQ ID NO: 22989 - protein, 94 aa, Zea mays
  misc_feature: Ceres CLONE 1393079-F
  misc_feature (4)..(4): Xaa is any aa, unknown, or other
MGAXAMQSLRPVKQAKQHMCTVALYADGPQSGRGENPPTNVPPAFNQEIPPQGGPGLWNSRKKAQAGGFPMGGGKKNPGGRGKKIFPNPRGPGG

SEQ ID NO: 22990 - DNA, 744 bp, Zea mays
  misc_feature: Ceres CLONE 1393082-F
  misc_feature: Encodes the peptide sequence at SEQ ID NO. 22991
cgctcattactagtggatcccccgggctgcaggaattcgcacgagaccattacctagaacatcctaatcgaaaaaaagcaccacgcacgatcgccttcgccaaccgcgccgctctctctctctttctctctcgcacgagccgcgccggcgccgccaccacgcgcgcgggagacagagaccacagccgcagccaccgacgggcggaataggaatggtggcgccggggggaggagcaggaggaggtccgttgcggtggccggcggcggaggagcttgacactgtacggaagaaggtggtggagattagtggaagggatgaacaagaggttatggttgctgcttgcccctacagaatttggccctttgggggctcatattgatccatcaggggtggagtagtcacagctatgaccataaaattatggaggtactcccttggccttcgttcccctcctagtggggcccgcaccaacccctcactttttcttttccgggttcgcctccttcttctcggccaggtaacaagacgccgtcacgcgccactcccgcgtccccaccctcctccccaccccctcattcgcggcccgcccgggcgaacgtctgtcccgcccgctgcgtccttactactactccgcgtcgctcccacggccgacctagaccgcctgatacccctagcccgcccccccgatatgagcacgcgccctctacgtcttcgtcctctcccctcgctcacgccgccaccacc

SEQ ID NO: 22991 - protein, 55 aa, Zea mays
  misc_feature: Ceres CLONE 1393082-F
MVAPGGGAGGGPLRWPAAEELDTVRKKVVEISGRDEQEVMVAACPYRIWPFGGSY

SEQ ID NO: 22992 - DNA, 748 bp, Zea mays
  misc_feature: Ceres CLONE 1393084-F
  misc_feature: Encodes the peptide sequence at SEQ ID NO. 22993
  misc_feature (371)..(371): n is a, c, t, g, unknown, or other
  misc_feature (402)..(402): n is a, c, t, g, unknown, or other
  misc_feature (407)..(407): n is a, c, t, g, unknown, or other
  misc_feature (408)..(408): n is a, c, t, g, unknown, or other
  misc_feature (520)..(520): n is a, c, t, g, unknown, or other
  misc_feature (521)..(521): n is a, c, t, g, unknown, or other
  misc_feature (748)..(748): n is a, c, t, g, unknown, or other
cgcggtggcggccgctctagaactagtggatcccccgggctgcaggaattcgcacgagaccattacctagaacatcctaatcgaaaactctcgatccggaaacctctcaaaccctagccgcctcctcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaggncacgaacacgcttctcatcatcgacaggggnatcgnnatgacaaagtccgaccttggcaacaaccccggtacatccgcaggtcgggaacaaggagttatggaacccccttgtgccggcccttattgtccataattgcccatttcggggnngtttataaactgcgcaccccccccaaaaaaagttttccacaccccccgcaccttgggggggtttttgggggggggcccccgggggggggttttttttttattttggaaacggggggggaatttttgggggaaaaaaaaaaacttgtctctctcaaaagaatttggtgatctcttgtggggccccccccccttgtgttaaaaaaacctctttttttcccccccccccn

SEQ ID NO: 22993 - protein, 84 aa, Zea mays
  misc_feature: Ceres CLONE 1393084-F
  misc_feature (73)..(73): Xaa is any aa, unknown, or other
  misc_feature (83)..(83): Xaa is any aa, unknown, or other
MASETETFAFQAEINQLLSLIINTFYSNKEIFLRELISNSSDALDKIRFESLTDKSKLDAQPELFIHLVPDRXRTRFSSSTGXS

SEQ ID NO: 22994 - DNA, 668 bp, Zea mays
  misc_feature: Ceres CLONE 1393090-F
  misc_feature: Encodes the peptide sequence at SEQ ID NO. 22995
acccgcggtggcggccgctctatcaatagtggatcccccgggctgcaggaattcgcacgagaccattacctagaacatcctaatcgaaaactcctggacggttcggtgtataaagctccggcgactggtgcccaccacggctagctgccgtcgtcgcagaagtaggagctctcgtttctccatcagtagtgattgggcagcatcgtcatcgatcgatcgccatgaggctccgcggcttgctgcgcctcgtcctcgcgctcctcctcgccgccaccgccatcgtgccggtgctgctccttagcgagacgggcggggcggcgccgtcccacctgcgccgccgttcaactcctcgcgtgtcaaggccgtctcgtggcatccaaggatcttcgtgtacaaggggttcctctccgacgccgagtgcgaccacctcgtgactctggcgaagaagaagatccagcggtccatggtggcggacaacgagtccggcaagagcgtcaagagcgaggtgcgcaccagctccggcatgttcctcgacaagcgccaggacccggtggtgagtcggatcgaggagagggtcgcggcatggacgtttcttcctcaagagaacgccgaaaacatgcaggtgctgcgctacgaagcgggggagaaagacgagccggacttcgact

SEQ ID NO: 22995 - protein, 68 aa, Zea mays
  misc_feature: Ceres CLONE 1393090-F
  misc_feature: SWISSPROT Homolog: EC 1.14.11.2 Procollagen-proline dioxygenase
MVADNESGKSVKSEVRTSSGMFLDKRQDPVVSRIEERVAAWTFLPQENAENMQVLRYEAGEKDEPDFD

SEQ ID NO: 22996 - DNA, 807 bp, Zea mays
  misc_feature: Ceres CLONE 1393094-F
  misc_feature: Encodes the peptide sequence at SEQ ID NO. 22997
  misc_feature (807)..(807): n is a, c, t, g, unknown, or other
atttctacctccctttccttcctcccttcccactcaaacattcaaaactggagctccaccgcggtggcggccgctctagaactagtggatcccccgggctgcaggaattcgcacgagaccattacctagaacatcctaacaaaaagcgttctgtggccgccgcccttctgccgtccgaccggaccaggtcgccgacgtcgcccctatcccgcacgcgtcatcgcagcgcctccgagtctccgccaagatctgcctcggccacggcgcggcgccgctggagctgcagccgtccagccgactgccttccgccgaccaccgaccaccgaccactggccgagccgccgcagctagctgcgctttgaagcatgggtcgttttgaacaagttactccagaaggccctgaaactaatcagcatgatgagcagcgctccatacgtttacatgcattttctgatctatcacacgtccctgcagccacttttatttatctcttaaaggactgcttatggatatggtacgaacaaagcaacctcataggttaagatcctcatgtagctggaaaaaggggactggattaatgagccacaaccaagtccggttcatatatgcactaccacgctcatgctacattttacactgtgttgttataaacgataagctcgccacggcagcagcactcatcttggccggcgctctgcgagcggaccagataagttgcagtgttccgacccccccccaccgtcccttagcagccttctactgtgccttcgtccgaaaccctatagtcccagtacacactcctgatan

SEQ ID NO: 22997 - protein, 58 aa, Zea mays
  misc_feature: Ceres CLONE 1393094-F
MGRFEQVTPEGPETNQHDEQRSIRLHAFSDLSHVPAATFIYLLKDCLWIWYEQSNLIG

SEQ ID NO: 22998 - DNA, 720 bp, Zea mays
  misc_feature: Ceres CLONE 1393095-F
  misc_feature: Encodes the peptide sequence at SEQ ID NO. 22999
  misc_feature (411)..(411): n is a, c, t, g, unknown, or other
  misc_feature (416)..(416): n is a, c, t, g, unknown, or other
acccgcggtggcggccgctctagaactagtggatcccccgggctgcaggaattcgcacgagaccattacctagaacatcctaatcgaaaagtccgccccccgccaccaccgcactcccatccagatgggagtgcgcaagaggagctttcggcattccggtctcgctcgaccaaccggatccccgtgagagtccccacccacaccccgagggcggcgtcgggtcgtcggggacagctgatttcacaagacgagccggcgagccggccggcatttcgtcgtcggatggcgccggcctcctcctcgtccgccggcgtcgcgtgcctcgtcctgctcctgctcctgctcctcgccggcgcctccgcggcgcacggctcgttccaggctaggcgtgctctgtcagatgaccatggnagcgntatagtggcgcgatggcggaggttgctcgacgacgctgtgaatcccgcgattaactctcttggggtggctcgcgccgagaactccccggagcgaccccttcgccaacctctacgggaacagtgcgggttggaacattagcgacgtccaccattgtgattttggtgacggaaccctgggatacccctcttccccttgcccgtgtgcggtacatgcgcccttacataaattacttcctactcccccccccctacttactacgtccaccacccagcctctaactactgcccctctccttgtcacctt

SEQ ID NO: 22999 - protein, 90 aa, Zea mays
  misc_feature: Ceres CLONE 1393095-F
  misc_feature (45)..(45): Xaa is any aa, unknown, or other
MAPASSSSAGVACLVLLLLLLLAGASAAHGSFQARRALSDDHGSXIVARWRRLLDDAVNPAINSLGVARAENSPERPLRQPLREQCGLEH

SEQ ID NO: 23000 - DNA, 664 bp, Zea mays
  misc_feature: Ceres CLONE 1393097-F
  misc_feature (256)..(256): n is a, c, t, g, unknown, or other
  misc_feature (267)..(267): n is a, c, t, g, unknown, or other
acagctggagctccccgcggtggcggccgctctagaactagtggatcccccgggctgcaggaattcgcacgagaccattacctagaacatcctaatcgaaaaattccactgtttctctctcgaaatcggccgtctctctcccgtccggcacttcctccgatcgactagcctgcggcggcgccggcgccggcgaccagcggccatgcgggtggcacccagggtgctcttccctcgtcgcgacgccgcgggctacggngctgccctcgncgaagcgctccggcccggcgccgggattaactagggagtcctcgcccctccaagctccccctgggaaagtacggcccccaacggaaaaaaagggtggggccaagttcccgaggtttttccgattccgggggttctccccgggggaccctttttgtgtttgccaaaaataaaaccccctccttggagggggggggggaaaaagggggttttggaaatggattttttttggagatccccccccgggggggagattttattttgcccccctaccccccaaaaagcgcggggtgttttttttgggggggagaaattgtccaaaaaggggtttccggggtgttctcggggggggggaaaaaaaggggggaaaaaaggggggtaaatcccccccggggggggg

SEQ ID NO: 23001 - DNA, 743 bp, Zea mays
  misc_feature: Ceres CLONE 1393098-F
  misc_feature: Encodes the peptide sequence at SEQ ID NO. 23002
  misc_feature (715)..(715): n is a, c, t, g, unknown, or other
aaagtggagctccccgcggtggcggccgctctagaactagtggatcccccgggctgcaggaattcgcacgagaccattacctagaacatcctaatcgaaaactgctagtgctcagtcctcgccctctcgctttccgagggagcctttgcctttcccctccgcccgccagccattaatggcggcggcatctccatccactcccccctcgcccccctcccactgctgctacttctagaagcgctggtggcagggcaggcggtatcccggccgctggcgctggcgcgagagttggttgggtggtggtgttcagcccccctccctcttcaggtttagggtggagcgatccgtgcaggccaacgcggggtgcgtgaccccaaagggaaaccgccgccttttttctcttctgccgccccgcttttccaatccctcctcaacctcatccgccccgcccgcaccatcaccaaaaaggtccccgccttcttcttcctcttctcctctgcccctgcttgtcgtttgctcgtgctcccccaccccctttctgattcagccagggttccttccgcggcgcggcgcgtcgccatgggcaactgctggggcgccaagatcagctccgacagcccctcccgcggcgcctcctccccgtcagggacggcgtccaagttggcgaagaggaaccgggcgccgccacccctgaagcgaggcagaaaccaagcgntgtccgcgtcaatgttgcccaacccccc

SEQ ID NO: 23002 - protein, 54 aa, Zea mays
  misc_feature: Ceres CLONE 1393098-F
  misc_feature (46)..(46): Xaa is any aa, unknown, or other
MGNCWGAKISSDSPSRGASSPSGTASKLAKRNRAPPPLKRGRNQAXSASMLPNP

SEQ ID NO: 23003 - DNA, 659 bp, Zea mays
  misc_feature: Ceres CLONE 1393100-F
  misc_feature: Encodes the peptide sequence at SEQ ID NO. 23004
  misc_feature (293)..(293): n is a, c, t, g, unknown, or other
  misc_feature (341)..(341): n is a, c, t, g, unknown, or other
  misc_feature (345)..(345): n is a, c, t, g, unknown, or other
  misc_feature (374)..(374): n is a, c, t, g, unknown, or other
ggcggccgctctagaactagtggatcccccgggctgcaggaattcgcacgagaccattacctagaacatcctaatcgaaaaacacaccactccacagcagtagcaagagggatagagcaaggccacacacacacacacaccactaggctagcctagccttttagtcgtcgaggaggagcaagaagggcgcgcacgcaagcaggcaagcaagaagagagccgatcgaccgagagctagcacgcgatggcgaggtcttccaagatgatggtggcggcagctctgctgggcttggncctggccgtgtcgatcgccgaggcgaggaaacatcagaccacgacgancganaagaaggacgacgcggtgggtgcagccgnaaaactttcccgcccttcgaccgcctcggggacgggggcgtcccccggggttcgggggccctccccgggggaagcattcctggaagaagaatttcccgggtttcacaatggcccgaaaggggaaaaacctaacccgggttttcattttggcccggaaggggaaaaatgccccttttttgggggggggggtccccggggttttagggggttttgggggggaagtgcccgggtccccccacgggggggtttttgtccccgggaaacccccaaaaagcggtggaaccc

SEQ ID NO: 23004 - protein, 138 aa, Zea mays
  misc_feature: Ceres CLONE 1393100-F
  misc_feature (17)..(17): Xaa is any aa, unknown, or other
  misc_feature (33)..(33): Xaa is any aa, unknown, or other
  misc_feature (34)..(34): Xaa is any aa, unknown, or other
  misc_feature (44)..(44): Xaa is any aa, unknown, or other
MARSSKMMVAAALLGLXLAVSIAEARKHQTTTXXKKDDAVGAAXKLSRPSTASGTGASPGVRGPSPGEAFLEEEFPGFHNGPKGEKPNPGFHFGPEGEKCPFFGGGGPRGFRGFWGGSARVPPRGGFCPRETPKKRWN

SEQ ID NO: 23005 - DNA, 756 bp, Zea mays
  misc_feature: Ceres CLONE 1393102-F
  misc_feature: Encodes the peptide sequence at SEQ ID NO. 23006
aaatttacaccccccacacacccaaacacacacaccaaaaaaatgttttttttcaaagctggtgctccccgcggcggcggccgctctagaactagtggatcccccgggctgcaggaattcgcacgagaccattacctagaacatcctaatcgaaaaacaccgcacacgcacgcacgaacgcgctcccaccccctcccgccgcaaacgccgccaaaaccccggcccgactcggcgtcctccgccaacctcctcctgggcagcgccggcggggggatatggcatcggaggacgtggtgggcaagagcaggggcgacacggccgtcaccaccatcgtcaacctggcggaggaggccaagctcgcgcgcgagggggtcaaggcgcccggtcaccagatcctcaccatctgcaagtcgctcgtcgccggcggagtagcaggcggagtgactcgtactgatgctgctccacttgaacgattgaaatattgcttcaggttcaaaagcccgacagcatcaagaacaatgggaccgctcacgaacccaaccaaagcgagcgaagagacagacccacgagaaacaattccgaggtcaccgggcacccactctcgcgttcgcctgcagaccccacccaccccaccccaacgcctcgcaagcccaccacccacgccagcaaaaagaaaaagatatgtaaagacattcccaccccccacactccctacccactacccattacaccgtccctgctacaaaacacccaacg

SEQ ID NO: 23006 - protein, 160 aa, Zea mays
  misc_feature: Ceres CLONE 1393102-F
MASEDVVGKSRGDTAVTTIVNLAEEAKLAREGVKAPGHQILTICKSLVAGGVAGGVTRTDAAPLERLKYCFRFKSPTASRTMGPLTNPTKASEETDPRETIPRSPGTHSRVRLQTPPTPPQRLASPPPTPAKRKRYVKTFPPPTLPTHYPLHRPCYKTPN

SEQ ID NO: 23007 - DNA, 745 bp, Zea mays
  misc_feature: Ceres CLONE 1393103-F
  misc_feature: Translation starting site: 207
  misc_feature (20)..(20): n is a, c, t, g, unknown, or other
  misc_feature (21)..(21): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (28)..(28): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
gtcccccccccccccccccnntnnnggngnnngggttgcggcactttaaaatagtgggactccccgcggaggcggccgcactacaactagaggatcccccgggctgcagttacccgcacgagaccattacctagaacatcctaatcgaaaaataaatcgataaagtaatcattcccaagtctataggtctctctctctctcgcgagatgacgaataagggaagcggatcgtcgttgagactctcaccggaaagaccgtcagccttgaggtggaaagctccgacacgatcgacaacgctgaagccaagattcacgacagggagggaatgccccgggatcagctaaggcttatcttcgtcggaaagtgactcgaggatggacgaactctcggtgagtacaacatccagaaggagccgatccttcatctcgtcctcaggctccgtgctggcatgcacatcttcgataggactcgttactggagagatcgatgacactccagggggagagctgcgacagcatcgacaaagtcaaagctaagatgcaagacaaggaggctatacctccccgaccagaaggggtttgatctttgccgggaagcatctcgagggacggcagaagcctcgctgattacaatatccaagagggagtcccactctccccttggaagatgcggtctacgtggcaggcgatgccgaatctttgtgacagacccccttaacgggccaagaccaattaaatctagaggg

SEQ ID NO: 23008 - DNA, 689 bp, Zea mays
  misc_feature: Ceres CLONE 1393107-F
  misc_feature: Encodes the peptide sequence at SEQ ID NO. 23009
  misc_feature (689)..(689): n is a, c, t, g, unknown, or other
gctctagaactagtggatcccccgggctgcaggaattcgcacgagaccattacctagaacatcctaatcgaaaaagtttgttcaactacatacgcaaatcggaatcgaaaccctatctcggatccgatggctcgttcgccgccgccttcttcgtcggccggcggcgcgcagtacgcgcagcagttcctcaacacggcgctctcccagcgggggccgtccgcgctgccgtacgccgaggacgtcaagtggctcatccgcaaccacctggtggcgctggccgaggccttcccctccctccatcccaaggccgccctcttcacccacaacgacggccgcgccgctcacctcctccaggccgacggcaccatccccatccaccacgccggtgcctcctacaaccttcccgccgtcatctggctgcccgagccctacccgcggtccccgccgttcgtcttcccctcgccgacccgagaaatggtcatcaagcccccccccccgctttgtcgacagctcccggctcggcggcaatgggccctaccttccggtccgggggctttccccccctccccacccctgtcgaccacgtgcggaatctttttcggcacctattccgcgcgttgaaaccgccatccttctacaaggaaatcccttctgggccccgcttaaaattcctgaaagccgaatccccn

SEQ ID NO: 23009 - protein, 164 aa, Zea mays
  misc_feature: Ceres CLONE 1393107-F
  misc_feature (43)..(150): Pfam Name: UEV Pfam Description: UEV domain
MARSPPPSSSAGGAQYAQQFLNTALSQRGPSALPYAEDVKWLIRNHLVALAEAFPSLHPKAALFTHNDGRAAHLLQADGTIPIHHAGASYNLPAVIWLPEPYPRSPPFVFPSPTREMVIKPPPPLCRQLPARRQWALPSGPGAFPPSPPLSTTCGIFFGTYSAR

SEQ ID NO: 23010 - DNA, 682 bp, Zea mays
  misc_feature: Ceres CLONE 1393113-F
  misc_feature: Encodes the peptide sequence at SEQ ID NO. 23011
cccacgagaccattacctagaacatcctaatcgaaaaatccaacgacccacactgagacgtcccctccccgctccgtcctctctcctctgccgccgagacgacgcgatggcggggtccgccgccttgccgccgatcgccgccttcgcgtcgctccttaccgcgcggcgcttcgccgccgccaggtccgcgctccggtccctgctcacgccgcgactactggcggtgccgttcgcgaacctcggcggctcgccacttacgcgcgccaagccgatacgcaccgggcagaagtctacaacactcgcctcttcagccttgactaccgctacatctgaatgctcaaattcgccgagacaatgctattacctacctactccccctccataaaataaatctatcctacctcattcttcctccccacatcctcgtacacttctcctgcctttacatccccctcaagcacagaactcaatacactaaacccaacctacccttacctcattatactatccctatacactacaaatccacaacgcatactctccctcccaccctcacccacttccctcacctctcttagaactcaccatcttcccaaccatttcataataactcctctctactcgatcaacacccacacgtctccaatacacaaaatacatcctaccaactaccacaactccg

SEQ ID NO: 23011 - protein, 92 aa, Zea mays
  misc_feature: Ceres CLONE 1393113-F
MAGSAALPPIAAFASLLTARRFAAARSALRSLLTPRLLAVPFANLGGSPLTRAKPIRTGQKSTTLASSALTTATSECSNSPRQCYYLPTPPP

SEQ ID NO: 23012 - DNA, 729 bp, Zea mays
  misc_feature: Ceres CLONE 1393115-F
  misc_feature: Encodes the peptide sequence at SEQ ID NO. 23013
  misc_feature (729)..(729): n is a, c, t, g, unknown, or other
cgcggtggcggccgctctagaactagtggatcccccgggctgcaggaattcgcacgagaccattacctagaacatcctaatcgaaaaagtaatcactcctcagtgctcactagcccaagtcgccctaaacctagcccgggcacccgccagaccagccagcccaacaacgcaaaacgcgacgcggccaccgccttgtccatgggctcctcggcgcagctcaggcggctgaagcctctgtaccagctggtggtgaacaacatcctgaccatcgtggccgtgccgctcgccgccgcggtcctgctcaaggcggcggagctggggcccgaggagatcctggcccgggcccgcgcgctccggccggcgcacatgctcctggcggagttcctgccggccgtggcgacggttctgtacctgacgctccggccgcgcgaggtgcacctggtgaactacgcgtgcattcgcaccaaccccaaatgacgcgtcccggttcgcgaacgttcccgaaacactcccgcgcgcagaaaggcttacaccattgggcaatcaaggttccagacccaaaaccacttttcttattggctagaaaaccaaatattaacgaggcaccataccccttaatccctcgcggacccttctccactcgtaccaactcttttgcagaccacacccccaccgtcttcttctcccaaccaacaggtccgcgtattctaatccgtcacacaggacacn

SEQ ID NO: 23013 - protein, 92 aa, Zea mays
  misc_feature: Ceres CLONE 1393115-F
MGSSAQLRRLKPLYQLVVNNILTIVAVPLAAAVLLKAAELGPEEILARARALRPAHMLLAEFLPAVATVLYLTLRPREVHLVNYACIRTNPK

SEQ ID NO: 23014 - DNA, 756 bp, Zea mays
  misc_feature: Ceres CLONE 1393117-F
  misc_feature: Encodes the peptide sequence at SEQ ID NO. 23015
cgcggtggcggccgctcttcaactagtggatcccccgggctgcaggaattcgcacgagaccattacctagaacatcctaatcgaaaaacacacacacactctctcgcttgacctacccccctccgccccccgccggacctgcagggtgttcgacgcttcgcccgcccgcccgagcgccgccacggcatggcttcctccatctccgccgccgctaaggcctccgcggcctttgcccaaaagaaggagctggccgcgccggcgccgcaccgcgcgggctcgagccgtcggaccaagccgtgccgcgtgcgcgccgtcgcgtcgcccgcgcgcaccccccgggccccgtcgtccaccggctcggtgaagaccgcgatgacgatgacgaagaagatcctggtgagggcgtcgtagcgcgcggcgctggagaccggaaagaacgtgtgcgtgaacatctacgagctcatgtacgaacgatggctgggcttcctctacatacctctatctactagaacgaaagtgacccgaccactcttccactacaccctcgtcgatgttctccccaatccacccaatactcaaaccgctactccgaaaagaataagctcgctcaaacaatacatacaccttagtgactggacaccccccccatctaaaaccaaatctcccataactaatcacctccgctccacagtaagttgctcccccttatcatccctttaactctacagcgtaagttaccacggatcactccccccc

SEQ ID NO: 23015 - protein, 74 aa, Zea mays
  misc_feature: Ceres CLONE 1393117-F
MASSISAAAKASAAFAQKKELAAPAPHRAGSSRRTKPCRVRAVASPARTPRAPSSTGSVKTAMTMTKKILVRAS

SEQ ID NO: 23016 - DNA, 725 bp, Zea mays
  misc_feature: Ceres CLONE 1393118-F
  misc_feature: Encodes the peptide sequence at SEQ ID NO. 23017
  misc_feature (393)..(393): n is a, c, t, g, unknown, or other
  misc_feature (442)..(442): n is a, c, t, g, unknown, or other
  misc_feature (447)..(447): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
tccccgcggtggcggccgctctagaactagtggatcccccgggctgcaggaattcgcacgagaccattacctagaacatcctaatcgaaagcaggagaaaccaaagaaaagttgctttttctttattttcttcgtcctcttgttctcgactcgctgcccactgcgtcacccgaatcccttcgatccaatctccaaaccctaggcagcccgccatcagattgttaggtcctccttccttaaaccgcggcggccggccatgtcccacggcggcggcggcgggagggcgaaagtgacgccgaacctggcggtggacggcgagggcacgcggacgctcaatctcaccgtgctgcagcgcctcgaccacgccgttgaggacatcctcatcaccgcggntcacgtcacgctctacgacttcgacaccgacatcaaccagtggagccgnaaggnacgtggagnnntcgctctttgggcgcaagaaggatgctcaacccagattcccagtctttggcttggaacccaagaaatacgaaaatccaagttgaaaattctttgggaaaattttgaaaaaccaataaaaagcccctaaatttagggacccgaatggggctcaagaaaatataggaattgcggtttaacattccccgggagggcgaaaaggtgtaaatcctttccacaaaggctacggagacttttctcaaaggggccaaccacgcgaaaattccttt

SEQ ID NO: 23017 - protein, 109 aa, Zea mays
  misc_feature: Ceres CLONE 1393118-F
  misc_feature (46)..(46): Xaa is any aa, unknown, or other
  misc_feature (64)..(64): Xaa is any aa, unknown, or other
  misc_feature (67)..(67): Xaa is any aa, unknown, or other
  misc_feature (68)..(68): Xaa is any aa, unknown, or other
MSHGGGGGRAKVTPNLAVDGEGTRTLNLTVLQRLDHAVEDILITAXHVTLYDFDTDINQWSRKXRGXXALWAQEGCSTQIPSLWLGTQEIRKSKLKILWENFEKPIKSP

SEQ ID NO: 23018 - DNA, 748 bp, Zea mays
  misc_feature: Ceres CLONE 1393125-F
  misc_feature (30)..(30): n is a, c, t, g, unknown, or other
  misc_feature (31)..(31): n is a, c, t, g, unknown, or other
ttttttttttttttttttttttttattttnnttattgacgttagcacgacaaacgtggaacgtccccgcggtggcggccgctttccaatagtggatcccccgggctgcaggacttcgcacgagaccattacctagaacatcctaatcgaaaaccccaaatccaacccttcgtactcagtttccatcattggcatggcgtccgataccgagggcatcgccgccctcttctcgatgtacaacgacgacgaggaagaggaggatgccgacgagctcagccctccttccccagcgcttcccgccgccgtcacctcctcctcgccgctgtcccctcaagccggggacgaggaccccaacccttctgtggcgccaccgacaccttcccgggccgaggaattgggcagtctcaaaaccctagcgagtccccacccttccccggagcgggggctgcttccgccacttccctcaaggagcacttcatcacccttgtgcatgtcgtccccctccccgctacggggaaccgttcttcgcgccacccgtaaacctgcccgcggcctccgcccggacgacgcccttgcaatcaacgtactacacggacgaccataccgactctgacgaccaccccaaaacccaaaatccaacacacacatcgaccacataaaaaaataggaaaacaaaagaaacaacgcagcggaaaacaaaaccttgtgaaagtaatacacatggggggcggccccattacctccactgt

SEQ ID NO: 23019 - DNA, 777 bp, Zea mays
  misc_feature: Ceres CLONE 1393126-F
  misc_feature (246)..(246): n is a, c, t, g, unknown, or other
  misc_feature (293)..(293): n is a, c, t, g, unknown, or other
aaagtggagctccccgcggtggcggccgctctagaactagtggatcccccgggctgcaggaattcgcacgagaccattacctagaacatcctaatcgaaaagccgcaacccctctctcattttcttcctcgtctacacctccttctctcctcctcgatacattcgagcacgcccggacgcggtcagaagggagaaagcagcaagcggcgccggggttccccttcccttcgtcgcccccgatcgacngcgatcggggccgactgctcgtgggggacgccgaaccgaagcccggncggcgctgcttcatatacgggaagcaggttctagatttctttacgtcggccgctgcaggtttcagtttccagggggttccccccagttggctaataactttattggtgggtggaccggggggtggtttttttcggaaattggccaagttggtttttgttggattttccccagggtgaacaccccttgggggggggaaaaacttttgtattttttggggccgaagtttgtttttatattaaagacaaattggggtgggccagggggcctaaaaatttttgtgggggacaaaaataaggaacccccgtggggggttttctttaaaaaaaatagcgcgcctgggttttaaaatttaaaaaaacccccttggtgttggtagaaaaaatttattttttcttccccaaaccccacgaggggggggggagaaaaattttttctcccccccccggggttttaaaaagggggggggcaccccccccccctttt

SEQ ID NO: 23020 - DNA, 799 bp, Zea mays
  misc_feature: Ceres CLONE 1393127-F
  misc_feature: Encodes the peptide sequence at SEQ ID NO. 23021
  misc_feature (254)..(254): n is a, c, t, g, unknown, or other
  misc_feature (328)..(328): n is a, c, t, g, unknown, or other
cgcggtggcggccgctctacaactagtggatcccccgggctgcaggaattcgcacgagaccattacctagaacatcctaatcaaaaaaaaaaacatcactccctcgcgaaccccaagaactgcagcgacggcaatgcgatggcggcggagggcgcggcgagcgagccagagctggtgtcgatcccggcgacgccgcacggtctgtcgacgccggagggcgcggccacgccgaccggagcgtgcggtggcgtcgncgtcagaaacaggtctcccggaccccagggcgtcgcgtggtggagggcctgcgcggtcacctgtaggacggggncaacttcacgggccttcaaccgggggtaggcgggttgcccctcacctaaaagccggggggtaacccccactaacccgtttttacttccccctaagccgggggtcggccttaaaaagaatttttccccccccgttcgcttttgggagaaaggggggggggggtggggagaaatatctgggggcacgctcgtttattaccgccccaatagctacaccccgcccccccctcggtacgctttcatcggacgttggtcccatcatcccctctcctagactatcgctccctttcactacccagccactgcagcacaacatcatcgggcgtccttcttctaccctctctcaatcccctcctccccacctatctacgcagaaaataccctcctccaatagatcgcggccacccacaccatatgcaaaggtcattctactagattgtgtctcaacctacactttccctatatcttcatct

SEQ ID NO: 23021 - protein, 85 aa, Zea mays
  misc_feature: Ceres CLONE 1393127-F
  misc_feature (41)..(41): Xaa is any aa, unknown, or other
MRWRRRARRASQSWCRSRRRRTVCRRRRARPRRPERAVASXSETGLPDPRASRGGGPARSPVGRGQLHGPSTGGRRVAPHLKAGG

SEQ ID NO: 23022 - DNA, 746 bp, Zea mays
  misc_feature: Ceres CLONE 1393128-F
  misc_feature: Encodes the peptide sequence at SEQ ID NO. 23023
  misc_feature (1)..(1): n is a, c, t, g, unknown, or other
  misc_feature (14)..(14): n is a, c, t, g, unknown, or other
  misc_feature (20)..(20): n is a, c, t, g, unknown, or other
  misc_feature (30)..(30): n is a, c, t, g, unknown, or other
nttttttttttttnttgggnattattagtntattgtataataggttttccaaaagctggagctccaccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggcgacgctgttcccgctgggcgggctgctgctggtgctgtcggggctggcgctgacggcctccgtgggtggggctgaacgcgcccacgccggtgttcctgatcttcagccccgtgctggtccccgcagcgctgattatcatgaacggccgtcatggggtacatcaagccgaggggcgctgaatgatcccgtgaatctacgacaatcccaaaacgaaaacaaacagcaaatccataccacaccgcaaaccccgacaccccccaaaggaggaggccgcatagcactcctagcgccgaccccacaccatcacaacaggcacagaaccggacctaaacgc

SEQ ID NO: 23023 - protein, 163 aa, Zea mays
  misc_feature: Ceres CLONE 1393128-F
MADRDRSGIYGGAHATYGQQQQQGGGGRPMGEQVKGMLHDKGPTASQALTVATLFPLGGLLLVLSGLALTASVGGAERAHAGVPDLQPRAGPRSADYHERPSWGTSSRGALNDPVNLRQSQNENKQQIHTTPQTPTPPKGGGRIALLAPTPHHHNRHRTGPKR

SEQ ID NO: 23024 - DNA, 721 bp, Zea mays
  misc_feature: Ceres CLONE 1393129-F
  misc_feature: Encodes the peptide sequence at SEQ ID NO. 23025
  misc_feature (395)..(395): n is a, c, t, g, unknown, or other
  misc_feature (407)..(407): n is a, c, t, g, unknown, or other
  misc_feature (649)..(649): n is a, c, t, g, unknown, or other
tggagctccccgcggtggcggccgctctagaactagtggatcccccgggctgcaggaattcgcacgagaccattacctagaacatcctaatcaaaaattcccgttccccaattcgaaatcgagtcgggtcggtcttgccgtgcgtgcgtggctgcgcgaaccagcccacgctcccactccccgcccgccaccgccgggtccctctagggttttgccgcgatgtcgctccggccgagcgagcgggagcagatgcggaagggcaactacaagcagacggtggacgccgaggagagccgccgccgccgcgagggccagatggtcgacatccgcaaggccaagcgagaggaaagcctccagaagaagcgccgcgatgggttcccccgccgccggcgcgngccgccgatggnccactccaccgcactccagaaaaagctcgatggcttggcggcgatggaaaaggccgtttacttccaagaccccattgtgaagtttgggcccccacgcatttagggaagtggttctctaaaggggaacccccaattgagaaggtggtccgccagggttcggcccccattaattggttccttaacgggggggacatccccacttccgtgtgggggtgttggggcccctcccattttgttcgggnactataaaaaaacattgggggtgggtagaagggccctgcccccctttttttcgcgcctatctcttgaggggg

SEQ ID NO: 23025 - protein, 96 aa, Zea mays
  misc_feature: Ceres CLONE 1393129-F
  misc_feature (4)..(95): Pfam Name: IBB Pfam Description: Importin beta binding domain
  misc_feature (59)..(59): Xaa is any aa, unknown, or other
  misc_feature (63)..(63): Xaa is any aa, unknown, or other
MSLRPSEREQMRKGNYKQTVDAEESRRRREGQMVDIRKAKREESLQKKRRDGFPRRRRXPPMXHSTALQKKLDGLAAMEKAVYFQDPIVKFGPPRI

SEQ ID NO: 23026 - DNA, 743 bp, Zea mays
  misc_feature: Ceres CLONE 1393131-F
  misc_feature: Encodes the peptide sequence at SEQ ID NO. 23027
gctctagaactagtggatcccccgggctgcaggaattcgcacgagaccattacctagaacatcctaatgaaaaacatgccacattgccaccaagccacagttccacctttcgattcatgcacgctcagtcatgggcgccctccggagtttagccatctcctacccggagttcctcgtggccgggctgtgcttcgtctccctctcggccctgcgccacgcgatgcgtgagcggcggcaacgcgcccccctgagctggcctgtggtgggcatgctcccgttcgtgctcgcgaacctcgggcgcctctacgacgccatcaccgacgccctccacgggtccgggtgcacgctcatgttccgcgggccgtggctcgcccgcgcggacttcctgctgacgtgcgacccggcgaccgcccagcaactgcctgacgtccaaccacgggggtttacaacagggaaccgagactttgacggagatgccttcacctcccggcgcccacgcctggtgagttccaccactcccactacctgctcccccatctttctcctcccacgccacctctcccgctatttctttcgattattcccgatatccagccttcacacaacctatatccccacccctcgcctgtattccaccccctgctcttactccatgtctttattatccacccaccccgacccatcaatttcaccgatcagcaccgaccatcttttgatttgtttttttaccgagcgccgcgtat

SEQ ID NO: 23027 - protein, 204 aa, Zea mays
  misc_feature: Ceres CLONE 1393131-F
MGALRSLAISYPEFLVAGLCFVSLSALRHAMRERRQRAPLSWPVVGMLPFVLANLGRLYDAITDALHGSGCTLMFRGPWLARADFLLTCDPATAQQLPDVQPRGFTTGNRDFDGDAFTSRRPRLVSSTTPTTCSPIFLLPRHLSRYFFRLFPISSLHTTYIPTPRLYSTPCSYSMSLLSTHPDPSISPISTDHLLICFFTERRV

SEQ ID NO: 23028 - DNA, 754 bp, Zea mays
  misc_feature: Ceres CLONE 1393132-F
  misc_feature (7)..(7): n is a, c, t, g, unknown, or other
  misc_feature (8)..(8): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (21)..(21): n is a, c, t, g, unknown, or other
  misc_feature (28)..(28): n is a, c, t, g, unknown, or other
  misc_feature (75)..(75): n is a, c, t, g, unknown, or other
tggtccnnccnnnntnnnnancaacaantgacatgtgggtcatcctccaaaactgcactccaccgcggaggcggncgcattcaaaaagaggatcccccgggctgcattccctcacacgagaccattacctagaacatcctaatcgaaaaagccttatccccaaatcgcttcttctctgttgattccatggtgcatcagccgagctcctctccctggccgatccatggtgctcgtctctagctcatgtcttgccgccggccgagcccctccccagcgcccttggagccggcgtcctctgccctcatctcattccccgacgccgccctctcccctcggtgctctgctggtcggcgtcttctccctgcccgacgtttctggcgccatggacgccgcgccttgggtcgcctgctccactgcgccgatccgcccatctccctgctgccgctctcccatggcgcgtccctgcatcttgcttcagcccgctctgccatctcccttggcgccctaaccccaacgccgagctccctaccccggtcgcgcccccggtggttgaactcgccgagcttccttttctatccctcgacctcccccattcggcgccctcatctcaaggccagaccagcctcctctaccaccccactcctcctcctaatcccctttgcaggaaaagaacatggccgaagctaaacccccatggcgcccagggagaagtttcgtcaattcccctgaaaacaagacccttgcaatgcggagg

SEQ ID NO: 23029 - DNA, 707 bp, Zea mays
  misc_feature: Ceres CLONE 1393137-F
  misc_feature: Encodes the peptide sequence at SEQ ID NO. 23030
cgctctttaatagtggatcccccgggctgcaggaattcgcacgagaccattacctagaacatcctaatcgaaaaattttttcatttcttccccccttctcgtcacgtccaaaggggggaaaacttctttctctctcttttttttccctcccccgcccgaatctgatgcttaaaccctcgccgggaggaggattccaatcccgacgcaccagcccgcgcccgccacctacagccgcgcccggatctccgccatggccgccgcgccgcaccaggcccagggccccgcagatagtgtgattccgctgcagtctgaacccgcacttgataataacccctccaagagtgcaaacgccagggaccagattctttctggtacggagaatgtgactacaggcaatgcacgcggcggcagctccttgaaatcgcaaaaaggcccgccagagaaggctagctctgttggaaaacctggagaacaaccttttccctaccagcaaaatgtgtatgcaccacagccacaaccactctatcctggaggctacatgaacccttcaggacaatgggaggaatatccccattatgtggagtatggaggggctccattccgtatctcccggaatctacaatgacaaccaatccctcatgctatctcctggatatgcaaacaaccccaaatgatgtatggagcatattctcctgttccaccggttg

SEQ ID NO: 23030 - protein, 124 aa, Zea mays
  misc_feature: Ceres CLONE 1393137-F
MAAAPHQAQGPADSVIPLQSEPALDNNPSKSANARDQILSGTENVTTGNARGGSSLKSQKGPPEKASSVGKPGEQPFPYQQNVYAPQPQPLYPGGYMNPSGQWEEYPHYVEYGGAPFRISRNLQ

SEQ ID NO: 23031 - DNA, 673 bp, Zea mays
  misc_feature: Ceres CLONE 1393138-F
  misc_feature: Encodes the peptide sequence at SEQ ID NO. 23032
aaagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggtagcaatggcggaccgtgaccgcagcgtcatctacggcggcgcccacgccacctacggtgagcagcagcagcaggtaggaggcggacgcccgatgggtgagcaggagaagggcatgctccacgacaaggggccgacggcgtcgcaggcgctgacggtggcgacgctgttcccgctgggaggactgctgctggtgctgtcggggctggcgctgacggtctccgcggtggggttgctcgtgctcacgacggtggtcctgatcgtagtgcacgtgatggaccccgccgatgatgtgatagtagacgtcatgatgaaagaccgtgctgatcacaagatcaatttcatctattgcgatggtatggaggtcttagacaaattggttaacgacaaccaggagtttgatttcatatttgctgatgctgacaagccaaactacctcaacttccttgagagatttctgaaattggtgaaggtg

SEQ ID NO: 23032 - protein, 156 aa, Zea mays
  misc_feature: Ceres CLONE 1393138-F
  misc_feature (28)..(156): Pfam Name: Methyltransf_3 Pfam Description: O-methyltransferase
  misc_feature: SWISSPROT Homolog: EC 2.1.1.104 Caffeoyl-CoA O-methyltransferase
MADRDRSVIYGGAHATYGEQQQQVGGGRPMGEQEKGMLHDKGPTASQALTVATLFPLGGLLLVLSGLALTVSAVGLLVLTTVVLIVVHVMDPADDVIVDVMMKDRADHKINFIYCDGMEVLDKLVNDNQEFDFIFADADKPNYLNFLERFLKLVKV

SEQ ID NO: 23033 - DNA, 659 bp, Zea mays
  misc_feature: Ceres CLONE 1393139-F
  misc_feature: Translation starting site: 460
  misc_feature: Pfam Name: Amidohydro_1 Pfam Description: Amidohydrolase family
  misc_feature: SWISSPROT Homolog: EC 3.5.2.3 Dihydroorotase
gctctagaactagtggatcccccgggctgcaggaattcgcacgagaccattacctagaacatcctaatcaaaacttaatgtttccaaggttctgtggcagtgcgaggcattttgggaggtggtgagcgcctcgcttggcaccttcattttcgtgatgatgctgtccttcaggctgcagtgccacacaagttcgtttggtgtaggtgctgcttgatttttggcggtgcatgccgggtgttcgacaatgtttctgaggttttgtggcagtgcgaggcattttgggagggacatcatcatgcccaacttgaagtcgtccgtgaccacaacagcgagcgcggtggagtacatggatgaagtattgaaggcgttgtcgccagccgccgccgccgacgacggaggagcagcacctctcgtctgtccaccgctgaccgctcgtttgtcagcctagcaccggtgtgcatgaacgcccagtatatgctacagcaccgccgcccctggccctgccgcctgcgccggtcgttgccctgtgcactccgcgggcctcggaaatggctaccaggacatttgatcgggtgggccccctctcctctcttctcttcacccccggccggtctccctctctccctactttccggataccgatcgcgagtagaccaagg

SEQ ID NO: 23034 - DNA, 649 bp, Zea mays
  misc_feature: Ceres CLONE 1393140-F
  misc_feature: Encodes the peptide sequence at SEQ ID NO. 23035
  misc_feature (407)..(407): n is a, c, t, g, unknown, or other
  misc_feature (415)..(415): n is a, c, t, g, unknown, or other
  misc_feature (418)..(418): n is a, c, t, g, unknown, or other
  misc_feature (421)..(421): n is a, c, t, g, unknown, or other
  misc_feature (444)..(444): n is a, c, t, g, unknown, or other
  misc_feature (448)..(448): n is a, c, t, g, unknown, or other
  misc_feature (455)..(455): n is a, c, t, g, unknown, or other
  misc_feature (463)..(463): n is a, c, t, g, unknown, or other
aaagctggagctccccgcggtggcggccgctctagaactagtggatcccccgggctgcaggaattcgcacgagaccattacctagaacatcctaatcaaaaaaaatcctccgaaccccgccgccgacgagcgagctatggcgctggcgcggcggctgctccgccttactccctacctcggcacgctctcgctcccaccccccaactcgcatctcctccggaatcgcacctatatctctgacatgcgccgctctgccttcgtcgaccgcttgctccgttccgtacgctccgagatctccttcctcgataactccgccccgccaccgccaccaccgcctcctaagccattcaccattgaggaccgcccgggcgagcagtgggcccgcctgcgccgcgtgtcctgcgggncgaggggnagnaanaggaggcaggggggacgccacgntggncgacggngcgctccnccctcccgctcgggcgcggacacgggcgggccgcccagaatgcatatcagtgttaagggtgaggcctcccaggccgcgcgggctggagtgccgctccacttcgagtgctccgcgtggcctgacgagatggaggggcggagggtcttttcccgtccggcggggggggggcccgcccccagggaaaaa

SEQ ID NO: 23035 - protein, 171 aa, Zea mays
  misc_feature: Ceres CLONE 1393140-F
  misc_feature (91)..(91): Xaa is any aa, unknown, or other
  misc_feature (94)..(94): Xaa is any aa, unknown, or other
  misc_feature (95)..(95): Xaa is any aa, unknown, or other
  misc_feature (103)..(103): Xaa is any aa, unknown, or other
  misc_feature (107)..(107): Xaa is any aa, unknown, or other
MALARRLLRLTPYLGTLSLPPPNSHLLRNRTYISDMRRSAFVDRLLRSVRSEISFLDNSAPPPPPPPPKPFTIEDRPGEQWARLRRVSCGXRGXXRRQGGRHXGRRXAPPSRSGADTGGPPRMHISVKGEASQAARAGVPLHFECSAWPDEMEGRRVFSRPAGGGPAPREK

SEQ ID NO: 23036 - DNA, 688 bp, Zea mays
  misc_feature: Ceres CLONE 1393142-F
  misc_feature (325)..(325): n is a, c, t, g, unknown, or other
tccccgcggtggcggccgctctagaactagtggatcccccgggctgcaggaattcgcacgagatcattacctagaacatcctaatcgaaaaaactttagcagcaaaattcacccaaaagaaactcctgataaatagaaaaaggagggaaaaagaaaaacacttgcagcggcatccaccaccgaagctcccatcatcggtctatccctccgtgtcaaccccctcctcagaagttctaattgcagttcagcccctggccggtccgccgggccaccggaaggagccgctcgccggaggaagccccccatctccttgccctgcggcggngtttatggggttctcgctgtaccccatgaagacgtccacgcggttgctctggagcactagcttcttccgccataagctcagctcctcctcctgcttcctctgagcccgccccacccgcgtcgatcacctcggcggcggcccgctgttgctgcgcggtcctagcacccgttcgagtgtgtgtgtttgcgtcctttgagtttcccgattgggtcccgttggccccttgggttgactactggtctattgcacatcgagcaaacaacaaacagcacagttcgagggggcttcgatctaccatttatccgcgcccccacctttttatagcgatcaacgcagtttcgcgcgattagaacctactgactt

SEQ ID NO: 23037 - DNA, 714 bp, Zea mays
  misc_feature: Ceres CLONE 1393149-F
  misc_feature: Encodes the peptide sequence at SEQ ID NO. 23038
gctctagaactagtggatcccccgggctgcaggaattcgcacgagaccattacctagaacatcctaatcgaaaactccctccctcctccattggactgcttgctccctgttgaccattgggtattctgaaccatcgagccatggctgccaagctgactcgcctccacagtcttcgcgaacgccttggtgccaccttctcctcccatcccaatgaactgatagcactcttttccaggtatgttcaccagggcaagggaatgcttcagcgccatcagctgcttgcggagtttgatgccctgtttgatagtgacaaggagaagtatgcaccctttgaagacattcttcgtgctgctcaggaagcaattgtgctccccccatgggttgcacttgctatcaggccaaggcctggtgtctgggattacattcgggtgaatgtaagtgagctggctgtggaggagctgagtgtttctgagtacttggcattcaaggaacagctggtggatggacaatccaacagcaactttgtgcttgagcttgattttgagcccttcaatgcctcctttcctcgttcttccatgtcgaagtccatcggaaatggagtggaattccttaaccgaacactggccgcccaagtgtcccaggacaaggaaagtttgcaacccttgctgaacttcctcaaggctcaaaacaaaaagggcaccacagagaatgtga

SEQ ID NO: 23038 - protein, 191 aa, Zea mays
  misc_feature: Ceres CLONE 1393149-F
  misc_feature (6)..(191): Pfam Name: Sucrose_synth Pfam Description: Sucrose synthase
  misc_feature: SWISSPROT Homolog: EC 2.4.1.13 Sucrose synthase
  misc_feature: The sequence is a functional homolog of SEQ ID NO 12 in US patent 7091398
  misc_feature: The sequence is a functional homolog of SEQ ID NO 2 in US patent 7091398
MAAKLTRLHSLRERLGATFSSHPNELIALFSRYVHQGKGMLQRHQLLAEFDALFDSDKEKYAPFEDILRAAQEAIVLPPWVALAIRPRPGVWDYIRVNVSELAVEELSVSEYLAFKEQLVDGQSNSNFVLELDFEPFNASFPRSSMSKSIGNGVEFLNRTLAAQVSQDKESLQPLLNFLKAQNKKGTTENV

SEQ ID NO: 23039 - DNA, 760 bp, Zea mays
  misc_feature: Ceres CLONE 1393152-F
aagctggagctccccgcggtggcggccgctctagaactagtggatcccccgggctgcaggaattcgcacgagaccattacctagaacatcctaatcgaaaagcattctccaatatccacctcctcctcgcccccctctctctctctaaaagaactgaaaagataagggggaaatcctcaagtgctcgttacataaaccctaacctcgttggattcgcagcaaaagcccaccaattggaagccctccgatgttccagctgcatgctggagctgagccgtgctcggtttgacgaaattttgcatcccttctgtgcttggaccacccgattgaggctgtttctccgagggggcgtgccagcggtttcgcggcccaggtcctcacctgtgctatccggcgccggatccgggtttgttccggtgagaggtcgggtttttggtggggtctgtccttcttgtcgcccttcttcgctgtctcgggtcgcccgcgctgtttgcggctgtgcctccctgcgtcccccttcctccgtttgtgtctccccccccccgccccttgtcccgctcttgctttgcactgctcttctggctttcctccttccccccggtttgacgactgtccctctttacgctcgtccgtggcacgctctgcccagcgcgagcgtttcaactacctcgtccctaactgtcctaacgacttctaaccccccttcatcgttccgcgagcccacccgctgctacattattactcccacggctcgcatatg

SEQ ID NO: 23040 - DNA, 716 bp, Zea mays
  misc_feature: Ceres CLONE 1393153-F
  misc_feature: Encodes the peptide sequence at SEQ ID NO. 23041
  misc_feature (537)..(537): n is a, c, t, g, unknown, or other
gctctagaactagtggatcccccgggctgcaggaattcgcacgagaccattacctagaacatcctaatcaaaaaatctctcatttcctcacgcacgtctcgcaactgccgcggcacaccgcgccgcttctcctcctcctcctcctccttccgagccgagagaaaggctgctgccagagggacgagggcgagcgaggatccttccgagcgatggagcagtacgaggtggtggagcagatcggccggggcgcctacggctccgcctacctcgtcctccacaaggccgagcgcaagaggtacgtcatgaagaagatccgcctctccaagcagaacgacaagttccagcggaccgcttaccaggagatgtccctgatggcaagcctcagcaacccgtacatcgtcgagtacaaggacggatgggtggacgaggggacctccgtctgcatcgtcacaagctactgcgaaggaggggacatggccgagaggatcaagaagggaaggggcatcctattctcagaagagagggggtggcggtggntcacgcaattggtcctcgccctcgactaccctggctgcaaccgtgtgctccaccggggtccccaagggttccaccattttattggacagggataacaatatcagactcgctggctttgggctggccaaactcgccaaggaggaccttggcctcctcggatgagagaacccccaactaat

SEQ ID NO: 23041 - protein, 140 aa, Zea mays
  misc_feature: Ceres CLONE 1393153-F
  misc_feature (4)..(136): Pfam Name: Pkinase Pfam Description: Protein kinase domain
  misc_feature: SWISSPROT Homolog: EC 2.7.11.1 Non-specific serine/threonine protein kinase
  misc_feature (110)..(110): Xaa is any aa, unknown, or other
MEQYEVVEQIGRGAYGSAYLVLHKAERKRYVMKKIRLSKQNDKFQRTAYQEMSLMASLSNPYIVEYKDGWVDEGTSVCIVTSYCEGGDMAERIKKGRGILFSEERGWRWXTQLVLALDYPGCNRVLHRGPQGFHHFIGQG

SEQ ID NO: 23042 - DNA, 705 bp, Zea mays
  misc_feature: Ceres CLONE 1393155-F
  misc_feature (365)..(365): n is a, c, t, g, unknown, or other
  misc_feature (366)..(366): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (400)..(400): n is a, c, t, g, unknown, or other
  misc_feature (401)..(401): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (424)..(424): n is a, c, t, g, unknown, or other
  misc_feature (441)..(441): n is a, c, t, g, unknown, or other
  misc_feature (463)..(463): n is a, c, t, g, unknown, or other
  misc_feature (489)..(489): n is a, c, t, g, unknown, or other
  misc_feature (497)..(497): n is a, c, t, g, unknown, or other
  misc_feature (537)..(537): n is a, c, t, g, unknown, or other
  misc_feature (538)..(538): n is a, c, t, g, unknown, or other
  misc_feature (543)..(543): n is a, c, t, g, unknown, or other
  misc_feature (563)..(563): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (580)..(580): n is a, c, t, g, unknown, or other
  misc_feature (616)..(616): n is a, c, t, g, unknown, or other
  misc_feature (656)..(656): n is a, c, t, g, unknown, or other
  misc_feature (658)..(658): n is a, c, t, g, unknown, or other
  misc_feature (659)..(659): n is a, c, t, g, unknown, or other
  misc_feature (661)..(661): n is a, c, t, g, unknown, or other
  misc_feature (662)..(662): n is a, c, t, g, unknown, or other
  misc_feature (669)..(669): n is a, c, t, g, unknown, or other
  misc_feature (670)..(670): n is a, c, t, g, unknown, or other
  misc_feature (691)..(691): n is a, c, t, g, unknown, or other
ccccgcggtggcggccgctctagaactagtggatcccccgggctgcaggaattcgcacgagaccattacctagaacatcctaatcaaaaaacagcccaggcacacacgactagaaccaggcaaccagctgcggagggaggaaacctagcggaacactgtgcaggtgacggcggcgcgctaccggtgacaggggatacggcggcatcgtcccctcctccatccccggcgcggcggctccagcagccggcctgcaggcacacaagtggccacccttccaatggcggtggagaagtccagcagcggtacgaggatggccgtcggctagtggccggatgcataccatttaggtatagagctaacaatgnncnnnnnncnnnnnnnnnnnnnnnnnnnnnncccnncnnncccctcccccccccccccnccccccccccccccccncccccccccccccccccccccncccccccccccccccccccccccccncccccccncccccccccccccccccccccccccccccccccccccccnnccccncccccccccccccccccccnccnnnnnnccccccccncccccccccccccccccccccccccccccccccccncccccccccccccccccccccccccccccccccccccccncnncnnccccccnnccccccccccccccacccccncccccccccccccc

SEQ ID NO: 23043 - DNA, 666 bp, Zea mays
  misc_feature: Ceres CLONE 1393156-F
  misc_feature (195)..(195): n is a, c, t, g, unknown, or other
aagctggagctccccgcggtggcggccgctctagaactagtggatcccccgggctgcaggaattcgcacgagaccattacctagaacatcctaaaaaaatcgatcagtcgcgtgtctaggtttcctctctcaccatagcgcccgctctgtcgcccttcgttcacctctccttcctctcgtccctgcctggcaggnagaggggaagtcagaggcacggagtggcgcagagcagacgcccgtgaaccattgtagctgtccctgtcgtcgtcgtcggtcacgaaccacctcaggtaaggatgggaaagaaagccaccatcctcctgaacatgtacgaagtcgggggcacgcttcggcaggggaccttctcccaagggggacccgggcggaaacccccggccggggggagagggggcatccaggccttcgaaaagagaaaggttttccccccccccttttccaccaaaaaagggggggaattcccggtggggcccccccccccccccccatgtgtggaattggcaaagggggggccccccaaaaaaaaaaaaaaatcccccccggggaaacacccgggggggggaaattttttccccccccccccccggcgccccacaaaggggccccccccaaaaaaaattcccccccctcccggggggcgggcgattt

SEQ ID NO: 23044 - DNA, 718 bp, Zea mays
  misc_feature: Ceres CLONE 1393157-F
  misc_feature: Translation starting site: 333
  misc_feature (324)..(324): n is a, c, t, g, unknown, or other
  misc_feature (362)..(362): n is a, c, t, g, unknown, or other
  misc_feature (402)..(402): n is a, c, t, g, unknown, or other
  misc_feature (424)..(424): n is a, c, t, g, unknown, or other
  misc_feature (425)..(425): n is a, c, t, g, unknown, or other
  misc_feature (471)..(471): n is a, c, t, g, unknown, or other
  misc_feature (633)..(633): n is a, c, t, g, unknown, or other
acccgcggtggcggccgctctataactagtggatcccccgggctgcaggaattcgcacgagaccattacctagaacatcctaatcgaaaaatatacgccgccatattcgcaagccaccgcaaccgaagcgcgccttcgccgccgcccccgcccccgccgcctctgcgatccccgcaaggtcgcaaacatgtctaccgtgctccagcgcccgacccccggcacggtccagtgcttcggccgcaagaagacggctgtggccgtcgcctacaccaagccggggcgcgggctgatcaaggtgaacggcgtcccgattgagctcatcanggccggagatgctccgcctcaaggccttcgagcccatnctggctggcggggcgctccaggttcaaggacatcgacatngaggatcccgcgtccgaggcgnncgggaaagaccgtcgcagatctacgccatcccgccaggcccgtcgncaaagggggctcgtcgcctaactaaccagaaggtacgtcgacgaggccgcccaagaaaggaggtcaaggacatcttcacccggtacgaccgcacccttctcgtcgccgaccccaggcgctgcgagccgaaaaaattcgggggtcggggcgcccgcgccaggntccagaagtcctaccggtggacgcttcgctgcccgctctttgcggaaagttgcctgtgttgcccccatttgccaatcgatgcctg

SEQ ID NO: 23045 - DNA, 676 bp, Zea mays
  misc_feature: Ceres CLONE 1393159-F
  misc_feature: Encodes the peptide sequence at SEQ ID NO. 23046
  misc_feature (315)..(315): n is a, c, t, g, unknown, or other
aaagctggagctccccgcggtggcggccgctctagaactagtggatcccccgggctgcaggaattcgcacgagaccattacctagaacatcctaatcgaaaaaaactaaccccaaaccccaatccaccccatcccctcctcatccactccgggcggccatggcctgctccttctccgccgccatcaccgtctcttccgcccctaccccggccgccagacccctcgctgctgccccgcagtccgtctgcatcgctcgctccgcggtcgccaccactgccaggccgctccgcctcgccgcctcagggtccgcgcggnctaccagactcgttgcccgcggcagcgtagtcgatgactttgccgctggtcgggaacaagggcgccagacttagaaggccggagctgtgtccgaaccagaagttcatcaacggggaagctctctgattacttgggggaagaagtaccgtcatttctggtccttctacccccttggatttcaaccttcctcggcccgaacgagaataatggggtttaatggacggataccaagaatttggagaagtggaaaccgtgagggttttgggggtttccattggaaggggggtccccccccctttgatgggggaaaaaaaaaaggaaaaccgggggggctccgggaattttaaaaaacccattgttg

SEQ ID NO: 23046 - protein, 76 aa, Zea mays
  misc_feature: Ceres CLONE 1393159-F
  misc_feature (53)..(53): Xaa is any aa, unknown, or other
MACSFSAAITVSSAPTPAARPLAAAPQSVCIARSAVATTARPLRLAASGSARXTRLVARGSVVDDFAAGREQGRQT

SEQ ID NO: 23047 - DNA, 706 bp, Zea mays
  misc_feature: Ceres CLONE 1393161-F
  misc_feature: Encodes the peptide sequence at SEQ ID NO. 23048
  misc_feature (518)..(518): n is a, c, t, g, unknown, or other
  misc_feature (534)..(534): n is a, c, t, g, unknown, or other
  misc_feature (706)..(706): n is a, c, t, g, unknown, or other
caccgcggtggcggccgctctagaactagtggatcccccgggctgcaggaattcgcacgagaccattacctagaacatcctaatcgaaaacgaaaaattcgaaagatccctccaggaaagatttttcttccctcctccgacgccccagcccaccaacacactctataaagcagccctcagtcacacacagaacgcacaagcgcaagccgggcaagaaaactccgtaggccagtctgcgagttggatggccttcttcttggccctcgtgtgcatcctcatcttgctagccatcgcctcctacgtccagtacactcgctggcaaaaggggaaaggccgcttcggcggccatgggaggtctgctcccttgaagctgcctcctggctccatgggctggccttaccttggcgagaccctccagctttactcccaggaccccagcttcttcttcgcttccaaacagaagaggtacggcgagatcttcaagacgcaccttctgggttgcccgtgcgtgatgctgncgagcccggaagccgncgcggttcgtgctgctgaagcatgcggacctggttcaagccggaccactcgcgcagccggatctccaccgaaccgactttaccactattattctcactccgcgtgtttacaacggcccaccacccccacactatactgtccaggccgcgctacccacacgccctcatgtacn

SEQ ID NO: 23048 - protein, 154 aa, Zea mays
  misc_feature: Ceres CLONE 1393161-F
  misc_feature: SWISSPROT Homolog: EC 1.14.13.93 (+)-abscisic acid 8'-hydroxylase
  misc_feature (92)..(92): Xaa is any aa, unknown, or other
  misc_feature (97)..(97): Xaa is any aa, unknown, or other
MAFFLALVCILILLAIASYVQYTRWQKGKGRFGGHGRSAPLKLPPGSMGWPYLGETLQLYSQDPSFFFASKQKRYGEIFKTHLLGCPCVMLXSPEAXAVRAAEACGPGSSRTTRAAGSPPNRLYHYYSHSACLQRPTTPTLYCPGRATHTPSCT

SEQ ID NO: 23049 - DNA, 739 bp, Zea mays
  misc_feature: Ceres CLONE 1393162-F
  misc_feature: Encodes the peptide sequence at SEQ ID NO. 23050
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (364)..(364): n is a, c, t, g, unknown, or other
  misc_feature (418)..(418): n is a, c, t, g, unknown, or other
  misc_feature (434)..(434): n is a, c, t, g, unknown, or other
  misc_feature (535)..(535): n is a, c, t, g, unknown, or other
aaagctggagctcaccgcggtggcggccgctctagaactagtggatcccccgggctgcaggaattcgcacgagaccattacctagaacatcctaatcgaaaaaaaacgactggctgtccgaacggggacgtctggttcctctcattccccttccacctcgctctctctctctctcctcccactgctcgccctctctctcttacgcgcgcgtgacaacctccctccctccactgcgcgcggcgcgggagcagcagcggcagcacccaccgactgatcgccggtgggcggggcgggggcgatctgatgcgggcgcggcggtgatggcagcgccatccggcggtgggggcggcggtgcgnnnnaggnctcctcctcggccgccgcagctgcgacgatcggggtccacgggggggaccaagntgcagaggcgatgtgncagatgaatttggaagaagccatggaactggggccatacccagagcgtgttggtgagccagactgtagctattacatgaggactggaatgtgcagggttgnaatgacctgaaaatttaatcacccagcagacagaaagttggctgttgctgctggaagaatgaagggagaatatcctcaaagaattgggcagcctgaatggcaatactatctgaagactggtacgtgcaagtttggagcaactttggaggttcatcattcccgaaaaaaggctggatgggaaactccaagttcattgcaagaaca

SEQ ID NO: 23050 - protein, 74 aa, Zea mays
  misc_feature: Ceres CLONE 1393162-F
  misc_feature (13)..(13): Xaa is any aa, unknown, or other
  misc_feature (14)..(14): Xaa is any aa, unknown, or other
  misc_feature (15)..(15): Xaa is any aa, unknown, or other
  misc_feature (33)..(33): Xaa is any aa, unknown, or other
  misc_feature (38)..(38): Xaa is any aa, unknown, or other
  misc_feature (72)..(72): Xaa is any aa, unknown, or other
MAAPSGGGGGGAXXXSSSAAAAATIGVHGGDQXAEAMXQMNLEEAMELGPYPERVGEPDCSYYMRTGMCRVXMT

SEQ ID NO: 23051 - DNA, 740 bp, Zea mays
  misc_feature: Ceres CLONE 1393163-F
ccccgcggtggcggccgctctattctagtggatcccccgggctgcaggaattcgcacgagaccattacctagaacatcctaaaaaaaaaaatcacacgcccatctagtcatatacgttcctggaggatcccaacccgtagcctctaaactgacacaacggcaccgcgaaccaacgcgcccgatgatggtgcgccacaggtgtaacgagctcgccttgaccgcggatacaccgagtgagcggaccttcgacgcgtgaggcgcgctgggctgcggacgccaccgctgctccagcgcagcgctcgcggcgcgcgcgtcgactcgcacggacccaccgaagtgtggggcgagctctgccggtccgtgctctgtccgtctgtccccttcgccgtccaccggatgctctactacggttgcttcgccgggttcccgtctcccacgccgccgcctggacgcccgaccccaaggaggctgtcttgaccaatgtcggacgtgtactcgagccgcgcgatagtttattcctctcctaccctctatatgcttccttccctacattttccacatctcctagccattcttcctcgcatacctacaggcccctcaaccatctgccttttccttattctggtatcctatgctacgacgcatccttccttcctgccttcgctatcattatccttctcatattttctgattatccctctaaaacgcctttctctcacccccatatctccacgtacctc

SEQ ID NO: 23052 - DNA, 698 bp, Zea mays
  misc_feature: Ceres CLONE 1393164-F
  misc_feature: Translation starting site: 237
ccccgcggtggcggccgctctatttctagtggatcccccgggctgcaggaattcgcacgagaccattacctagaacatcctaatcgaaaagggtctccgtgtcgtctctgcgactccacttgctcttttcgctggccctggctacttgcggcaactcccatctccacgcgctctcccatccgagatctcaaccgcctcgccggcgagcgactgacgggcggacggtcccgccggctatggggaactgctgctccgatgaggtgagccacgccggtgctcatcccgtcggctccgccaccgccaaagccgcctccgcagcctccgccgcggccgatcgctttctccgctcccgtggtgccggcgcgtccacgcagatcgagttatctctctctgcatcaaatttgggtgatcaagaatattttcccaagagtaatcccatgggtggttgtgtattccaaaaagagagatggtacactagaagaaattgggcgcagtgaagtaattttaaattcattgaacccattttggacgaccaaaatcagtgtgcagtaccagtttgaggttcttcacgaattggtgtctcaggtctttgacatccaccagcacgttcacgaggacccacacaaccgcgttaacgcagcctcaccctcccttcacgacaaccctacctgccccttcgcaccagcgccctcctcacc

SEQ ID NO: 23053 - DNA, 700 bp, Zea mays
  misc_feature: Ceres CLONE 1393165-F
  misc_feature: Encodes the peptide sequence at SEQ ID NO. 23054
  misc_feature (655)..(655): n is a, c, t, g, unknown, or other
tccccgcggtggcggccgctctagaactagtggatcccccgggctgcaggaattcgcacgagaccattacctagaacatcctaatcgaaaagacttcatactgctcgcctcgccgtctttcccccaatctgttgctcctccaagctgcgggcgatcgccgtaccccggccgccgcagggaaccccctcgccatggccttgcaggggaagaagctcatcaacaaccccgacgatgtggtgacggagttcatcgaagggttggtggagacttacccgggtctgcagtacctcgacgggttccctcagattaaggtcgttcttcgtgctgatgtccagcgcggttcctatgacaaagttgcagtcatctcgggtggtggaagtggccatgaaccttcccatgctggatttgttgggccagggatgttgacagctgctgtttctggagatgttttcgcctctccacctgttgattctattttagctgctattcgagctgtaactggtcccatggggtgccttctaatagaaaagaactacactggtgatagactcaattttggaatagctgctgagcaggcaaaatctgaaggctataagatggagatggtcattgttggagatgattgtgccctttctcccactagagggatagttgntacaaaaagtttaagttgcaacaatctcttgtgcaaagcgttctt

SEQ ID NO: 23054 - protein, 169 aa, Zea mays
  misc_feature: Ceres CLONE 1393165-F
  misc_feature (22)..(169): Pfam Name: Dak1 Pfam Description: Dak1 domain
  misc_feature: SWISSPROT Homolog: EC 2.7.1.29 Glycerone kinase
  misc_feature (155)..(155): Xaa is any aa, unknown, or other
MALQGKKLINNPDDVVTEFIEGLVETYPGLQYLDGFPQIKVVLRADVQRGSYDKVAVISGGGSGHEPSHAGFVGPGMLTAAVSGDVFASPPVDSILAAIRAVTGPMGCLLIEKNYTGDRLNFGIAAEQAKSEGYKMEMVIVGDDCALSPTRGIVXTKSLSCNNLLCKAF

SEQ ID NO: 23055 - DNA, 711 bp, Zea mays
  misc_feature: Ceres CLONE 1393167-F
  misc_feature: Encodes the peptide sequence at SEQ ID NO. 23056
  misc_feature (711)..(711): n is a, c, t, g, unknown, or other
gctcagaactagtggatcccccgggctgcaggaattcgcacgagaccattacctagaacatcctaatctaaaaatccagctgagctgatcatcatgggctactgtgcgtgcgaggggacagagaatctagtgctcataagcaaccaccactcagtcctcctcctctaccctttcccttccgccgagttcctacttggtcctatagggagagagatctcgaactccaagggcgcatgctccgggtgctagatacgatgccgtgtgcgtagctgcggcagcccttgatcgatcaatcgatcgcttgtgcggaaggagccggatccgagtggagtcagctagctagatactccgtgggcgtcgtcgtcgttggacgtacgccagaagagggagctagagaagaattaccgtacagctgcttccaacatgccagctgcctcgtctgcccacctgttcggactcggcgagggaaagatgcagatgcatccgcaacaggagcagccgccgcctcctcctctttgggacaaacccggccgcgccgcccgacaaagaaaaatcgcaaccaaccctgcagacccttgacgcggtgggtgatccatcttttcccccccagaccctcatagggttatctactcgcctctctccacgtttctacttcgcttctctatgtccctccatctcccacacttgaatctctctcaccctctgctcatn

SEQ ID NO: 23056 - protein, 51 aa, Zea mays
  misc_feature: Ceres CLONE 1393167-F
MGYCACEGTENLVLISNHHSVLLLYPFPSAEFLLGPIGREISNSKGACSGC

SEQ ID NO: 23057 - DNA, 809 bp, Zea mays
  misc_feature: Ceres CLONE 1393170-F
  misc_feature (1)..(1): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (36)..(36): n is a, c, t, g, unknown, or other
  misc_feature (44)..(44): n is a, c, t, g, unknown, or other
  misc_feature (47)..(47): n is a, c, t, g, unknown, or other
ntttccccccccccccccccccatccnnntnnnntntgtacccnccnccaaagctggagctccccgcggtggcggccgctctagaactagtggatcccccgggctgcaggaattcgcacgagaccattacctagaacatcctaatcgaaaaacaggtaattgccttcctgtgtcgggattgtagctccaatccactccgcgccggccgggtgcgctgccatccggatcagacgccctcgcatctctcgcccttccggcatcgtatcccctgggcggcagcggagtaaagatccgacccgcttgggattgtttgcttctcctttttgcggcgcgccgctggactccagtggctgcacatgctcgacgacggtgctgagctcctgcaatggcccgaaaaaatgccgccgcaatgcagcgggagggttcgggggggatcgttttaaggactgctcggaaatttcggaaccttcgccgtctcccaagttggcggaactcgacagccctaactccgccatgaaaagggcttgttgacggccgggtggctttctcttgggaccctggtccttggacggtcgaagcacccctccaagttctccttggggcccaaagcctttggtccattcgcacaaggcaacggctccggtcccattgggaaaggggccccaaaaggcacaaagggggaattggacattgggaaagaagaggcccaatggtttcccccccttgggttttgctgggggctttcttatatagggcggatagtttcttttctttgttggggttccccccaccccgatttctttcctcct

SEQ ID NO: 23058 - DNA, 844 bp, Zea mays
  misc_feature: Ceres CLONE 1393171-F
  misc_feature (18)..(18): n is a, c, t, g, unknown, or other
  misc_feature (21)..(21): n is a, c, t, g, unknown, or other
  misc_feature (22)..(22): n is a, c, t, g, unknown, or other
  misc_feature (36)..(36): n is a, c, t, g, unknown, or other
  misc_feature (52)..(52): n is a, c, t, g, unknown, or other
  misc_feature (53)..(53): n is a, c, t, g, unknown, or other
tgtgcacccccccccccnccnncacccccccccccnaatggggtccttcatnncaaagctggggctccccgcggcggcggccgctctagaactagtggatcccccgggctgcaggaattcgcacgagaccattacctagaacatcctatccgaaaaaaccgcgccgctctctctctctttctctctcgcacgagccgcgccggcgccgccaccacgcgcgcgggagacagagaccacagccgcagccaccgacgggcggaataggaatggtggcgccggggggaggagcaggaggaggtccgttgcggtgcccggcggcggaggagcttgacactgtacggaagaaaggtggtggagattagtgcaaagggatgaacaagaggttatgggttgctgctaggcccctacagaatttggacctttggggggctcataatggatcatcaggggtgggaagacatccccagctaatgaccataaaattatgggaggaactccctttgggtttccgttcccctccaaagggggccctgggggggttatacctttccttttctggggaccaggttttggaagggggggctaataaagaaattcccgaaggttgagagggactttggcaaaaaagccctaatgtggataaacccccggaaaaacaataaaaaccggggaggaaaagttattcggcaaacagggtgggcgggttaaaggggcaccgggggaaaaaaaaaggggggaaatggatccttaagggaaaggggttttcccataagggaatttattttttcggggggggggagaaagggcccttgggataaaacttccgagggtctccaactttctc

SEQ ID NO: 23059 - DNA, 650 bp, Zea mays
  misc_feature: Ceres CLONE 1393172-F
  misc_feature: Encodes the peptide sequence at SEQ ID NO. 23060
  misc_feature (480)..(480): n is a, c, t, g, unknown, or other
tggagctccccgcggtggcggccgctctagaactagtggatcccccgggctgcaggaattcgcacgagaccattacctagaacatcctaatcgaaaagatccgccactacgccacaaaatcctctcctactccggcagttctgctcgccgccgcctccacgatgacggaagacgtgcagatgaacgactcggagccccagcctgcggcctcagctcccgccgtcggggcgccggcgctctccacactacaccatctgaaggagatcgcgtccgtgatcgaggccggttctctgtccaaggaggtccgccggatctcccgcgccttccgcctcaccgtcgcgctccgtcgccgcctcgccgcgcgggacgtctccgccttcctcgccttcgcgctacccgcgtccctccgaagcctacggacgcctcactgccctgggtgccaaaggaagatgatactgaaatggatttttaatgctgaanttcccagaaactcaaatttcaaccaaaaatggggccccccggaaatggaaataaaatggcaactttggcccggaagggattttcctttttgggccaaaaaaaaaaatgttgggggttaaggcttcgcccaggggggaaactttttcccccccaaaaaaaataaacaccgg

SEQ ID NO: 23060 - protein, 145 aa, Zea mays
  misc_feature: Ceres CLONE 1393172-F
  misc_feature (107)..(107): Xaa is any aa, unknown, or other
MTEDVQMNDSEPQPAASAPAVGAPALSTLHHLKEIASVIEAGSLSKEVRRISRAFRLTVALRRRLAARDVSAFLAFALPASLRSLRTPHCPGCQRKMILKWIFNAEXPRNSNFNQKWGPPEMEIKWQLWPGRDFPFWAKKKNVGG

SEQ ID NO: 23061 - DNA, 763 bp, Zea mays
  misc_feature: Ceres CLONE 1393173-F
  misc_feature (180)..(180): n is a, c, t, g, unknown, or other
  misc_feature (192)..(192): n is a, c, t, g, unknown, or other
  misc_feature (207)..(207): n is a, c, t, g, unknown, or other
  misc_feature (208)..(208): n is a, c, t, g, unknown, or other
  misc_feature (672)..(672): n is a, c, t, g, unknown, or other
aagctggagctccccgcggtggcggccgctctttaactagtggatcccccgggctgcaggaattcgcacgagaccattacctagaacatcctaatcgaaaaaccagttcgggatcgtcggacacaggcacggcacgagctcagccggcggcggcagagcgggaaggacctcaactcttcntccctccccctnctcttttttttcttnnaacacctcttcccttcttttttctcccccttacctttttttccttcttttctttcttttcctcttctttttttttcttttcgttttttttttcccctttttttttcttttttcttcttcccttctttctctacctcttctactctcctccttcctttccccccccccgttcctcattatctctattccctagctactctttccccccccctcttcctcctatgctttctctaacactactccgtccctctcttcttctacatttctctccccccactttttcctccctcatcccctcttttcttcttttcttacctcttcctctatcttttttctctttacttttttccttttctcttcttccttttttttcttctccttctccctttcttttctcttttttttttccttttctccactactcctctcttctctctttcttctcttccccatcacaccctctcnctccttccctcattctcctcccgccctctttttctcaccattcttcaaccctccctctctcccctttcctttatcttttcttttttaatag

SEQ ID NO: 23062 - DNA, 690 bp, Zea mays
  misc_feature: Ceres CLONE 1393175-F
  misc_feature: Encodes the peptide sequence at SEQ ID NO. 23063
  misc_feature (336)..(336): n is a, c, t, g, unknown, or other
ggagctccccgcggtggcggccgctctagaactagtggatcccccgggctgcaggaattcgcacgagaccattacctagaacatcctaatcaaaaaaaagcgatgcgcagctccgtaaccacttcgtcctcacttctcagtccaccttcccaccgcaaccacttcaccacctcctcacagtcccagcaatggagctagtagcgtggctcgtcatcgtgtcctcagtatccctcgctgggctcctgccagtggtctcggcgtcgacgacgacaccgcagcagcaatgtggcggcaataatgtcggacctgccggagtgagagcaggctactggtcgncgtcctcgaaccgctactccgcggtcggcagcatcgacgcgtccctgtacacgcacctctactacagcgcggtgaccatcgacgagagaagctgcgcggtcgcgccgcctcccgcgagggccgaaggcgcctcgctgctcgccggctcttcttgtggggggtaaatccgggagcccgcccccaggaaccgggcttgtccgtttgcacggacgaaaaacaggggggggcgagtccaaaggccgcctttctccaggatgggggaccgaaaccgggcctccccccgggggggggggacaaaaaactcccctcccgggaaacttggcccgcgcccaaagggttttcgaacgcccgggg

SEQ ID NO: 23063 - protein, 103 aa, Zea mays
  misc_feature: Ceres CLONE 1393175-F
  misc_feature (50)..(50): Xaa is any aa, unknown, or other
MELVAWLVIVSSVSLAGLLPVVSASTTTPQQQCGGNNVGPAGVRAGYWSXSSNRYSAVGSIDASLYTHLYYSAVTIDERSCAVAPPPARAEGASLLAGSSCGG

SEQ ID NO: 23064 - DNA, 682 bp, Zea mays
  misc_feature: Ceres CLONE 1393177-F
  misc_feature: Encodes the peptide sequence at SEQ ID NO. 23065
  misc_feature (586)..(586): n is a, c, t, g, unknown, or other
aaagctggagctccccgcggtggcggccgctctataactagtggatcccccgggctgcaggaattcgcacgagaccattacctagaacatcctaatcgaaaaaatctgaagcaaaatgtaccgggaatgttgaagagcgggactcttaagcagtagtgagatgcggcggtggtggtcgccggcgttggcggctgtggagccgcggtccgtgcagctcctgctcctgggcgtcgctctcgtcgcagcttctttctacgccggcaccctcttcggctcctccgcgtcccctgcgctcgtactgcccccttcgcgcccccgatcgcccgattccttcagggccaaagttacagatgttccagtgtttaccaacagagtttctcgtacgtaccgggcaaaatcagtgacagttccagatcacggagttgatgtgtgtcctttggaaatacatgagtatgtcccctgccatgatggagcctatataagcagcttggagagcctggatacatctaggcatggagatcttgaaagtatttgtcctcatgggagaagcggttgttttgtttggtgccccctcccaatgactacnagataccataagatggccaacagccgagactacgtatggcgtagtaatgtcaaccttcacatcttgctgaggccaagggagacagaactgggtgct

SEQ ID NO: 23065 - protein, 174 aa, Zea mays
  misc_feature: Ceres CLONE 1393177-F
MRRWWSPALAAVEPRSVQLLLLGVALVAASFYAGTLFGSSASPALVLPPSRPRSPDSFRAKVTDVPVFTNRVSRTYRAKSVTVPDHGVDVCPLEIHEYVPCHDGAYISSLESLDTSRHGDLESICPHGRSGCFVWCPLPMTTRYHKMANSRDYVWRSNVNLHILLRPRETELGA

SEQ ID NO: 23066 - DNA, 766 bp, Zea mays
  misc_feature: Ceres CLONE 1393181-F
  misc_feature: Encodes the peptide sequence at SEQ ID NO. 23067
  misc_feature (13)..(13): n is a, c, t, g, unknown, or other
  misc_feature (14)..(14): n is a, c, t, g, unknown, or other
tttgggtccctcnncccctctcgggggtatccccgtgggtgagtgtggttgttcaaagctggtgctccccgcggtggcggccgctctacaatagtggatcccccgggctgcaggtaattcgcacgagaccattacctaacatcctaatcgaaaacctttccccgctcttctcccacacaaacgccaccgccgcatcgaatccgagacgccgatctcggattcgccgtcaccacacgctgccctcgtcgcgctctcccgccgccgccgctcgtctcgtcagccatggcaggattggcaccagaagggtcgcaatttgatgacaagcagtatgacaagaaaatgcaggagatattaactgaagacttcttcacttcatatgatgatgtttgtgaaagttttgacagcatgggactgcaagagaaccttctgagaggcatctatgcctatggttttgagaggccatcggctattcagcaaaagggggattagttccctttctgacagggggcttgacggtgattcaacaagctcagtctgggaactggaaaaacaggtaactttctggtctgggaatcttgcaggaacttggaataatggattgggttggaagggccgggcattgggttccttggcccaaacccgggggagttgggtcaaaaaaatgggaaaagggttatggggggcgtcttgggggaaatatattgggggggtcaaaaggggcaggccctggggggttgggggaaaaacctttgtttttgcgagaaac

SEQ ID NO: 23067 - protein, 68 aa, Zea mays
  misc_feature: Ceres CLONE 1393181-F
MAGLAPEGSQFDDKQYDKKMQEILTEDFFTSYDDVCESFDSMGLQENLLRGIYAYGFERPSAIQQKGD

SEQ ID NO: 23068 - DNA, 659 bp, Zea mays
  misc_feature: Ceres CLONE 1393183-F
  misc_feature: Encodes the peptide sequence at SEQ ID NO. 23069
  misc_feature (421)..(421): n is a, c, t, g, unknown, or other
  misc_feature (423)..(423): n is a, c, t, g, unknown, or other
  misc_feature (424)..(424): n is a, c, t, g, unknown, or other
  misc_feature (437)..(437): n is a, c, t, g, unknown, or other
  misc_feature (487)..(487): n is a, c, t, g, unknown, or other
  misc_feature (515)..(515): n is a, c, t, g, unknown, or other
  misc_feature (522)..(522): n is a, c, t, g, unknown, or other
tcaccgcggtggcggccgctctagaactagtggatcccccgggctgcaggaattcgcacgagaccattacctagaacatcctaatcgaaaaagaactgactccctcgatcccagcggcagcggcggaagcgaacggtgaccgcgacctcccctgaccctgaggctgcatatactcggatcgggtttcacatctccggttttggattggttggttgcccgcggtgatgggaggagagctgtggtggtatccataggggatcctcgtttgcgtccttgtgcgatggcttcgacctccgttcctgagttaaccgcggacaagaaatgcgacaaagccatcgcggatacggcggcaccacttacttctcagggacactcccgaagaacgactgggaaagtcagcacactagtgcctgctttgccngnntgtaattgcagcnagcgatggggctgcatccagtgggggtgatagaaaacagaatggcatggnacattctgctgatggttctttgaagcgnatgaaangtgaagtgctgaaagagctcgctgccggggacgtcaggaaaactcgctggccgctaaatgcagggacaaggcgagccacctgtcaaaaggcagggggacggcaaaatccggggtcaactgctgacttgatcgaaagg

SEQ ID NO: 23069 - protein, 61 aa, Zea mays
  misc_feature: Ceres CLONE 1393183-F
  misc_feature (48)..(48): Xaa is any aa, unknown, or other
  misc_feature (53)..(53): Xaa is any aa, unknown, or other
MASTSVPELTADKKCDKAIADTAAPLTSQGHSRRTTGKVSTLVPALPXCNCSXRWGCIQWG

SEQ ID NO: 23070 - DNA, 747 bp, Zea mays
  misc_feature: Ceres CLONE 1393184-F
  misc_feature: Encodes the peptide sequence at SEQ ID NO. 23071
  misc_feature (10)..(10): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (49)..(49): n is a, c, t, g, unknown, or other
ggggccccgnccnnnccnnncccgcggcaccaccacagcgcccccgtgntgcaaagctggagctccccgcggtggcggccgctctatacctagtggatcccccgggctgcaggaattcgcacgagaccattacctagaacatcctaatcgaaaaagagcagccgacaactctctaccgtccgagaccccaagcaccagcgcggcggcggcggcggcggcgaccatggctgtcgggaagaacaagaggatctccaagggaaagaagtttaagatctgttccacagatcacgcgtgcgcgctcgcgaatcgggggttccacacatagcttcgtcgttttgaatttgatgtactaatggagtctaagggtggcaagaagtctagcagtagtcgttccatgatgtatgaagctccccttggctacagcattgaggacgttcgacctgccggaggcgcgaagaagttccagtctgctgcttactccaactgcgcaaagaagccatcctgatatcccttttggcttcctcgttctagtaagattaggatttcttttctgacacttcgattcttaccaatccccctgggctgctgctttcctgacaatcgaccagtttccccagtctgggttccctgcaggcctccctcctccatcttccagcggttggtgttctgactcacctgcaaccaaaggggtggatcttttctggtggctggcgcctccccccgggctcccagcttatccggggttcc

SEQ ID NO: 23071 - protein, 50 aa, Zea mays
  misc_feature: Ceres CLONE 1393184-F
  misc_feature (1)..(50): Pfam Name: AdoMetDC_leader Pfam Description: S-adenosyl-l-methionine decarboxylase leader peptide
MESKGGKKSSSSRSMMYEAPLGYSIEDVRPAGGAKKFQSAAYSNCAKKPS

SEQ ID NO: 23072 - DNA, 643 bp, Zea mays
  misc_feature: Ceres CLONE 1393185-F
  misc_feature: Encodes the peptide sequence at SEQ ID NO. 23073
  misc_feature (467)..(467): n is a, c, t, g, unknown, or other
  misc_feature (558)..(558): n is a, c, t, g, unknown, or other
gctctagaactagtggatcccccgggctgcaggaattcgcacgagaccattacctagaacatcctaatcgaaaaattaattaacaaagagaagacttcttccttcctcgtcgtctccagcccattccaattcttgattccatcgccccaccatccacaactcccctaatccttccaacctcctcgtcgtccagtccaccacctccacgcgcaatggccagcggctaggcggcaccaaccagatcacaaggattcgtttcatccggcagcgcagctctagagcctccatgggcagctacgcgtacaagtactgtatgtgcttcacgcgcaagttccgatccccggacgcccagccgccgccggacgtccgcgccgcccacctctccttcgcctctgacgcccatgccctccgccgcttcgtcgccggcgtccagggcgagtcccccgccgacgtcgaccgcatcctcngcatgctctccgggggccacagccatggaatccgccgcctcgtcacaaggtcggcggcggcatccacgcccacgctcgaagacttcttcgncttcctcttctccccgacctcacccacccatcgcgcacaggttcacaggacttgtcagcgccgtctctcactatttcgtgtcacc

SEQ ID NO: 23073 - protein, 119 aa, Zea mays
  misc_feature: Ceres CLONE 1393185-F
  misc_feature (61)..(61): Xaa is any aa, unknown, or other
  misc_feature (91)..(91): Xaa is any aa, unknown, or other
MGSYAYKYCMCFTRKFRSPDAQPPPDVRAAHLSFASDAHALRRFVAGVQGESPADVDRILXMLSGGHSHGIRRLVTRSAAASTPTLEDFFXFLFSPTSPTHRAQVHRTCQRRLSLFRVT

SEQ ID NO: 23074 - DNA, 580 bp, Zea mays
  misc_feature: Ceres CLONE 1393187-F
aaactggagctccccgcggtggcggccgctctataatagtggatcccccgggctgcaggaattcgcacgagaccattacctagaacatcctaatcgaaaaccttcgctgtcctctctggctaaaaagaaccgcagaaagatcgttttttttccctgtccccgttcttgcactcgagttcttcagttcttaggaatagtcagacggaacaactcgagtttgccatggtggtgatctggaaccggggtgtgctgccccctctttgattccctgattggtctcgctccagttcgacgcgggatttggacgggacgggcggaagttgggagagcagagcggccggcatgttttggtcccagggtccaaggatgaggtgaaatgcaaggagcctacaacaggactttcggagggagacaaatcacctaagcttggatcaactaacgggctgacaaatggggaaaaaaaaaaatttgaaaaacccggaattttaaggggtaaaggaaaaaaaaacctgggcccacggggttttaaaacccgggaaaaaatttttcccggaaagggaaaaggggttccccttgtggg

SEQ ID NO: 23075 - DNA, 656 bp, Zea mays
  misc_feature: Ceres CLONE 1393188-F
  misc_feature: Encodes the peptide sequence at SEQ ID NO. 23076
  misc_feature (147)..(147): n is a, c, t, g, unknown, or other
  misc_feature (300)..(300): n is a, c, t, g, unknown, or other
  misc_feature (403)..(403): n is a, c, t, g, unknown, or other
  misc_feature (409)..(409): n is a, c, t, g, unknown, or other
  misc_feature (410)..(410): n is a, c, t, g, unknown, or other
  misc_feature (472)..(472): n is a, c, t, g, unknown, or other
  misc_feature (525)..(525): n is a, c, t, g, unknown, or other
tccccgcggtggcggccgctctagaactagtggatcccccgggctgcaggaattcgcacgagaccattacctagaacatcctaatcgaaaaacctcctatggccaccgtcgactgccccctgccctctcccgcggacctcgacgacnacggattcccggctctaccctcatcccccgctgcctgtagcagcggcttcgcggaggacttctaccgcagcggcaccgactggtcctccttacgcgcccctccgccgctggggccgcccagaaggcacccggtgtgaaggagagaggaggcgnctcggccgtgcagagcagcctcttccaggcgtgggggatcgagaagccgcggcgggacgggcgtggggctgattcatcgcttgtgcagaggagcctcttcagncatggnngatcgagagacgccaaaggggaggtctcgggggctggagatccctccccctcctctcccttncgggtcctttggtggcaggaagcggaggcgagaaaccaccaggaaggaacggntggccgccaagaagcccctcgggtgcccttctaaaagaaaatccctggacacattccccggggatgcatttcggaatggacaaggtggagggggttcggcctaatttcttaacccctttctcagggccttg

SEQ ID NO: 23076 - protein, 61 aa, Zea mays
  misc_feature: Ceres CLONE 1393188-F
  misc_feature (17)..(17): Xaa is any aa, unknown, or other
MATVDCPLPSPADLDDXGFPALPSSPAACSSGFAEDFYRSGTDWSSLRAPPPLGPPRRHPV

SEQ ID NO: 23077 - DNA, 795 bp, Zea mays
  misc_feature: Ceres CLONE 1393190-F
  misc_feature (12)..(12): n is a, c, t, g, unknown, or other
  misc_feature (21)..(21): n is a, c, t, g, unknown, or other
  misc_feature (22)..(22): n is a, c, t, g, unknown, or other
  misc_feature (29)..(29): n is a, c, t, g, unknown, or other
  misc_feature (30)..(30): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
tttttttttaantttttttannagaaaannannntaannnagaaccagaaaaaaaagggtgggactccccgcggtggcggccgctctagaactagtggatcccccgggctgcaggaattcgcacgagaccattacctagaacatcctaatcgaaaatcggctcccaccttcctccgttgcctcctcttccgcggccccgtcgatgggcttggctttaccagtggcgggttcccacacgggggctagacgccgccaccgctgaccccgtctacaccgaatcccccgcgcgatttaacccctcgcatcgctcgccgcctccgcttccatacaaccgcgcactccaaacgcgcacgcgctgttcgatcctcgggcgctctctccaccccctccttctccgcccccaacagatctccgccgggccgggcggatcccttaaattcgccttctccggggactgtcggatctcccgcgggggctgaggaatggggcaactggctgcgtggacgccaaaaaagcaaccgaacgacgcccggcgggcggccaagaaaagcccaagggagcttgaagcaggaaagaagggtaaagaaagccgaaccccctttctccgaacgaagaacaaaccgtttcggggacaaggcgaaggggcgccaaaaacttgggggggtgcctgccggcaatcccccacgggggggggaaacattggggggggggggggaaaaaaagtttcaggggcgcggaaacctcgggtggcggggaggagattctcagggcgttacacactaccctcttgggcag

SEQ ID NO: 23078 - DNA, 666 bp, Zea mays
  misc_feature: Ceres CLONE 1393191-F
  misc_feature: Pfam Name: TPP_enzyme_N Pfam Description: Thiamine pyrophosphate enzyme, N-terminal TPP binding domain
  misc_feature: SWISSPROT Homolog: EC 4.1.1.8 Oxalyl-CoA decarboxylase
  misc_feature (361)..(361): n is a, c, t, g, unknown, or other
  misc_feature (379)..(379): n is a, c, t, g, unknown, or other
  misc_feature (382)..(382): n is a, c, t, g, unknown, or other
  misc_feature (383)..(383): n is a, c, t, g, unknown, or other
  misc_feature (390)..(390): n is a, c, t, g, unknown, or other
aagctggagctccccgcggtggcggccgctctataactagtggatcccccgggctgcagcaattcgcacgagaccattacctagaacatcctaatcgaaaaaccgcatacaccgctgcccgcgcgcagccgcgcaggtgcatctgcgccgccgccggcccgccgcacccgcacgtctccttatacccatccggccatctacacacggcagtccacgctcgtggcaccgcactcactccgaatcctgaagcaacaaacaccagaagcgcaccaactccccaaccaccggagaccgcaccccagcaaaggatgtcatctgactccacggccgccgtgacggtggacggcagcgcgctgcgggncgccgcgctgggccgcgncgnncacgcgncacatggttcggggtggtgggcatccccgtcacctccctcgcgtcccgtgccgccgcggccggggtccgcttcctcgctttccgcaacgagcagtccgcggggtacgccgccgccgcctacggcttcctcacgggctccccgggcgccctactcaccgtctccggcccaggatgcgtccacgggctcgcgggcctctcccacgccaccgacaacgtctggccgctcctcatgatctccggatcctgcgatcgggctgacgccggcaggggcgactt

SEQ ID NO: 23079 - DNA, 554 bp, Zea mays
  misc_feature: Ceres CLONE 1393194-F
  misc_feature (96)..(96): n is a, c, t, g, unknown, or other
ggcggccgctctagaactagtggatcccccgggctgcaggaattcgcacgagaccattacctagaacatcctaatcaaaactcgcttccctccccncacgtcgcgtccgaaatcggcgacggtgcgccatggtcgatgctggacaccttcttcacaagggcggggcgcggcttccgcggcgcaagtgcagacgctgctgaagctgtcgatcccgcgataaagctgctgcggaaccgcggagctgcagctgcgcagatgccccgggactcgccaagctctagaggccggccaggaggcccctgcccggatcaggggggaacacatcctcccggaaaggaaaaattgggggccggcgaagaaaaaccccaagttttttttgggaattcaatggggggtccccggccccctttttggggccccaaaaggggggtctccttttggttctcaaaaaaaaaaattaaggggggggggtttgcccccccccaaaggggggggattccccccgggggggggggggggttaaaagggggggtggccaaaacaaaaaggggaag

SEQ ID NO: 23080 - DNA, 669 bp, Zea mays
  misc_feature: Ceres CLONE 1393195-F
  misc_feature: Encodes the peptide sequence at SEQ ID NO. 23081
  misc_feature (421)..(421): n is a, c, t, g, unknown, or other
tccccgcggtggcggccgctctataactagtggatcccccgggctgcaggaattcgcacgagaccattacctagaacatcctaatcgaaaaaccctcccccaccgccattgctcagcagcagtataaaagccacgcctgacagacagctggttcatttctggttgctgccttgctggtgctacccctcgtggcacgcaggcaagaacagatagagcgagatgtatgtgaacgacgtgctgctaatgccgctggcgccagcgctgactgccatgtgctggagtcgatgctccaagaccgactgtgtcgacgcgctctcgccgtggcctccgggttgatcgccgcggaggaacctgttccaggtgatcctgacaagacggcccttcatgtacgtgttgcgcgacctccgggagaagtacgtgnccatcttcaccatgtgtatggggcagcgcaccctcatcgtgatcacatcggcgtacctcatccacgaggcgctggtgaatacggtaccatgttcacgagtcggcctgagtacagactgaccgcctcctactcagagtataaaagtgagccgtaaatcggcggcctacgggccccctggggggaggtctgcgtcgtaactacgtcgccgatgacgtggtcccgaaccgcgcttagggcttcctcttggt

SEQ ID NO: 23081 - protein, 38 aa, Zea mays
  misc_feature: Ceres CLONE 1393195-F
MYVNDVLLMPLAPALTAMCWSRCSKTDCVDALSPWPPG

SEQ ID NO: 23082 - DNA, 657 bp, Zea mays
  misc_feature: Ceres CLONE 1393196-F
  misc_feature: Encodes the peptide sequence at SEQ ID NO. 23083
  misc_feature (354)..(354): n is a, c, t, g, unknown, or other
  misc_feature (461)..(461): n is a, c, t, g, unknown, or other
  misc_feature (501)..(501): n is a, c, t, g, unknown, or other
  misc_feature (657)..(657): n is a, c, t, g, unknown, or other
tccccgcggtggcggccgctctagaactagtggatcccccgggctgcaggaattcgcacgagaccattacctagaacatcctaatcaaaaacacacatccggaccgagcgcgaccccacctcccagatctcatctgcgacgacctcctccctcccgatcccgctccgtctccccccaccgccaccgctgccgctgccgcctcccccaccgaggtcttgtcttcggcgatccagccggagcccgcggcggcgacgatgtacgggtgggagatgctgtcgttcaacatacacgatgggttcctggaggccatcgtgcggggcaaccgctcgggcctcctcaccgccgccgactacnacaacctctgccagtgcgagaccctcgacgacatcaagatgcacctcactgccaccgagtacgggccctacctccagaacgaaccttcacccttgcacacaacgacnatttgtggagagtgcactcttaaactagtcgatgagtacnagcacatgctgtgccaggccactgaaccactatctacgtttttggagaatataacttatggccacatgatggacatggtgcccttattggaacgggaaccctgatgaaaaaaatggttacgaatttttggagaatgccccccattgggcatggtgn

SEQ ID NO: 23083 - protein, 116 aa, Zea mays
  misc_feature: Ceres CLONE 1393196-F
  misc_feature: SWISSPROT Homolog: EC 3.6.3.14 H(+)-transporting two-sector ATPase
  misc_feature (34)..(34): Xaa is any aa, unknown, or other
  misc_feature (83)..(83): Xaa is any aa, unknown, or other
MYGWEMLSFNIHDGFLEAIVRGNRSGLLTAADYXNLCQCETLDDIKMHLTATEYGPYLQNEPSPLHTTTICGECTLKLVDEYXHMLCQATEPLSTFLENITYGHMMDMVPLLEREP

SEQ ID NO: 23084 - DNA, 668 bp, Zea mays
  misc_feature: Ceres CLONE 1393198-F
  misc_feature (668)..(668): n is a, c, t, g, unknown, or other
ccccgcggtggcggccgctctataactagtggatcccccgggctgcaggaattcgcacgagaccattacctagaacatcctaatcgaaaagttccataaaccctaacctcgttggattcgcggcaaaaatcctcccaattcggaaccctccgatgttccagctacctgcgggagctgagccgtgctcggtttggcgaaatttcgcacccctcttgtgctaggaccacccggttcaagctgttcctcggaagggtcaggtcttcaccggtgttctccggcgccggatccaggtttgttccggcgagaggtcggcctctttggtgggggccagcccagcttcgagctcaatttgccggcctgagatggaatcgcgactgcggtgccggtgcctcaggtagtcgcgtcgagtcgacgcgcgattcctgccatttggggtgggccagcctttcctggcaatctcgggggggcgtttcgcctcgctgcgtggcagaaaggtgtgacgtgtgatgcatcccaaggctcgaatccacgccgacccggtgcgcgagggcgaccacttcgactggctggcgggattcgctcgtcctgctcatcctgaccagggccaaggacgtggcggtcgctccgccggggctacgccgggtccaacggggtctgggggttcgttn

SEQ ID NO: 23085 - DNA, 826 bp, Zea mays
  misc_feature: Ceres CLONE 1393200-F
  misc_feature: Encodes the peptide sequence at SEQ ID NO. 23086
  misc_feature (10)..(10): n is a, c, t, g, unknown, or other
  misc_feature (14)..(14): n is a, c, t, g, unknown, or other
  misc_feature (24)..(24): n is a, c, t, g, unknown, or other
  misc_feature (31)..(31): n is a, c, t, g, unknown, or other
  misc_feature (36)..(36): n is a, c, t, g, unknown, or other
  misc_feature (38)..(38): n is a, c, t, g, unknown, or other
tttttttttntttnttttttttgnccctttnccccncncccaccaccgcaaaggtgagactccccgcggtggcggccgctctagaatagtggatcccccgggctgcaggaattcgcacgagaccattacctagaacatcctaatcgaaaaaagaagctttacagtgaacgagtgagtatgtgcggcatacttgctgtgctcgggtgcgccgacgaggccaagggcagcagcaagaggtcccgggtgctggagctgtcgcggcggctgaagcaccggggccccgactggagcggcctccggcaggtgggcgactgctacctctctcaccagcgcctcgccatcatcgacccggcctctggcgaccagcccctctacaacgaggaccagtcggtgggtcgtcgccgtcaacggcgagattctacaaccacccttgaacctcagggagccgccctcgccgggcgccaggccaccagctttcagggacccggcaagcgactgccgaggtccatcggcggcaccctgttaccaagggaccattgggataaaaaaagttccggtggacaatgccttggaaccgggggtccttcccccccttccatgggctgctggagaccactccccccattgggccaacccgcggccggggaaagcaaactttcctttccatgggtttgcttccgcgaaccgccaattggggggggggacccgcccctctatactttcggaatgtggggaagagccgatgggggccagcggcgtggggaaattccccaagaaacaaataaaaaggtccactgcaacaaacatagggggagccccactcctg

SEQ ID NO: 23086 - protein, 216 aa, Zea mays
  misc_feature: Ceres CLONE 1393200-F
  misc_feature: SWISSPROT Homolog: EC 6.3.5.4 Asparagine synthase (glutamine-hydrolyzing)
MCGILAVLGCADEAKGSSKRSRVLELSRRLKHRGPDWSGLRQVGDCYLSHQRLAIIDPASGDQPLYNEDQSVGRRRQRRDSTTTLEPQGAALAGRQATSFQGPGKRLPRSIGGTLLPRDHWDKKSSGGQCLGTGGPSPPSMGCWRPLPPLGQPAAGESKLSFPWVCFREPPIGGGDPPLYTFGMWGRADGGQRRGEIPQETNKKVHCNKHRGSPTP

SEQ ID NO: 23087 - DNA, 677 bp, Zea mays
  misc_feature: Ceres CLONE 1393202-F
  misc_feature: Encodes the peptide sequence at SEQ ID NO. 23088
  misc_feature (322)..(322): n is a, c, t, g, unknown, or other
  misc_feature (488)..(488): n is a, c, t, g, unknown, or other
  misc_feature (583)..(583): n is a, c, t, g, unknown, or other
  misc_feature (657)..(657): n is a, c, t, g, unknown, or other
  misc_feature (663)..(663): n is a, c, t, g, unknown, or other
  misc_feature (677)..(677): n is a, c, t, g, unknown, or other
aaagctggagctccccgcggtggcggccgctctataatagtggatcccccgggctgcaggaattcgcacgagaccattacctagaacatcctaatcgaaaaccccttgccctccgtccagctcgccgtctctcgcagagggaagcagggcgcagcagtgaccagttaccagtcatggttcgctgcgttgccggcagctgccctcccgtcaccttcgcgtgttgcccccgccggactggacgaagtgctgttgttcagtgtggcactgcatcgagcacaccagcaatatctggaactggaccttcatcatctggatcctcggngcttgttcaagattgtactgcccctctggtctgtgcactgcaattaactgccagacaagatgtttcctgctttcacttcccaggacacaacagaggaaaagctgctccatcttccttgtcgaaactcattggctcaggggcatttctgcatgacttgcccgagctnaccgagctggatgatctcttctccccaaaaggtgtgattctagatgcccagaggcgagcagctcaactgtttgggtcatctaaaacttggttccnttgtcacggaacgacctgttggatccaggcctcagtgatggctacctgttcctccggggactacctcattgtgncacggnacctgcacatttcn

SEQ ID NO: 23088 - protein, 168 aa, Zea mays
  misc_feature: Ceres CLONE 1393202-F
  misc_feature: SWISSPROT Homolog: EC 4.1.1.19 Arginine decarboxylase
  misc_feature (50)..(50): Xaa is any aa, unknown, or other
  misc_feature (137)..(137): Xaa is any aa, unknown, or other
  misc_feature (162)..(162): Xaa is any aa, unknown, or other
  misc_feature (164)..(164): Xaa is any aa, unknown, or other
MVRCVAGSCPPVTFACCPRRTGRSAVVQCGTASSTPAISGTGPSSSGSSXLVQDCTAPLVCALQLTARQDVSCFHFPGHNRGKAAPSSLSKLIGSGAFLHDLPELTELDDLFSPKGVILDAQRRAAQLFGSSKTWFXCHGTTCWIQASVMATCSSGDYLIVXRXLHIS

SEQ ID NO: 23089 - DNA, 684 bp, Zea mays
  misc_feature: Ceres CLONE 1393203-F
  misc_feature: Encodes the peptide sequence at SEQ ID NO. 23090
  misc_feature (301)..(301): n is a, c, t, g, unknown, or other
  misc_feature (358)..(358): n is a, c, t, g, unknown, or other
  misc_feature (359)..(359): n is a, c, t, g, unknown, or other
  misc_feature (477)..(477): n is a, c, t, g, unknown, or other
  misc_feature (478)..(478): n is a, c, t, g, unknown, or other
  misc_feature (568)..(568): n is a, c, t, g, unknown, or other
  misc_feature (621)..(621): n is a, c, t, g, unknown, or other
aagctggagctccccgcggtggcggccgctctagtactagtggatcccccgggctgcaggaattcgcacgagaccattacctagaacatcctaatcaaaactgagcactgctgctgctgaaaatggcgcctgggcttgcgaactgggtcgcgctggttctgaccgtcgtccttggtctctcgtgccacgtcgcgctctcggaggatgaaacactggacaagctgcggttcgtgcgccacgcacaggacgcgcccctggtgtcgcagtacaactacatcgtgatcggcggcggcacggcggngtgcccgctggcggcgacgctgtcggagcactcgcgcgtgctgctcctggagcgcgnnggcctcccgtccccgcacatgtccgaccagcagcacttcacggacgcgctggcggacacgtccccggcgtcgcccgcgcagcggttcgtgtccgaggacggcgtggtgaacgcgcggnncccgggtgcttggccgggggcagctgcctcaaccgcgggtttctaccacgcgggccagcacccgactacgtgcggcgccgccggtttggnacgccccgcctcgtcaactcgtcctaaccgcttgggtggaaccgcccctttcntggtccgcccccgccgtgcccccgtgggaaagccccgcttcccgggaccgtttgcttcaaagg

SEQ ID NO: 23090 - protein, 187 aa, Zea mays
  misc_feature: Ceres CLONE 1393203-F
  misc_feature: SWISSPROT Homolog: EC 4.1.2.10 Mandelonitrile lyase
  misc_feature (60)..(60): Xaa is any aa, unknown, or other
  misc_feature (79)..(79): Xaa is any aa, unknown, or other
  misc_feature (119)..(119): Xaa is any aa, unknown, or other
  misc_feature (149)..(149): Xaa is any aa, unknown, or other
  misc_feature (167)..(167): Xaa is any aa, unknown, or other
MAPGLANWVALVLTVVLGLSCHVALSEDETLDKLRFVRHAQDAPLVSQYNYIVIGGGTAXCPLAATLSEHSRVLLLERXGLPSPHMSDQQHFTDALADTSPASPAQRFVSEDGVVNARXPGAWPGAAASTAGFYHAGQHPTTCGAAGLXRPASSTRPNRLGGTAPFXVRPRRAPVGKPRFPGPFASK

SEQ ID NO: 23091 - DNA, 665 bp, Zea mays
  misc_feature: Ceres CLONE 1393204-F
  misc_feature: Encodes the peptide sequence at SEQ ID NO. 23092
tcaccgcggtggcggccgctctagaactagtggatcccccgggctgcaggaattcgcacgagaccattacctagaacatcctaatcgaaaacactcgccgcggctaacccagctcccagcccccgtctcgtcgccatgggaaccaggaatcttacgcggaaccgcgccgcttccatggcgacggcatccactacgctgctcctctcccttgccttcctcgccttcgcctgggcggcgtcgccgtcgccggatgcggaggcgatctcccggttccaggagtacctccgcatcgacacggcgcagccggcgccagattacgccgcggccgtggccttcctccggaacaggccgccgaggctggactcgaggcgcgcacgcttgagctcgtcgccgggaagcccctgctgctgctgcgggggcccggtcgggggccgtcgctcccctccatactcctcactcccacactgaggtggggccgccggagccgaaaaagtgggaccaccccgcctttttccgccgcctcaatggagcattccggtcgcatctacgcgggaggctcccaggaaatgaaggggggggggaatgcagaacctggaagccattccccggtccccgttttggagggatttggtccaaatcgaaaaaatcctataaaattttggtcg

SEQ ID NO: 23092 - protein, 110 aa, Zea mays
  misc_feature: Ceres CLONE 1393204-F
MGTRNLTRNRAASMATASTTLLLSLAFLAFAWAASPSPDAEAISRFQEYLRIDTAQPAPDYAAAVAFLRNRPPRLDSRRARLSSSPGSPCCCCGGPVGGRRSPPYSSLPH

SEQ ID NO: 23093 - DNA, 849 bp, Zea mays
  misc_feature: Ceres CLONE 1393207-F
  misc_feature: Encodes the peptide sequence at SEQ ID NO. 23094
  misc_feature (28)..(28): n is a, c, t, g, unknown, or other
tggtcccccccccccccccccccctccntggttatcgtgccaaactcctcacactagcgctccccgcggtggcggccgctctagaatagtggatcccccgggctgcaggaattcgcacgagaccattacctagaactcctaatcgaaaaaactaccgaagtctacttccattccttcctttctcctttcatatacccgcgtcgcccacgagcccgccgtgccgacagaggtgtggacctcgccggagcagaggttatggggccaccgcagccagccaggcccggcgtcatcaaaatcgaggcttgcgcggcggcgatcgccgtcgaccaccgaatcagccttccctactacttccgcatcgcgggcaggcctcttccgacagggttaatatatatccggaacgaggagaaactttcctcccacctaatatgggcttcctttctggagaaaaattgaagctttggctgggggggaaaaaaattccgggagggaatccggggattaaccatgggctttccaagggttaaaaaggaaaaagggcattttttttgggaaaaaactttgggtgggaaggtgtattcaaaaaagaaactttggagaacattttggaaaagccccagtttgggggcaaccggggcaaaaaattggcccaaatcattaaaaaaaaggggagggaacctggggggaaactccaaaaataggaaaaaggcccaaaagggggaaaccaatgggccaccacctccttaagggataagaggcggggattaacttcccaaggtttttttataattcccaccaggccttatttggtgggggcagcgccccaaaggggggcgccttcgccaaaat

SEQ ID NO: 23094 - protein, 66 aa, Zea mays
  misc_feature: Ceres CLONE 1393207-F
MGPPQPARPGVIKIEACAAAIAVDHRISLPYYFRIAGRPLPTGLIYIRNEEKLSSHLIWASFLEKN

SEQ ID NO: 23095 - DNA, 663 bp, Zea mays
  misc_feature: Ceres CLONE 1393208-F
  misc_feature: Encodes the peptide sequence at SEQ ID NO. 23096
  misc_feature (618)..(618): n is a, c, t, g, unknown, or other
  misc_feature (619)..(619): n is a, c, t, g, unknown, or other
gctctataactagtggatcccccgggctgcaggaattcgcacgagaccattacctagaacatcctaatcgaagaatctgaccacgtcacacgacatccaccaccagccctcccctgtcatcagttgaagcaggtggcccgttcattcccctcttctctgctggttggctcgggctccccaattcaacgagatctccaattcgcaccgcgtcgtctctgcatccggaccccataccccgatcgatccctaaaggccatggttttctccgccgccgcgtcccctctagtacccagcgctgctgactctgcttcctcctgcgacgcccactccgctgatgatgtcgcgttagatgctgcccgtgttgaagacgcgtacctcttagggttcgggatttctcgctgatcggttcgagaatttgtaaagtatggatctctcgcggaccacatcggcggacctctcggtcggggctccactctcacggtcacggccacgcccaagctcggaggaacggggaaaccggcgccgttgcccctggtcaacgacacggaggaaccaaaaccggaacgcgtcctggcccggaaaggcccaacccggaaaaggtatgaacaagaacagggnncaaaccaaaatctcctcccctccccggggaacttcccttctttg

SEQ ID NO: 23096 - protein, 48 aa, Zea mays
  misc_feature: Ceres CLONE 1393208-F
MVFSAAASPLVPSAADSASSCDAHSADDVALDAARVEDAYLLGFGISR

SEQ ID NO: 23097 - DNA, 665 bp, Zea mays
  misc_feature: Ceres CLONE 1393209-F
tccccgcggtggcggccgctctagaactagtggatcccccgggctgcaggaattcgcacgagaccattacctagaacatcctaatctaaaagacaaccagacgcgccagggtttcaggcttccacgaatctccccgccgccctcaattcccctcggcgccgccgcctcctcccctcgcttcggtcctcggttagttaaccatccaggttctgtcaagatgtctgatagccatgagactgacaggaacattgagatttgaaaaattaagaaactgatcaaggcattggaatcagccagaggcaatggcacaagcatgatctctctgatcatgcctccacgtgatcaggttgctcgagtggctaagatgtaggtgatgaatatggtactggttccaaaatcaaggagaaaggtatcggccatctggggtgggtggcatcaactcagctcaagagaaggtggaggtctaacaaaagtggctctaaacggattggttctggaacatggaacttttggtaatggaaacggaaaggaaaaaaaagttactattggttttgagagcatcaaggctatcaatggatcctcctaccttggggagaacaattccacactgggggtttaaaggagctcttggatctgaggaaaaagttggggtccattggtagggg

SEQ ID NO: 23098 - DNA, 662 bp, Zea mays
  misc_feature: Ceres CLONE 1393210-F
  misc_feature: Encodes the peptide sequence at SEQ ID NO. 23099
  misc_feature (299)..(299): n is a, c, t, g, unknown, or other
  misc_feature (332)..(332): n is a, c, t, g, unknown, or other
  misc_feature (393)..(393): n is a, c, t, g, unknown, or other
  misc_feature (423)..(423): n is a, c, t, g, unknown, or other
  misc_feature (428)..(428): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (570)..(570): n is a, c, t, g, unknown, or other
  misc_feature (611)..(611): n is a, c, t, g, unknown, or other
  misc_feature (644)..(644): n is a, c, t, g, unknown, or other
tccccgcggtggcggccgctctataactagtggatcccccgggctgcaggaattcgcacgagaccattacctagaacatcctaatcgaaaaacacaccgacctaacagaaaaaaacagagtccaaaagaaggaacagggaggtgggggaaaagcgcagggacaaagaaaggaaagggacgcccgtctcgtcacgtcttccacccccgccgccatggctgccctgggcctgctcctcctcgccgtcgtcggtgccaccaacgccgcggcgccgggcggtagaatgtccatcatctcctancacgaggagcacgccgcgcgcgggctggagcgnacggagccggaggcccggacgctgtacgagctctgggctcgcgagcacgggcgcgcctacnacgcgctcggcgagcgcgaccggcgcttcngcgtngtctggggacacctacgcttcgtcgacgcgcacaacgagcgcgccgcggagcacgtcttccgcctcgnnnatcaccagtttcgcgacctcaccaacgacgagttccgcgccgcgtacctcggggccaggatccccgcgcccnggagaagggaacccgccgggggggagaggtaccgccacggngtggggccggagagctgccgaaaggtcatttgnaaggaaaaagggcccccc

SEQ ID NO: 23099 - protein, 150 aa, Zea mays
  misc_feature: Ceres CLONE 1393210-F
  misc_feature (49)..(107): Pfam Name: Inhibitor_I29 Pfam Description: Cathepsin propeptide inhibitor domain (I29)
  misc_feature: SWISSPROT Homolog: EC 3.4.22.14 Actinidain
  misc_feature (29)..(29): Xaa is any aa, unknown, or other
  misc_feature (61)..(61): Xaa is any aa, unknown, or other
  misc_feature (71)..(71): Xaa is any aa, unknown, or other
  misc_feature (95)..(95): Xaa is any aa, unknown, or other
  misc_feature (96)..(96): Xaa is any aa, unknown, or other
  misc_feature (120)..(120): Xaa is any aa, unknown, or other
  misc_feature (144)..(144): Xaa is any aa, unknown, or other
MAALGLLLLAVVGATNAAAPGGRMSIISXHEEHAARGLERTEPEARTLYELWAREHGRAYXALGERDRRFXVVWGHLRFVDAHNERAAEHVFRLXXHQFRDLTNDEFRAAYLGARIPAPXRREPAGGERYRHGVGPESCRKVIXKEKGPP

SEQ ID NO: 23100 - DNA, 858 bp, Zea mays
  misc_feature: Ceres CLONE 1393216-F
  misc_feature: Encodes the peptide sequence at SEQ ID NO. 23101
  misc_feature (1)..(1): n is a, c, t, g, unknown, or other
naaaacccaacctcccccccccattctcttaaaaaattgtgacacgggaatacatttacccaccaagatggcgggcgctctatattagtggatcccccgggctggaggaattcgcacgagaccattacctacaacatcctaatcgaaaactcgtgttcttgttcgtctccgcctcaggcaactccacacggtcacacctcgctcgctctcgctcccgtatggcggtttcctttttcgaagccttgctaggtttagctggggcctctgtctatcctgtcaatggcccccttaggggggtgtacttcaaacttcagaggtgacgcgaggcctgcgaacgcgcgtagctgaattgcctcaaggaggtggggatggtacccggacttctcgcccgggactgggggccccgagcttttgagttccgcccttcaactcggccaaccttctccgaacccggggggttgcagaaatcccgacaatccgccgcctgcgggatggacgcccctccagggcccatgggccgccacacacggtgagggtcgtgcttcattttcttttggccgacctgggccagtcgccaaccataatagtgagaacaaacgatacatggaactctccgcgcccccgccctacggaatttttatgaaaaataacatggcccggtaaccaaacaaatactggcaaaagagttgcaaaacttgaatgatatgggtgaacgccctcagcctcgggcaaccgcctagcgcacgccccggcgacccctaaccgaccaccaaaaaaatactcccgccagcaattaaactattttaaggtgaacaaataagtactgagaacaattgtgaaaaacataatactccataa

SEQ ID NO: 23101 - protein, 33 aa, Zea mays
  misc_feature: Ceres CLONE 1393216-F
MAVSFFEALLGLAGASVYPVNGPLRGVYFKLQR

SEQ ID NO: 23102 - DNA, 880 bp, Zea mays
  misc_feature: Ceres CLONE 1393218-F
  misc_feature: Encodes the peptide sequence at SEQ ID NO. 23103
  misc_feature (1)..(1): n is a, c, t, g, unknown, or other
  misc_feature (2)..(2): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (43)..(43): n is a, c, t, g, unknown, or other
nnccccccccaccccccccccccccnnntcccccgggaagaanttttccaagctggagctccccgcggtggcggccgctctataatagtggatcccccgggctgcaggaattcgcacgagaccattacctagaacatcctaatcgaaaactagtcttcacggcggggttgttgtcgcttgtggccagccgccagcaccagcacaaggcgatcgagagtggtgaccaccagtaaactgcaaagtgcaaaccaaacaccacccacgagaaagcggaggagggagcaatggcggagccgagccagcagctgcggtcgttcgtggaggtgccggcgggctcccacttccccatccagaacctggcccttcggggtcttccgcccggggggggggttgctaggcgcaggcgccgcgcccccgcggtgggcctattcggggatttcgaggttcgacccctcgccgcccgtcggccgaacgcggcgccttccttccaaacgagccccgtcgcatcttccgggtttcccggtagcattctaacttaaggaagaccgctccacccctggttccccttgcggaaattgccaccccacgcacccacccagcccacataaaggtctcatatcctccctacatataatcagaaaaactacccacatagggtatatatataaaatactcccatcccctccaccacggtccacccccacccccaccttgtctaacattaccgcacgcccgcgtcacacacgagttagtgaatactaatccaacatcatctcatatctgatccgcatttcgcgaacatccgacagcgaacgatacacatggcaatacacatgtgcccccctcactcccctcccacccgactacgtcccacacccaa

SEQ ID NO: 23103 - protein, 84 aa, Zea mays
  misc_feature: Ceres CLONE 1393218-F
MAEPSQQLRSFVEVPAGSHFPIQNLALRGLPPGGGVARRRRRAPAVGLFGDFEVRPLAARRPNAAPSFQTSPVASSGFPGSILT

SEQ ID NO: 23104 - DNA, 711 bp, Zea mays
  misc_feature: Ceres CLONE 1393219-F
  misc_feature: Encodes the peptide sequence at SEQ ID NO. 23105
  misc_feature (317)..(317): n is a, c, t, g, unknown, or other
  misc_feature (353)..(353): n is a, c, t, g, unknown, or other
  misc_feature (384)..(384): n is a, c, t, g, unknown, or other
  misc_feature (385)..(385): n is a, c, t, g, unknown, or other
  misc_feature (391)..(391): n is a, c, t, g, unknown, or other
  misc_feature (689)..(689): n is a, c, t, g, unknown, or other
  misc_feature (692)..(692): n is a, c, t, g, unknown, or other
  misc_feature (711)..(711): n is a, c, t, g, unknown, or other
aagctggagctccccgcggtggcggccgctctatcatagtggatcccccgggctgcaggaattcgcacgagaccattacctagaacatcctaatcgaaaacacataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcatcgtgggcggcngcacggccgggtgcccgctggcccgcacgctgtcgnagcgcttccgcgtgctgctgctggagcgcgnngcctcnccctacgacgacgaccgatcggggaaatggcccgcttgcggacacgctgtcggaaccctccccgggctcgcccggcgaagggtttgtggttgaaggaaggggtcattaactccggccccggggtggttggggggggggaatttggataaacgccggtttctaaaagggggccaaaaaaaaaaaaagggggggggggctcctgggggaacccggggccccccccgggggggaaaacccgggggtggggaaaaaattgttgggggtctacacccggagagggggccccctggagaaaacncantaatcgaagcaccccctcn

SEQ ID NO: 23105 - protein, 111 aa, Zea mays
  misc_feature: Ceres CLONE 1393219-F
  misc_feature: SWISSPROT Homolog: EC 4.1.2.10 Mandelonitrile lyase
  misc_feature (57)..(57): Xaa is any aa, unknown, or other
  misc_feature (69)..(69): Xaa is any aa, unknown, or other
  misc_feature (79)..(79): Xaa is any aa, unknown, or other
MSGRSRHFTMSTLLATSFFFVLLCSSLQVRGVNYTFVKDAALAPSVSYYDYIIVGGXTAGCPLARTLSXRFRVLLLERXASPYDDDRSGKWPACGHAVGTLPGLARRRVCG

SEQ ID NO: 23106 - DNA, 668 bp, Zea mays
  misc_feature: Ceres CLONE 1393226-F
  misc_feature: Encodes the peptide sequence at SEQ ID NO. 23107
  misc_feature (363)..(363): n is a, c, t, g, unknown, or other
  misc_feature (434)..(434): n is a, c, t, g, unknown, or other
  misc_feature (507)..(507): n is a, c, t, g, unknown, or other
tccccgcggtggcggccgctctacaactagtggatcccccgggctgcaggaattcgcacgagaccattacctagaacatcctaatcgaaaaaaggcgaggattttcctgctccgaatctacccggctcggcccgatgggctcgctgatgtcctgcctctccgacccaatcccgtcggggaacaggtccccgccgccgcagccgaagcggcgctcctccacctcttcccgcggccgtggcggcggcgggagggactccgctaaggcctccgtgtccatagacgaggaggcgcttaccgcagcggcggcgctcgtgctggggcagaggggcgcgtccggtggcctgggcgcgttcgagcggtccngcgtcggtgcggtactcggccaagcggcagagccagggcccgccgcctgccccgaagttgcagcacgcggnccgaggtcgctcgctgacctcgagctccagccacagcaactcctagccaaggatttgaatactaaggatttgnaaaccaacgtcattgttcttggtcatggtggtgaatccgacgccttggtgttggtaccagaatatatcacttctcgaagaaagtggggttcaaaggtaacggcattgacttaacaggctcaggaattcgccattacgacacaactaagattagcagtcttg

SEQ ID NO: 23107 - protein, 161 aa, Zea mays
  misc_feature: Ceres CLONE 1393226-F
  misc_feature (77)..(77): Xaa is any aa, unknown, or other
  misc_feature (125)..(125): Xaa is any aa, unknown, or other
MGSLMSCLSDPIPSGNRSPPPQPKRRSSTSSRGRGGGGRDSAKASVSIDEEALTAAAALVLGQRGASGGLGAFERSXVGAVLGQAAEPGPAACPEVAARGPRSLADLELQPQQLLAKDLNTKDLXTNVIVLGHGGESDALVLVPEYITSRRKWGSKVTALT

SEQ ID NO: 23108 - DNA, 868 bp, Zea mays
  misc_feature: Ceres CLONE 1393228-F
  misc_feature (14)..(14): n is a, c, t, g, unknown, or other
  misc_feature (15)..(15): n is a, c, t, g, unknown, or other
  misc_feature (21)..(21): n is a, c, t, g, unknown, or other
  misc_feature (31)..(31): n is a, c, t, g, unknown, or other
  misc_feature (32)..(32): n is a, c, t, g, unknown, or other
  misc_feature (39)..(39): n is a, c, t, g, unknown, or other
ttattctccctatnnatttantctctttaanntaataanatacccccccatcaaagctggggctccccgtggggtgggacgctctctcaatagtggatcccccgggctgcatgtattcgcacgagaccattacctacaacatcctaatcgaaaaacggaagggcccggacagttttgcgcacaagccccccattcccattctaccaccgacccgtcccgtcccactgcctgccagcgtctcccccgctccctctcctcgagagatctcgcgctccggcgatcgggcgcggtgggcggagggtcgcgaagtgccctgcccacccccgatgctcttcccgaagcgcatcaactaacgcgccccccgatgctcgccttccgacggcatccttgcttcctcccccttctcgggttactttcggagatccccatcaatctccacccccgagcgccgcctccctcgcggggcgccagccccgcctccccccgccccgggacatccaacttcacgtctgtgtatcccgtgatggtcaagcgaacctaccttacacctctcacatagtcccgcaaggcccaacaagtcgtacccctatactatatctccccaccaccatcctatattccttaccttatccatcaccacaccccccacccccccaccctaaaccatgacgactttggtttgttgtgatgaaatctaactactcaccttcgcacaatatactatgtcccttctaggctacacttaccaactccaattgtttacagctcaacaccaccacgcaccccccctgtccactcttcccccccctaccccccacaccccccccccacacacccatcgcagcgtacaccacaaacccccccccca

SEQ ID NO: 23109 - DNA, 648 bp, Zea mays
  misc_feature: Ceres CLONE 1393230-F
  misc_feature: Encodes the peptide sequence at SEQ ID NO. 23110
cgctctcaactagtggatcccccgggctgcagtaattcgcacgagaccattacctagaacatcctaaaaaaaatcttatttcactgccagccctctgaaaaaaaaattaaaaaatgaggtcccagttccacccacctagagagccaaaagagccggcggtggccggcagccaaaacccacgttggattttgccgccgccgcctggagctaggggacaaggcaacgccggccggtgcaacatttatgcgtgtaccaggcagaccagcccggcagccacgcgtacacttctgccgcaaagctaaacgcgccactccgcggcaagctgctctgctgctcccaccagccaccgcaccgagtgccaatggcgactgcagcgagttcgacgccggcggcgcggcagcctactctggtctgcgcgtcactgaccgcgcgggtgccccgggagatggcagcggaggttgccgccgctgcggcgctcggtgccgacgtggcggagctccaggtcggctgcctcgacagcttcgagccatgcagggacctgcccgtgcttctcgcccagccccgctcgctccccgtcatcgtcacctacaggccgaatttggggagggagcccagtacgcaggcgaagatggagcacgttttgaggcg

SEQ ID NO: 23110 - protein, 95 aa, Zea mays
  misc_feature: Ceres CLONE 1393230-F
MATAASSTPAARQPTLVCASLTARVPREMAAEVAAAAALGADVAELQVGCLDSFEPCRDLPVLLAQPRSLPVIVTYRPNLGREPSTQAKMEHVLR

SEQ ID NO: 23111 - DNA, 659 bp, Zea mays
  misc_feature: Ceres CLONE 1393231-F
  misc_feature: Encodes the peptide sequence at SEQ ID NO. 23112
  misc_feature (523)..(523): n is a, c, t, g, unknown, or other
cgctcttaactagtggatcccccgggctgcaggaattcgcacgagaccattacctagaacatcctaatcgaaaaatgccacattgccaccaagccacagttccacctttcgattcatgcacgctcagtcatgggcgccctccggagtttagccatctcctacccggagttcctcgtggccgggctgtgcttcgtctccctctcggccctgcgccacgcgatgcgtgagcggcggcaacgcgcccccctgagctggcctgtggtgggcatgctcccgttcgtgctcgcgaacctcgggcgcctctacgacgccatcaccgacgccctccacgggtccgggtgcacgctcatgttccgcgggccgtggctcgcccgcgcggacttcctgctgacgtgcgacccggcggccgtccagcactgcctggcgtccaaccacgggggctacgacaggggccgagacttttgcggagatgttcgacctcctgggcgacgggctgctggttgcggacgcccgcggtcgtggnggcgccagcggcacgtcccccccaccggtttcgttcaccacggcgatccggtacgttcgtccttcggcacaatgacggcgctaatatggcgtaggccaatctctggcaccccccccgccccaccccccctcctccc

SEQ ID NO: 23112 - protein, 176 aa, Zea mays
  misc_feature: Ceres CLONE 1393231-F
  misc_feature (132)..(132): Xaa is any aa, unknown, or other
MGALRSLAISYPEFLVAGLCFVSLSALRHAMRERRQRAPLSWPVVGMLPFVLANLGRLYDAITDALHGSGCTLMFRGPWLARADFLLTCDPAAVQHCLASNHGGYDRGRDFCGDVRPPGRRAAGCGRPRSWXRQRHVPPTGFVHHGDPVRSSFGTMTALIWRRPISGTPPAPPPLL

SEQ ID NO: 23113 - DNA, 654 bp, Zea mays
  misc_feature: Ceres CLONE 1393234-F
  misc_feature: Encodes the peptide sequence at SEQ ID NO. 23114
  misc_feature (341)..(341): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (354)..(354): n is a, c, t, g, unknown, or other
  misc_feature (373)..(373): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (406)..(406): n is a, c, t, g, unknown, or other
  misc_feature (409)..(409): n is a, c, t, g, unknown, or other
  misc_feature (410)..(410): n is a, c, t, g, unknown, or other
  misc_feature (654)..(654): n is a, c, t, g, unknown, or other
aagctggagctccccgcggtggcggccgctctacaatagtggatcccccgggctgcaggaattcgcacgagaccattacctagaacatcctaatcaaaaaaaagcgaacctcgccgccgcctcttccgtctctctcatctccgtcctcctgcaatctcacccctccctctaaacccgcaggccgcagtagcgccgctacggtttgctcaggattcgaaccccaccttctgattgctccgaatccgagaagtttgcggcatggcggggtacccggaggacaaccagcacgcgttgaaacggtacgacgatgaggaggtcgacgaggagggcacccccggcgncgnnngagtcggnatggcgcgtctgggtacgncgatgctggccgaaaggatgggaagnnnnncgncgnnaactcttcggggaaaatttttgtcggaggcgttgcttggaaaaaaaatgaaaaaacaatccccaagattttttgaaaaaaatgggggaaaaaacggggttttggaaatttggggagggcccggcttccttaaagggcgcccgcggggtattggggatcccaacatttttgggaaccccctgggaaaaaaaaaagggttttgggggggggaaaacccctatataaaggggaaaaagcggcgaaan

SEQ ID NO: 23114 - protein, 131 aa, Zea mays
  misc_feature: Ceres CLONE 1393234-F
  misc_feature (28)..(28): Xaa is any aa, unknown, or other
  misc_feature (29)..(29): Xaa is any aa, unknown, or other
  misc_feature (30)..(30): Xaa is any aa, unknown, or other
  misc_feature (39)..(39): Xaa is any aa, unknown, or other
  misc_feature (47)..(47): Xaa is any aa, unknown, or other
  misc_feature (48)..(48): Xaa is any aa, unknown, or other
  misc_feature (49)..(49): Xaa is any aa, unknown, or other
  misc_feature (50)..(50): Xaa is any aa, unknown, or other
  misc_feature (51)..(51): Xaa is any aa, unknown, or other
MAGYPEDNQHALKRYDDEEVDEEGTPGXXXVGMARLGTXMLAERMGXXXXXTLRGKFLSEALLGKKMKKQSPRFFEKNGGKNGVLEIWGGPGFLKGRPRGIGDPNIFGNPLGKKKGFWGGENPYIKGKKRR

SEQ ID NO: 23115 - DNA, 744 bp, Zea mays
  misc_feature: Ceres CLONE 1393239-F
  misc_feature: Translation starting site: 198
  misc_feature (417)..(417): n is a, c, t, g, unknown, or other
  misc_feature (441)..(441): n is a, c, t, g, unknown, or other
  misc_feature (454)..(454): n is a, c, t, g, unknown, or other
  misc_feature (498)..(498): n is a, c, t, g, unknown, or other
  misc_feature (522)..(522): n is a, c, t, g, unknown, or other
  misc_feature (744)..(744): n is a, c, t, g, unknown, or other
aaagctggagctccccgcggtggcggccgctctagaactagtggatcccccgggctgcaggaattcgcacgagaccattacctagaacatcctaatcgaaaaatcacacactcgactctcctctctcgcatccgcagcctctcgagctctactccatcccctcgatctcgaagcgcagcagcagcagtcaggcggccatggacgccagcgcagccggagccggcgggaaggcgaagaagggcgcggccgggcgcaaggccggcgggccgaggaagaagtcggtgacgaggtccgtcaaggccgggctgcagttccccgtcggccgcatcgggcggtacctgaagaagggccggtacgcgcagcgcgtcggcacggggcgccccccgtctacctgggccgcgtcctcgagtacctggnccgcgaggtgctggagctggccgncaacgcggccaanggacacaagaagacccgcatcatcccgcgccacgtgctcctggncatccgcaacgacggagagctcgncaggctgctgtccggcgtcaccatcgcccacgggggcgtcctccccaacatcaacccggttgctcctgcccaaaaggaccgctgagagggcggcggcccaggaggccaagtcccccaaaaaagccgccaagtccccccaagaaggcatagagggggcgccttttacggctgggatggtggaatgctcgggctcaaaaaaatcttaaccgctggaagggcccn

SEQ ID NO: 23116 - DNA, 704 bp, Zea mays
  misc_feature: Ceres CLONE 1393240-F
  misc_feature: Encodes the peptide sequence at SEQ ID NO. 23117
  misc_feature (381)..(381): n is a, c, t, g, unknown, or other
  misc_feature (387)..(387): n is a, c, t, g, unknown, or other
  misc_feature (417)..(417): n is a, c, t, g, unknown, or other
  misc_feature (451)..(451): n is a, c, t, g, unknown, or other
  misc_feature (472)..(472): n is a, c, t, g, unknown, or other
  misc_feature (505)..(505): n is a, c, t, g, unknown, or other
  misc_feature (511)..(511): n is a, c, t, g, unknown, or other
  misc_feature (522)..(522): n is a, c, t, g, unknown, or other
  misc_feature (555)..(555): n is a, c, t, g, unknown, or other
aaagtggagctcaccgcggtggcggccgctctagaactagtggatcccccgggctgcaggaattcgcacgagaccattacctagaacatcctaatcgaaaaaacactcccccgatctccgccactccaaaatgtggcgccgccaccacctcctccggctacttccacctccggccaccgccgccaccgccgcggccccttctcatttcctgcgccacctctctacctcaagcaccccgaccccggccgcctccctggcctcgtccctcgcgtcggcgctcaccgcgctctccacgaccccgccccccgccaccaccccggacgcttacttctccctccacttctccgacgtgcggcctaccaacgcgctcctcgctgaggngctcgngctctccccgcccgccacctccccgcgcgntgccgatctcttccgcttcctcgtccccgcgcgntcgctccacccctccgacggngcgctcgcgcccatcgttcgccacctcgcccgncgccgngacttccccgncgtgcgcgcgctcatccagaagtttccaaccgntctcgggccccgcacgctcgacgcctaatctcagcagttcaccagagcggggcgcccaacgaacgctgtcaaggttgtcaaacaattgccggaacaattccgaacccgggaggttccccctttgctggcccccccccttttcttccagg

SEQ ID NO: 23117 - protein, 150 aa, Zea mays
  misc_feature: Ceres CLONE 1393240-F
  misc_feature (84)..(84): Xaa is any aa, unknown, or other
  misc_feature (86)..(86): Xaa is any aa, unknown, or other
  misc_feature (96)..(96): Xaa is any aa, unknown, or other
  misc_feature (131)..(131): Xaa is any aa, unknown, or other
  misc_feature (142)..(142): Xaa is any aa, unknown, or other
MWRRHHLLRLLPPPATAATAAAPSHFLRHLSTSSTPTPAASLASSLASALTALSTTPPPATTPDAYFSLHFSDVRPTNALLAEXLXLSPPATSPRXADLFRFLVPARSLHPSDGALAPIVRHLARRRDFPXVRALIQKFPTXLGPRTLDA

SEQ ID NO: 23118 - DNA, 676 bp, Zea mays
  misc_feature: Ceres CLONE 1393241-F
  misc_feature: Encodes the peptide sequence at SEQ ID NO. 23119
  misc_feature (497)..(497): n is a, c, t, g, unknown, or other
  misc_feature (498)..(498): n is a, c, t, g, unknown, or other
  misc_feature (547)..(547): n is a, c, t, g, unknown, or other
  misc_feature (580)..(580): n is a, c, t, g, unknown, or other
ccccgcggtggcggccgctctagtaactagtggatcccccgggctgcaggaattcgcacgagaccattacctagaacatcctaaaaaaaaatctgaagcaaaatgtaccgggaatgttgaagagcgggactcttaagcagtagtgagatgcggcggtggtggtcgccggcgttggcggctgtggagccgcggtccgtgcagctcctgctcctgggcgtcgctctcgtcgcagcttctttctacgccggcaccctcttcggctcctccgcgtcccctgcgctcgtactgccctcttcgcgcccccgatcgcccgattccttcagggccaaagttacagatgttccagtgtttaccaacagagtttctcgtacgtaccgggcaaaatcattgacagttcccagatcacggagttgatgtgtgtcctttggaatacaatgagtatgtcccctgccatgatggagcctatataagcagcttgaagagcctggataatctanngcatgaggatcttggaaagtatttgtcctcctgggaagaagccggttgntttttgttttggtgccccctcccaatgactacnagataccaataagatggccaacaagccgagactacggtatgggcgtagtaatgtcaaccattcacattcttgctgaggtcaaaggaggacagaacg

SEQ ID NO: 23119 - protein, 88 aa, Zea mays
  misc_feature: Ceres CLONE 1393241-F
MRRWWSPALAAVEPRSVQLLLLGVALVAASFYAGTLFGSSASPALVLPSSRPRSPDSFRAKVTDVPVFTNRVSRTYRAKSLTVPRSRS

SEQ ID NO: 23120 - DNA, 666 bp, Zea mays
  misc_feature: Ceres CLONE 1393242-F
  misc_feature: Encodes the peptide sequence at SEQ ID NO. 23121
  misc_feature (492)..(492): n is a, c, t, g, unknown, or other
  misc_feature (624)..(624): n is a, c, t, g, unknown, or other
tccccgcggtggcggccgctctataactagtggatcccccgggctgcaggaattcgcacgagaccattacctagaacatcctaatcgaaaagacacgcactctactctcgcacacagccgccgggcgggcacagtgacgcggccacgcgggcgccggagctagggtttccctgatccggcagggccggggagccgccggaaaccgttgctcgatttcggcgccggaggcgcggcatcggtgtctccgaggacggcggacgcgaggcgggttggggagctgaggcgcggcgccgggggctcagatctggtatgaccgacggcggcgaagacgggaatgcggcggcgcccagggccccctcgcgccgaaggggacctgtgcgggccagcctcgatgccgacgagttcatggcgctgatgcacggctcggatcccgtcagggtcgagctcacccgcctggagaacgagctcagggacaaggagagggagcttggngaggcacagacggagatacgcgcactgcgcttgtcggagagggcgcgggagaaagccgtcgaggagcttacagatgaattggagaagatggctgagaaaactcagctgacagaatctctcctttgaagcaangtaccacacttatactttgctttttgctgtgtcctctaatga

SEQ ID NO: 23121 - protein, 102 aa, Zea mays
  misc_feature: Ceres CLONE 1393242-F
MTDGGEDGNAAAPRAPSRRRGPVRASLDADEFMALMHGSDPVRVELTRLENELRDKERELGEAQTEIRALRLSERAREKAVEELTDELEKMAEKTQLTESLL

SEQ ID NO: 23122 - DNA, 666 bp, Zea mays
  misc_feature: Ceres CLONE 1393246-F
  misc_feature (385)..(385): n is a, c, t, g, unknown, or other
  misc_feature (431)..(431): n is a, c, t, g, unknown, or other
  misc_feature (456)..(456): n is a, c, t, g, unknown, or other
  misc_feature (457)..(457): n is a, c, t, g, unknown, or other
  misc_feature (552)..(552): n is a, c, t, g, unknown, or other
  misc_feature (561)..(561): n is a, c, t, g, unknown, or other
tccccgcggtggcggccgctctagaactagtggatcccccgggctgcaggaattcgcacgagaccattacctagaacatcctaatcgaaaaagcacaccactcgtagccgccggcaaggcgactgacctctttcctgctgccgagcgccatcgtctcctcggaccatctcacctcagagctgctgcgaccgccggccaacccgtctaggtcttgtccctgccgcttcctgagcctagaacatctttgcattttggagagtctccactcggagctattgtacagtctccatcccctttcacgagatggcacgtcagtctgctctctcgcttgtgagggatcgagcaaagacggagcgctgaagcgtctgactctgaggtcatcggngaccgctgggaggaactcgtctgggcgcatcacctctttccacgtngtgggagggccaagaggtgcagagnnaggtcgatgtgaaacgcgacgctggtccacgggtattggggaggggatcgagtacgacccgaatcgctctcgagcctttgctctgtgcgatgggnggcaagggntgcatttccgccgccccaagagtcacaaaaacctcagtgccctgtctcaaatccaacatctgcttaagttgatggccctccggccggtttttcccttggtgaata

SEQ ID NO: 23123 - DNA, 851 bp, Zea mays
  misc_feature: Ceres CLONE 1393248-F
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (33)..(33): n is a, c, t, g, unknown, or other
  misc_feature (34)..(34): n is a, c, t, g, unknown, or other
taaacccaaacaccaaacctnnnntnnnntgcnntttattaaaccaataaaaaactggagctccccgcggtggcggccgctctacaatagtggatcccccgggctgcaggatttcgcacgagaccattacctagaacatcctaatcaaaaactttaaaatggacgcgcacctccacctgggtctgtctgcgcagggacgcggacgcggcggcaccggcaagcaattgtctcatctgctccactccatctccatttaacgcactctccactccttcgcggcgggggtttaggcgcacggcggcaggccaattaacgccgctgcggcgagcgccgggggggaaatgggcgccgacggcacgagggcgctggacaagacgccgacgtgggccgtggccgccggtcggcgctgtcatcgtcgcggcggcgatagctcctcgagggcttcctccaccaacctccgggcagttggttcacaaaaaaaccgcgcaaaaaagggggtctgtcttgaacgcttcctggaccaagggctaaaatcgcgtagtggttggctccccccgagcggttcccaagttcagtagtgaggtaagaaaggaggtcccgtcaaagggtctacctttccgctccgtattttttaatcccccctaaccaggtcaggcacaaaaaaaacccaagacaaccccccatcccaaccaccaatctagattcaacataaccggggcgcgcgcctcaacccgctcgtgggcttcgcgttcctctcccctacccctatctatgatcccatgccccactctccctccgattcagcgcggggcaggtaacgggtagacgggtaacaatgaaggccataaaaa

SEQ ID NO: 23124 - DNA, 735 bp, Zea mays
  misc_feature: Ceres CLONE 1393249-F
  misc_feature: Translation starting site: 201
  misc_feature (322)..(322): n is a, c, t, g, unknown, or other
  misc_feature (323)..(323): n is a, c, t, g, unknown, or other
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (390)..(390): n is a, c, t, g, unknown, or other
  misc_feature (391)..(391): n is a, c, t, g, unknown, or other
  misc_feature (408)..(408): n is a, c, t, g, unknown, or other
  misc_feature (409)..(409): n is a, c, t, g, unknown, or other
  misc_feature (430)..(430): n is a, c, t, g, unknown, or other
  misc_feature (434)..(434): n is a, c, t, g, unknown, or other
  misc_feature (435)..(435): n is a, c, t, g, unknown, or other
  misc_feature (453)..(453): n is a, c, t, g, unknown, or other
  misc_feature (457)..(457): n is a, c, t, g, unknown, or other
  misc_feature (494)..(494): n is a, c, t, g, unknown, or other
  misc_feature (495)..(495): n is a, c, t, g, unknown, or other
  misc_feature (502)..(502): n is a, c, t, g, unknown, or other
  misc_feature (508)..(508): n is a, c, t, g, unknown, or other
  misc_feature (509)..(509): n is a, c, t, g, unknown, or other
tggagctccccgcggtggcggccgctctagtaatagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaaggtcatgctcccacgganncnnnnnnnnnnnnnnnnnnnnnnnnnnnnngnnnnnnnnnnnnnnnnnnnnnnnnnnnnnnnnnncnnccccccccccccccccnnccccccaccaacccccccccncccnnccccccccccccccgccncccnccctcccccccccccccccccccccccaaaaaaaaanncgggccncccggnnccttttgggaaaccgggggggggggggaaaacgccctgtgttttccccccccccccttgtgggggcggggggcccattgggccttggcccttgggggggggggcctgggtccccgggggggggccttggggggcccgccctcttttaaaccacaggggcccccccccccccccccctgtgggggttgggtgaggggcacccttcgtgggtgcccccccccggtggg

SEQ ID NO: 23125 - DNA, 789 bp, Zea mays
  misc_feature: Ceres CLONE 1393253-F
  misc_feature: Translation starting site: 257
  misc_feature (22)..(22): n is a, c, t, g, unknown, or other
  misc_feature (25)..(25): n is a, c, t, g, unknown, or other
  misc_feature (26)..(26): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (38)..(38): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (283)..(283): n is a, c, t, g, unknown, or other
  misc_feature (287)..(287): n is a, c, t, g, unknown, or other
  misc_feature (298)..(298): n is a, c, t, g, unknown, or other
  misc_feature (306)..(306): n is a, c, t, g, unknown, or other
gtggcccccccccccccccccnaannccannnnnaaanagcgcttnnnnnaaaaaactggagctcaccgcggtggcggccgctcttcaatagtggatcccccgggctgcaggaattcgcacgagaccattacctagaacatcctaatcaaaaagaagctctaaaataatctcttcccgacgtctctggaaggtcagcatctgaacccaggtagcctccagcgctggagacgtgccgtactcaaaccctagccaccaatggcagccggcggcggggctccgtgnccgnagcgcgcgcgnttggtggnaacccatatccgcaacagtttccgcgtggcgcccgtggaccaccggtcgctgtggctgccgggcggacggtcgtgtccccactgagggcggccgggggtgggcggattggggttccggcccctggtgaaaaggggcccgaaacggggatcggaaactccccttcgaaggagaaaatccccttgggggggggggaaaaagccttccgtccaggggttttggggattctacagaaaagagaggggggcaaaaaagtttaaggggaattggaaaactttgggttatttttcccggtcgcttcaagggatttggggtggttccccctttattgggaaaggggcgggtattgttttttaatgggatggggccttaaaactcacacagtccgggttaattggggggcaaaaaaagaactattactacgacgcgatttaacaggggggaggaaccctataaggtgggagggcgcttcttttttaaacggg

SEQ ID NO: 23126 - DNA, 765 bp, Zea mays
  misc_feature: Ceres CLONE 1393257-F
  misc_feature: Encodes the peptide sequence at SEQ ID NO. 23127
  misc_feature (308)..(308): n is a, c, t, g, unknown, or other
  misc_feature (443)..(443): n is a, c, t, g, unknown, or other
gggcgctctagtactaggtggatcccccgggctgcaggaattcgcacgagaccatttacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtggcatcatggtgggcgttcctcctgctcgccggcgggctgctggtcgtagcagccacggcccggggcggaggacggagtggtcgaacgggaaccncaaggaggacctgcggtggtgcaagcaaggcgtgccgagtggcagtacggaaaggacacccccgcggaagagggaatggccagagcgagtgccgcgaagcggcaccagcaagcctgacgcagggcgagggacggncaaccggggggggggaacgccctaacgtctcccggctcccgggaggggggcgaaggggccgggcggcccaggggcttgcgcccgcccccgaagggccccagccgggggcgaagacccaaggagtggaatggaggggggtgcccgccccccggcggaacggggccctcccgacttgggagcaaagagtaccgggccgccgccaagccaagaagccccgcgcaaagggcccgggagaaaggggccagacgcccacccccccgccggaacttggtggggaagaaggcaacgcttccctgagggtgcaagagacccccgtgggagg

SEQ ID NO: 23127 - protein, 91 aa, Zea mays
  misc_feature: Ceres CLONE 1393257-F
  misc_feature (39)..(39): Xaa is any aa, unknown, or other
  misc_feature (84)..(84): Xaa is any aa, unknown, or other
MGKGSVGGIMVGVPPARRRAAGRSSHGPGRRTEWSNGNXKEDLRWCKQGVPSGSTERTPPRKREWPERVPRSGTSKPDAGRGTXNRGGGTP

SEQ ID NO: 23128 - DNA, 964 bp, Zea mays
  misc_feature: Ceres CLONE 1393258-R
aaattgggtaccgggccccccctcgaggtcgacggtatcgataagcttttttttttttttttttaatttgttgtactagttttcctgatttatttacccttttctagtgagagcggtgaagtgttccacgtcagcaggaggaaaaatgaagaaacagagcaaaattacaaacagcttagatttgatttgtttagaaatgaagaaacagagcaaattagagagtttagtttcagtgcctggggacgagacccactctctgcgccatttcgtagagaccaatgctcataagaaccttggcatcagctgttttgcgccagagctctctgtacggtactagtcggactttgataaactcgccatgttcgcggagtcccgtctctttaccttgtagctgtctgatcgtataaaattccacttgccttctatacagaaaaacgctaatctcttcatcacagccaccgggagaagggaagatccggtggcctgtagatgggtcaaggaaagcagtggagatcaaccatttcgtcctttccttggttttataccaatcgtcctctttccacctgacggaactggagtaaccaacaaaaatcaccgtttttcattcattgcaaaatgcccatcagggggaatttccagcccaaattttttcccaggtgaggaaaccccctaaaccggggtctgtgggaaaaaacccccgggaagaagtcccccagtccgtccgtgatttcgcctaggtgggggggggaaagctgtttccccggcggggtgcgcctgtgggagaaatagcgtggtgtgtgggggaaaccctgtggtgggacaagggagcgcgtggttggccggaaaaagaacgacgcttgggctgcataacccgtctaagaagaagaagagggatgtgtgttgtgtctatacatgataagttcctggtaacagcccctcgccacgcaaggagtgcgggtggggg

SEQ ID NO: 23129 - DNA, 727 bp, Zea mays
  misc_feature: Ceres CLONE 1393259-F
  misc_feature: Encodes the peptide sequence at SEQ ID NO. 23130
  misc_feature (246)..(246): n is a, c, t, g, unknown, or other
  misc_feature (330)..(330): n is a, c, t, g, unknown, or other
  misc_feature (354)..(354): n is a, c, t, g, unknown, or other
  misc_feature (359)..(359): n is a, c, t, g, unknown, or other
  misc_feature (372)..(372): n is a, c, t, g, unknown, or other
  misc_feature (374)..(374): n is a, c, t, g, unknown, or other
  misc_feature (413)..(413): n is a, c, t, g, unknown, or other
  misc_feature (414)..(414): n is a, c, t, g, unknown, or other
  misc_feature (430)..(430): n is a, c, t, g, unknown, or other
  misc_feature (454)..(454): n is a, c, t, g, unknown, or other
  misc_feature (512)..(512): n is a, c, t, g, unknown, or other
  misc_feature (541)..(541): n is a, c, t, g, unknown, or other
tggagctccccgcggtggcggccgctctagaactagtggatcccccgggctgcaggaattcgcacgagaccattacctagaacatcctaatcgaaaaatcatcatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggngctgcagggcttgtacggcgctggcgccggcctgacgacgatgatgggcgccggcgggctgtacccctacgcggagtacctgangcagccgcagtgcagcccgctggncgcgncgccctactacgncngggtgtggcagccgagcgccatggtccagccgctcgggnnacagtgctgccagcancagatgaggatgatggacgtgcantccgtcgcgcacaactgcaaatgatgatgcaacttggaggtgccgttgccgcaaaagnaacctgtacgagcagttttgatgcaaaancaaaaacagttggttggagccaagggtttcaccccctggccttgtgatgggcaaaaaattcccggcctgggtgagacttaaaaaaacaatggcccattacccaccaacccgtgggggctccccgtggattccccctatattggtttctggatttgggaaaccctccctaccccctccccacaaaaa

SEQ ID NO: 23130 - protein, 105 aa, Zea mays
  misc_feature: Ceres CLONE 1393259-F
  misc_feature (29)..(29): Xaa is any aa, unknown, or other
  misc_feature (57)..(57): Xaa is any aa, unknown, or other
  misc_feature (65)..(65): Xaa is any aa, unknown, or other
  misc_feature (67)..(67): Xaa is any aa, unknown, or other
  misc_feature (71)..(71): Xaa is any aa, unknown, or other
  misc_feature (72)..(72): Xaa is any aa, unknown, or other
  misc_feature (85)..(85): Xaa is any aa, unknown, or other
  misc_feature (90)..(90): Xaa is any aa, unknown, or other
  misc_feature (98)..(98): Xaa is any aa, unknown, or other
MKMVIVLVVCLALSAASASAMQMPCPCAXLQGLYGAGAGLTTMMGAGGLYPYAEYLXQPQCSPLXAXPYYXXVWQPSAMVQPLGXQCCQXQMRMMDVXSVAHNCK

SEQ ID NO: 23131 - DNA, 726 bp, Zea mays
  misc_feature: Ceres CLONE 1393260-F
  misc_feature: Encodes the peptide sequence at SEQ ID NO. 23132
  misc_feature (514)..(514): n is a, c, t, g, unknown, or other
  misc_feature (519)..(519): n is a, c, t, g, unknown, or other
  misc_feature (528)..(528): n is a, c, t, g, unknown, or other
  misc_feature (674)..(674): n is a, c, t, g, unknown, or other
tccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcagaccaactaccccggcgtggccggcaacggcgcgacgttctacttcctggtgttcgccatcctggccgncgtgntgggcgcgncgtccaagctggcgggcgtgcaccacgtgcgcgcctggcgccacgacagcctggccaccaacgccgcgtcgtcgctcatcgcctggggcatcaccgcgctcgcctttcggctggcctgcaaggagaccacatcggcggacacgcgncttggcgctgcccgtgctgaaagccttcgtcatcatcctcgccttcacgcag

SEQ ID NO: 23132 - protein, 131 aa, Zea mays
  misc_feature: Ceres CLONE 1393260-F
  misc_feature (14)..(122): Pfam Name: AWPM-19 Pfam Description: AWPM-19-like family
  misc_feature (61)..(61): Xaa is any aa, unknown, or other
  misc_feature (63)..(63): Xaa is any aa, unknown, or other
  misc_feature (66)..(66): Xaa is any aa, unknown, or other
MAGIGRNMVAPLLVLNLIMYIIVIGFASWNLNHFINGQTNYPGVAGNGATFYFLVFAILAXVXGAXSKLAGVHHVRAWRHDSLATNAASSLIAWGITALAFRLACKETTSADTRLGAARAESLRHHPRLHA

SEQ ID NO: 23133 - DNA, 782 bp, Zea mays
  misc_feature: Ceres CLONE 1393267-F
  misc_feature: Encodes the peptide sequence at SEQ ID NO. 23134
  misc_feature (1)..(1): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (21)..(21): n is a, c, t, g, unknown, or other
  misc_feature (22)..(22): n is a, c, t, g, unknown, or other
  misc_feature (43)..(43): n is a, c, t, g, unknown, or other
ntttggttttnnnnnnttttnntctctttcttctttttgatantttacctacccccccaaaagctggagctccccgcggtggcggccgctcttccaatagtggatcccccgggctgcaggaattcgcacgagaccattacctagaacatcctaatcgaaaactgggaggcagagacgaaagcctactagcttccctttgggtcggtctcgcgctcccgctgcgcgtctgtctgtctgtctgtcttggagcctcatcaatggctaccatcagagaggagtccgactacgacagcagccggtcctcgctgacggcgccgggcggctcccgccggagctggatcagcgacattggcagcgccagctcggtctcggcgcgctccgtggcgggccgaggttgcgacgcgccggcgtgccgtcaccggcacaagcctcagaaggcgaaccaggtccgggtgggaggcccatcgggcgcgtcccgcgccggccggggggcccgcggtcggcctggaacccactttcggcccgggcggcggacgacctggggaaaggggggggacactcgggggaaacgtcccaccctcccggccagactggccccgggcccccgggccccccccccgggcggcggcctgttacccccattgaatgggcgggtggggacacggcccggccctgcgtgggtgtcccggccaggatatctggcaggcaagggggggggagtggaagtagatagggggctcttagcagcggtgcccccctcccctcctccctttcttcccgcc

SEQ ID NO: 23134 - protein, 175 aa, Zea mays
  misc_feature: Ceres CLONE 1393267-F
MATIREESDYDSSRSSLTAPGGSRRSWISDIGSASSVSARSVAGRGCDAPACRHRHKPQKANQVRVGGPSGASRAGRGARGRPGTHFRPGRRTTWGKGGDTRGKRPTLPARLAPGPRAPPPGGGLLPPLNGRVGTRPGPAWVSRPGYLAGKGGGVEVDRGLLAAVPPSPPPFLPA

SEQ ID NO: 23135 - DNA, 734 bp, Zea mays
  misc_feature: Ceres CLONE 1393269-F
  misc_feature: Encodes the peptide sequence at SEQ ID NO. 23136
aaagctggagctccccgcggtggcggccgctctaccaactagtggatcccccgggctgcaggaattcgcacgagaccattacctagacatcctaatcgaaaaagcgcaaaaccctagcctcgcccgtcccaaaccctggcggctacggtctctgatcccggtccaatggcgtcgtcgccggacttgttccctaacgttgccttctccgacgtctctgccgccgcccccgcggccgaggccaccgccgcgttcgggttcggcgccgccaccggggccccgggcctctgcctcgtcaagtccggaaaggacgaggcggaacccaacggccgaaatcgacctcgccgaggcgcaggttatttaagtccccccccacggaggggggtgggccttgggccaacaatcccaaagcttaacgttgggggggaaaaaaaaatcattttcacgaaagcaattaaaggttgtccttaacgcaaaaaaccctgggaggaaagcccttccctttttaactttttcgaaaaagggacaaatctcagtcttttagtggcaaaaaccttgtccgcatatactctgaaaaatggatgccacactctctccctccacctcgcctacttttataacaaaaaatctctgcgacatacccgaaaaggacgaaaaactattccaccaacataatgcaatctattaatttctcccgtgtaatctgtttaccacaaattttttactcgtaacacacg

SEQ ID NO: 23136 - protein, 100 aa, Zea mays
  misc_feature: Ceres CLONE 1393269-F
MASSPDLFPNVAFSDVSAAAPAAEATAAFGFGAATGAPGLCLVKSGKDEAEPNGRNRPRRGAGYLSPPPRRGVGLGPTIPKLNVGGEKKIIFTKAIKGCP

SEQ ID NO: 23137 - DNA, 672 bp, Zea mays
  misc_feature: Ceres CLONE 1393270-F
  misc_feature: Encodes the peptide sequence at SEQ ID NO. 23138
  misc_feature (437)..(437): n is a, c, t, g, unknown, or other
  misc_feature (672)..(672): n is a, c, t, g, unknown, or other
cgcggtggcggccgctctatcataatggatcccccgggctgcaggaattcgcacgagaccattacctagaacatcctaatcaaaaaaaactttagtctactcgtcctcggtcctcctcttctcgcagcagccagcagaccaatcgggacaagcaaactcccccgattagtttaagcagcccgggcccggcgacgaccagctccgttccgcgcggggatttaaacgcgcgaagcgagaaggcacgcagcaggcggcagcggcaagcaacgaacgcgatcgcgcgccgacgacgacgcgcggtgccggcgcctggtggtgccgtgttgcggactccgctgcatcgtctcggacggtcgtcgtcgttatcatgggtgtccggctgccggtggcgtggtccgccgtcctcgtcctcctcgtgcgggcgatcgtggcgcggnagtacgcgtccatcttcaactccggggactccctggtgcacgccgcaaacctgggtgatggaccgccatcccggactacgtggccacgggggcgcctgccctacgggatgacccaactacgggtaccccaccggtcccgttggctcggacgaccgccttcgtcggttgacttcatcgcgcagggaacctgggggtggcccctggctgctcgccctaccaagggtgaaggaacgcn

SEQ ID NO: 23138 - protein, 101 aa, Zea mays
  misc_feature: Ceres CLONE 1393270-F
  misc_feature (24)..(24): Xaa is any aa, unknown, or other
MGVRLPVAWSAVLVLLVRAIVARXYASIFNSGDSLVHAANLGDGPPSRTTWPRGRLPYGMTQLRVPHRSRWLGRPPSSVDFIAQGTWGWPLAARPTKGEGT

SEQ ID NO: 23139 - DNA, 681 bp, Zea mays
  misc_feature: Ceres CLONE 1393271-F
  misc_feature (107)..(107): n is a, c, t, g, unknown, or other
  misc_feature (219)..(219): n is a, c, t, g, unknown, or other
aaagctggagctccccgcggtggcggccgctctagaatagtggatcccccgggctgcaggaattcgcacgagaccattacctagaacatctaatcgaaaactggatncttctctcttctctttctctgagtcgcagcttcggcagctgggggtctggtctacggtctaccactaccactctaccagagaggggatcgatcacacaaacacacccatggngggctgcgcggcggggctcatgttcacgtacaacgccagctctgcggctgggatccggggtatactactacctcagcagcaacggcaccgggagctgcatccccatgcccggcgggggtggggcaactggaaggtgggctcctgcgcgcgcccagaagcagagcctctactgctgggagcggtgtctcggtttacggcatccgccgcctcacccagtccaggcgtgctcctcgaggggaccctcgggtccctcctctggtggatcgccctcttgcgcgcaaccaggtttcgcggccggaaacccggggggggaaaagaagcttgttccggccccggtaactgtgtcaaccggcctcaaatggctttttcaaaaaaaggcagtggggggggggggttcccccaagttctttagggaaaaggggaaaaccccgattttgggggggccccatttccccccgcccc

SEQ ID NO: 23140 - DNA, 699 bp, Zea mays
  misc_feature: Ceres CLONE 1393273-F
  misc_feature: Encodes the peptide sequence at SEQ ID NO. 23141
  misc_feature (380)..(380): n is a, c, t, g, unknown, or other
  misc_feature (515)..(515): n is a, c, t, g, unknown, or other
  misc_feature (563)..(563): n is a, c, t, g, unknown, or other
  misc_feature (565)..(565): n is a, c, t, g, unknown, or other
  misc_feature (572)..(572): n is a, c, t, g, unknown, or other
  misc_feature (613)..(613): n is a, c, t, g, unknown, or other
cgctctattactagtggatcccccgggctgcaggaattcgcacgagaccattacctagaacatcctaatcgaaaaactgcttcctagcttcgttcgttccggagcgccagagagagaaagaaaaggaaaagaagcgcctttgcccaccgcgcgatcaatcaatccggcgtccggcggactgccatggtgaagctggcgacgcccagagaggcgcgactgtacggcccggcgctggcgacaaggcggtgggagtacatcaacgcgggaacatacgtgttcgcggcgctgctcctggtcctggcggcggcgctgtccatgtccgtgtccgcggccaggccggggctcgccgtaagcgccgtggcgctggaggacgtggcggncgtcaacgcgcacgtactcgccgagcatctggatgacgtctactgccgcgtggtactgacgagctacgatgcccagctcgtgctcgtggagttcctcgtgccggacgagcacgcagccgggtgcgcgctcgccgncgacagtctgaaggtgctggaccccccccactcgcagtaccagaagcngnacgcggngatcatgctgctcgtacgcgagctgttggggggggctgggntcggtgctcaactcctgccaggtagtactacatcgtcgacgtctgcgagcagtgctgaagtcggcctttgaagtgcctcacctgat

SEQ ID NO: 23141 - protein, 166 aa, Zea mays
  misc_feature: Ceres CLONE 1393273-F
  misc_feature (66)..(66): Xaa is any aa, unknown, or other
  misc_feature (111)..(111): Xaa is any aa, unknown, or other
  misc_feature (127)..(127): Xaa is any aa, unknown, or other
  misc_feature (128)..(128): Xaa is any aa, unknown, or other
  misc_feature (130)..(130): Xaa is any aa, unknown, or other
  misc_feature (144)..(144): Xaa is any aa, unknown, or other
MVKLATPREARLYGPALATRRWEYINAGTYVFAALLLVLAAALSMSVSAARPGLAVSAVALEDVAXVNAHVLAEHLDDVYCRVVLTSYDAQLVLVEFLVPDEHAAGCALAXDSLKVLDPPHSQYQKXXAXIMLLVRELLGGAGXGAQLLPGSTTSSTSASSAEVGL

SEQ ID NO: 23142 - DNA, 722 bp, Zea mays
  misc_feature: Ceres CLONE 1393279-F
  misc_feature: Encodes the peptide sequence at SEQ ID NO. 23143
aaactggagctccccgcggtggcggccgctctagtactagtggatcccccgggctgcaggaattcgcacgagaccattacctagaacatcctaatcgaaaaattcgctcctcccgcccgccgccgtcgccgcctcctctccccagcacccggagctcgcccgaccgccgctcaccatgatcatccccaagaagaaccgcaatgagatctgcaagtacctcttcaaggagggcgtgctgtatgccaagaaggactacaacctggcgaagcacccgcagatcgatgtgcccaacctccaggtgatcaagctcatgcagagctttaagtccaaggagtatgttagggagaccttctcctggcagtactactactggtatctcaccaacgatggcattgagcacctacgcaactacctgaacctcccgtctgagatcgtgcctgccacgctcaagaagtctgccaagccacctggccgcccatttggctctggacctcctggtgaccgcccaaggggcccaggtcgttttgacggcgacaggccaaggtttggtgacagggatgggtaccgtggtgctcctcgtggtgctcctggtgactttggagacgataagagtggagctcctgctgagttccagccatcattcaggaggactgcctctgggcgtggtgtcggcagcggcttcggcgcaggtccagcctcttctccatggagtgagttgccct

SEQ ID NO: 23143 - protein, 182 aa, Zea mays
  misc_feature: Ceres CLONE 1393279-F
  misc_feature (3)..(98): Pfam Name: S10_plectin Pfam Description: Plectin/S10 domain
MIIPKKNRNEICKYLFKEGVLYAKKDYNLAKHPQIDVPNLQVIKLMQSFKSKEYVRETFSWQYYYWYLTNDGIEHLRNYLNLPSEIVPATLKKSAKPPGRPFGSGPPGDRPRGPGRFDGDRPRFGDRDGYRGAPRGAPGDFGDDKSGAPAEFQPSFRRTASGRGVGSGFGAGPASSPWSELP

SEQ ID NO: 23144 - DNA, 656 bp, Zea mays
  misc_feature: Ceres CLONE 1393280-F
  misc_feature: Translation starting site: 283
  misc_feature (422)..(422): n is a, c, t, g, unknown, or other
  misc_feature (448)..(448): n is a, c, t, g, unknown, or other
tccccgcggtggcggccgctctagaactagtggatcccccgggctgcaggaattcgcacgagaccattacctagaacatcctaatcgaaaaagagcagagctgagctgcctccaactccgacccacacccacggcacggcagtcggcagcagccagcgttgagcgcagtgccctcttgtctgctgcctcctacctccccgcccagtctcactcacacgctcccacttccgagtctcgctcgcagcctgttctcctggggtccgatcggaggggggtgaggagatggagccagattcggcgacgacgaggctcgcattgctggcgctgcttctcctggcggcgcccgcccgcccggcctcggcggctccggtggaggatggcctgctcagcaatggtgactttgagacgcaccagccggcggntttgtaagatctgcgtctgttgctgnaggtgcatcgtcaatccctgggttggacatcaatggcacagtcgagctcatttcagcaggccagcacagggtggcattgatcctgattgttccacagggagaccatgctgtaagggctaaggaatgatggtagcgtttggccagggtggtggacgtcaaaaaagggctccggaataaccctggcacatttcagcgcttgcccggactg

SEQ ID NO: 23145 - DNA, 708 bp, Zea mays
  misc_feature: Ceres CLONE 1393281-F
  misc_feature: Translation starting site: 209
  misc_feature: SWISSPROT Homolog: EC 2.7.1.4 Fructokinase
tccccgcggtggcggccgctctataactagtggatcccccgggctgcaggaattcgcacgagaccattacctagaacatcctaatcgaaaaaccgcattcgcagcacaatgagctcgccttaccttcccaaccagcccggctctctcttctatctgtctctcttctcggagaggcgtccacctcgcagcagaaaggaagcgcgaccaaatgtcgcctctaggatacgacggagctgctgtcacgacgaaggccaacaacctgggggtgtggttcggtgagatgctgatcgacttcttgccccgacgtgttcgtgctgtcgctgctggagtcatctgtcttctgtcaaggcacccggagacgcgcccgccaaagtctcctgcgccatcgacaagcttggaggatcctccacctgcgactggtagttatgcgacgacgagatcgaatgcatgctgacgaacatcctgatatagaacatcgtgaaatcgaagagatgcctgatcgacagcacgcgaggacgcggctgaccttcgtgacactcaagaacgatggggagcgatgagttctgttctacacgtactcgagcgctgacatgctgctgatggaagtggaatcttgccctgtgactagagcgaggcgcctagggatgtccactacgaagtccatctggctcatactccgaatcgatgccgatcgaggcacatggcctt

SEQ ID NO: 23146 - DNA, 692 bp, Zea mays
  misc_feature: Ceres CLONE 1393281-R
  misc_feature: Translation starting site: 423
  misc_feature: SWISSPROT Homolog: EC 2.7.1.4 Fructokinase
cgattgggtacgggccccccctcgaggtcgacggtatcgataagcttttttttttttttttttgcaccaaggcattcattgaaaactctgcatggaaggcatcacattagccttcccaatcacacgactctagcaatgttcaaaaccccaactgatccaagctaaaaataaaataaaaataaaggatagcatcccaccacgcatgccaacattttattgatgccccggggcgaaatctccacgaaagctaacttaattaacccaaacaaaccgtctcagcgtagaggcgcatagacggacgctaagactccatctacctaatgaaccgaaacctaggacgtctacgacgacgggcggggcagccggggacagtgacgtggtggaacggcggccgtgcggccatgatctagttggccttgccgatgaggtcctgggcggtggcgaccgaggacagcgccgggatggctcccttcttggtggagcagatggcgccgcaggcgttggagaacttgagagcctcgcggagcttctcctcgttgtggaagatggagtcttccttggctactttcacgaggagggagcccacaaatgcatccccggcgcggatgttgtcgactgtgtccaccttgaagccggacaccctgcaattgaagtccttggtgaagtacctgcatacccttgtccccgaacgg

SEQ ID NO: 23147 - DNA, 711 bp, Zea mays
  misc_feature: Ceres CLONE 1393282-F
  misc_feature: Encodes the peptide sequence at SEQ ID NO. 23148
  misc_feature (349)..(349): n is a, c, t, g, unknown, or other
  misc_feature (363)..(363): n is a, c, t, g, unknown, or other
gctctatttctagtggatcccccgggctgcaggaattcgcacgagaccattacctagaacatcctaatcgaaaaaagaggcgacggaatgacggagcggcaggtggcggagctgggtcccgggacggcgtgctgcggctggaaccactgtggccgccgcctcgccgctggcgccgtcgatggctccgtctccgtctatgactcccagccgccaccctcgttcaagtggcaggcccatgagcaagccattgtgaatgtcgtctggcttcctccagagtatggggatgctatagcttgtgtttgtgctgatgggacactgtctttttgtggagagtttgctgctgatgatncacttccaactggnaaaattgaaaaatcttcgaggatggcacctctcaaatacaaatgaacattttgggatacatctgggatcctgaaaagggttactgcataccccaatggccaggcaagggctaccagcctttggattctgggaattaaacaagggcgttttcgggaaggtcccaaaattttcggggccattcccaaatttggaagacgggggggcttttcccccccaaggggggacccacaaaagggggggaccccccacacaatttttggaaggggttttaaataaaacccccctttttcccctttgggaaaatggggggggggaaaaatcttccggggggttttccctttgtgggaa

SEQ ID NO: 23148 - protein, 106 aa, Zea mays
  misc_feature: Ceres CLONE 1393282-F
  misc_feature (88)..(88): Xaa is any aa, unknown, or other
MTERQVAELGPGTACCGWNHCGRRLAAGAVDGSVSVYDSQPPPSFKWQAHEQAIVNVVWLPPEYGDAIACVCADGTLSFCGEFAADDXLPTGKIEKSSRMAPLKYK

SEQ ID NO: 23149 - DNA, 817 bp, Zea mays
  misc_feature: Ceres CLONE 1393283-F
  misc_feature: Encodes the peptide sequence at SEQ ID NO. 23150
  misc_feature (25)..(25): n is a, c, t, g, unknown, or other
  misc_feature (30)..(30): n is a, c, t, g, unknown, or other
  misc_feature (33)..(33): n is a, c, t, g, unknown, or other
  misc_feature (35)..(35): n is a, c, t, g, unknown, or other
aaccccaaacaccacacccacacantccgngcntntttgcccggccccccaaaactggtactcaccgcggtggcggccgctctagaatagtggatcccccgggctgcaggaattcgcacgagaccattacctagaacatcctaatcgaaaagttccgcttcgtcccagcctctagttcttcctttcctccagagtgatggccaaatgctactcagaattggcccccgattccgcctttccatccatcgcgaagaacgccgccgcaatcccacgcctccccgatcacgatcaggcggcagctcgcgtccttcgtgctccacctgctccaagatcctgcgctcccctcctcgagcccaggaacctgccccgatgagttcggaggccgtaaccggcgacgccgcccgcccgccgttgccggaacgcccgccccgaaaggctgggggatttcctaaaaggttcatccgaagccctcctgcggtgaacccggaaaaccgaagcaggttggtccttttccgagggctaacaagggaagggccggtggttgcaacccccgagtttccgggtttgggagaaaagaagaagggccaaacgcggcctggacacctggcaggttgattcaaggggaaaaaaaaagtgggggcttcccctgggaagctggttgggcccaagggacttccgggggccccccggcggggggttccccgcaaaaaacggcgacgggcgggcccggcctcgctcaccttgttgcaatacaaaggaggggaagaaaagtttcggctctcccccaacccccactcaaaaacagacactaccaccg

SEQ ID NO: 23150 - protein, 81 aa, Zea mays
  misc_feature: Ceres CLONE 1393283-F
MSSEAVTGDAARPPLPERPPRKAGGFPKRFIRSPPAVNPENRSRLVLFRGLTREGPVVATPEFPGLGEKKKGQTRPGHLAG

SEQ ID NO: 23151 - DNA, 701 bp, Zea mays
  misc_feature: Ceres CLONE 1393286-F
  misc_feature: Translation starting site: 200
  misc_feature: SWISSPROT Homolog: EC 3.1.3.16 Phosphoprotein phosphatase
  misc_feature (369)..(369): n is a, c, t, g, unknown, or other
cgctctataatagtggatcccccgggctgcaggaattcgcacgagaccattacctagaacatcctaatcgaaaaaaaagagactttagggttttagcgggttctatttctgagcgagggtttatccgccaggggcggcgcgacgcggcggcagttgagctgggatttccttcccatcccgttcccttccaggcgaggcgatggacgaggcggcggtcgactacctcatccggcgcctcctcgaggcccgcggcgggcgcaccccgcgcaacgcgcaggtgaccgacgctgagatccggtgcctctgcgccgccgccaaggatgtgttcctctcccagccgaacctcctggagctcgaggccgccatcangatatgcggggatgtccatgggcagtattcagacctttctgcgattatttgagtatggtggctatccacgagatgcaaagtatctggtccctcggagactatggtgatagggggaaacagaggataggaaacatatggcttctctttggatacaagaaaaaggacccagaaaaactctttccttctcaggggaaccctgggatgcgcctcatccacccgaaaattgggttttttgagggggggaggagggaatccaaggtcgcatctggaaaaattccccgggggtttaacggccccccggggggggttattgaaggaagaattttgggtgg

SEQ ID NO: 23152 - DNA, 720 bp, Zea mays
  misc_feature: Ceres CLONE 1393287-F
  misc_feature: Encodes the peptide sequence at SEQ ID NO. 23153
  misc_feature (308)..(308): n is a, c, t, g, unknown, or other
  misc_feature (309)..(309): n is a, c, t, g, unknown, or other
  misc_feature (347)..(347): n is a, c, t, g, unknown, or other
  misc_feature (354)..(354): n is a, c, t, g, unknown, or other
  misc_feature (461)..(461): n is a, c, t, g, unknown, or other
ccccgcggtggcggccgctctagaactagtggatcccccgggctgcaggaattcgcacgagaccattacctagaacatcctaatcgaaaaaccgcagccgcagcacaatcgcctcgccttcccttccccaccagcccgtctctctcttctctctgtctctcttctcgtagccgcgtccacctcgcagcagcaagcaagcgcgaccaaatggcgcctctaggagacggcggagctgctgccgcggcggcgtccaacaacctggtggtgtcgttcggcgagatgctgatcgacttcgtccccgacgtggnncggctgtcgctggccgagtcgggcggcttcgtcagggnccccggnggcgcgcccgccaacgtcgcctggcgcatcgccaagctcggcggatccctccgccttcgtcggaaagttcggcgacaacgagttccgggcacatgtgggtgaaaatncctggagaaaacaacggtgaacgcggagggttggcttggttaaaaagcacgggggggagggggttggccctccggggcctcaagaacaagggggaagggggttctttgtcttaaaggaacccaggggggaaattgtttttgaggagggggaatttgaccggggccggggggggcccccagggtttcccaaaagggtcctttcgtttatcccaaaacggggcttttggaaaaatggccccaggggggaaaaaaggcgggg

SEQ ID NO: 23153 - protein, 82 aa, Zea mays
  misc_feature: Ceres CLONE 1393287-F
  misc_feature: SWISSPROT Homolog: EC 2.7.1.4 Fructokinase
  misc_feature (34)..(34): Xaa is any aa, unknown, or other
  misc_feature (47)..(47): Xaa is any aa, unknown, or other
MAPLGDGGAAAAAASNNLVVSFGEMLIDFVPDVXRLSLAESGGFVRXPGGAPANVAWRIAKLGGSLRLRRKVRRQRVPGTCG

SEQ ID NO: 23154 - DNA, 642 bp, Zea mays
  misc_feature: Ceres CLONE 1393291-F
  misc_feature: SWISSPROT Homolog: EC 2.7.2.3 Phosphoglycerate kinase
gctctataactagtggatcccccgggctgcaggaattcgcacgagaccattacctagaacatcctaatcgaaaaaccagaagcacatcccgacgcatccaatctgactactacacatatcgctgaccgcctattctatctgtctcttcctccccagggactgtgttgattaccaggacgagcgtgttaatactgaatcaacgacatctgaaatggaagaaagcgctcgtatgctccaacctatacgttactctctacgagtcccaaaacatcaccgacgacaccctcatccgcaacttcgtgcccttcatcaggttcatcatcgagaaggtcgccgagtgcatcctcttcagccagctgtctcgagcaaaaggtgtcaccaccaagtacagcttgaagcctcgtcgtacactcttgtcggacctcctcagaagtgaagacgtgatcgccattgattgcattgacgcagctactcagaaagatgctcgcgctattgccggaatgagcaggctctgctcgctagagcatgtaagattccacgatggtggacagaaaaacgcaactgaggttggctagccaggctacacccggggcttgacgttaatggcaaggagggttgggggacgtcccccggagattatgc

SEQ ID NO: 23155 - DNA, 687 bp, Zea mays
  misc_feature: Ceres CLONE 1393294-F
  misc_feature: Encodes the peptide sequence at SEQ ID NO. 23156
  misc_feature (509)..(509): n is a, c, t, g, unknown, or other
  misc_feature (627)..(627): n is a, c, t, g, unknown, or other
  misc_feature (647)..(647): n is a, c, t, g, unknown, or other
cgctctatactagtggatcccccgggctgcaggaattcgcacgagaccattacctagaacatcctaatcgaaaaatgcagcagtagccgtctgcctcctcgctttccctttcgtccgtacgccgccgcctcgcaccgccgacagtcctcagtccagaactccagatcgagcctccctctccccagatcgggtcctaggctacagcagccgccgcatccgtcaccttcacaccgcgtgcgtgctctctctccccctccccctctccgtgcgacgactgggtgggctaccgccgccctacgcaaggtgccgagaacttcgccgatatctgcgccggagaagagcgcccaccagatcaggcgcttagaaggcgcgctggccggtggatgacgatggcgggtggcgggggactgaaccggtcttcatcgagggggcagctgccgccgcaagagctgcttgacgatctctgcagccggttccttctgaatgtgcccaaggaggagctggagtcngtcgagcggatcctgttcctgctggagcaggcgcactggttctatgagggacactccgttgaggcacaccccaacctcagtccctctccttcaaggacttcacttccctcatggtcangagctgcactgctctccggncctacatcggcgcactggatgatatctacgaggacttcaa

SEQ ID NO: 23156 - protein, 99 aa, Zea mays
  misc_feature: Ceres CLONE 1393294-F
  misc_feature (19)..(96): Pfam Name: DCP2 Pfam Description: Dcp2, box A domain
  misc_feature (80)..(80): Xaa is any aa, unknown, or other
MAGGGGLNRSSSRGQLPPQELLDDLCSRFLLNVPKEELESVERILFLLEQAHWFYEGHSVEAHPNLSPSPSRTSLPSWSXAALLSGPTSAHWMISTRTS

SEQ ID NO: 23157 - DNA, 788 bp, Zea mays
  misc_feature: Ceres CLONE 1393295-F
  misc_feature: Encodes the peptide sequence at SEQ ID NO. 23158
  misc_feature (257)..(257): n is a, c, t, g, unknown, or other
  misc_feature (309)..(309): n is a, c, t, g, unknown, or other
  misc_feature (376)..(376): n is a, c, t, g, unknown, or other
  misc_feature (398)..(398): n is a, c, t, g, unknown, or other
  misc_feature (467)..(467): n is a, c, t, g, unknown, or other
  misc_feature (510)..(510): n is a, c, t, g, unknown, or other
cgctctataactagtggatcccccgggctgcaggaattcgcacgagaccattacctagaacatcctaatcggaaaaatcagtcatcacccaccgcctccgccgccgacaacagcgtagtgtagtgtagttccggagagggttggggagagtagtagtgatccgcaatgtcgacggaggaggctgttgtggctgagatcccggtgaccgaggtgccagcggaggtcccggcggcccaggtggccgaggcgcctaggtncgagaatgcgcctatggagagaaagcgcctaaggagaagaagctttccgcgncgaagaaggcggcggcgcaccctccctacgctgagatgattgaagaggcgatcgctgccctcaaggnagaggagggggtcgagctccgntggccatccagaaagtacgttcgagggggaaggatggcgggaaagcttccccaccaactttccgaaggnaacttcacttgtgaagtttgaaaaggttcccttgccccccggnaaagttggaagaggggtgaaaaaattccttcagaggtggccggcccccgagaggcaaagcccaagggcccccaaagcccaagggaccccaagggggcgggcccaaagcccaaaccctttggccagagaggggagggccaaaccccgtgtggaaacccaaagggggggcgttccccaaaccccgggggagggggggaggggtatttttttttttttcttgggggggaaaccccaaaaacccggggggggggcctctctaaggggggcaaaccccccccc

SEQ ID NO: 23158 - protein, 60 aa, Zea mays
  misc_feature: Ceres CLONE 1393295-F
  misc_feature (31)..(31): Xaa is any aa, unknown, or other
MSTEEAVVAEIPVTEVPAEVPAAQVAEAPRXENAPMERKRLRRRSFPRRRRRRRTLPTLR

SEQ ID NO: 23159 - DNA, 724 bp, Zea mays
  misc_feature: Ceres CLONE 1393297-F
  misc_feature: Encodes the peptide sequence at SEQ ID NO. 23160
  misc_feature (191)..(191): n is a, c, t, g, unknown, or other
  misc_feature (406)..(406): n is a, c, t, g, unknown, or other
  misc_feature (473)..(473): n is a, c, t, g, unknown, or other
  misc_feature (474)..(474): n is a, c, t, g, unknown, or other
  misc_feature (625)..(625): n is a, c, t, g, unknown, or other
ggagctccccgcggtggcggccgctctataactagtggatcccccgggctgcaggaattcgcacgagaccattacctagaacatcctaatcgaaaacttttgagaactccccttctccgccactaccgaagcccttgtacccctcaccgccgccgctgctgctagggagcttccatccgcgcgcgcctacnacgagagctagcagcggtagcggccgttatcttgtcgctccggctccgttcgtgtacccaagtcccagcctagatgccgcagatggaggggtccactgatcagatcgccgccggctggttcgctaaggagccggcttccgagcggcccgtgtgcttgccgaggaccggctcttccagtcgccctcacgcgcaggcgccggagttcgtgccgcggnggccgccgccaccggcgcccggcgttgtgctgcccgctccccgcgcagtgatccgcatgggtcgcgnngctcccccgccgccgggtgggggcttcttctccgcgccgcagccccggccggtcgagtactatgcgcctatccgtgaacgcagcggatttgctgccaagagcaacaggcgccggagctggaagcggagatgctcccgccgccggcgtgaanacggagccggtggtggatgggctccacgacgaggtgggtgcacagatccccagcaggtgaaaactattttagtgacatcaccttgctactacggacatc

SEQ ID NO: 23160 - protein, 153 aa, Zea mays
  misc_feature: Ceres CLONE 1393297-F
  misc_feature (48)..(48): Xaa is any aa, unknown, or other
  misc_feature (70)..(70): Xaa is any aa, unknown, or other
  misc_feature (121)..(121): Xaa is any aa, unknown, or other
MPQMEGSTDQIAAGWFAKEPASERPVCLPRTGSSSRPHAQAPEFVPRXPPPPAPGVVLPAPRAVIRMGRXAPPPPGGGFFSAPQPRPVEYYAPIRERSGFAAKSNRRRSWKRRCSRRRREXGAGGGWAPRRGGCTDPQQVKTILVTSPCYYGH

SEQ ID NO: 23161 - DNA, 632 bp, Zea mays
  misc_feature: Ceres CLONE 1393299-F
  misc_feature: SWISSPROT Homolog: EC 2.7.11.25 Mitogen-activated protein kinase kinase kinase
  misc_feature (299)..(299): n is a, c, t, g, unknown, or other
  misc_feature (463)..(463): n is a, c, t, g, unknown, or other
  misc_feature (528)..(528): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (581)..(581): n is a, c, t, g, unknown, or other
tggagctccccgcggtggcggccgctctagaactagtggatcccccgggctgcaggaattcgcacgagaccattacctagaacatcctaatcgaaaaagcaacccagccgcccattgccggcattgctcgcagcgctagcttcttgcgctcatcactcgtctcccgaccaagatcagcaaggacggcatggctctcgaagcagcgtacgactacctggacgtcgccgtcggtcagtggacgcccacacaagcagcagcaggtcctcgggggtcctcccttcctcctccggcattcgggntaagcccggggggggggaaaggaaatttctgttccgggaaaagttcccccccaaaaggtggggaaaaccccccccggggggggtggggccccccacaccaaaaaaccccctgcgggggggggggaggagaagagaccccccccccccctcattggggggggggnagcccatatttccctctttttttgtttccccccccccaggggtttttttttttttgggcccccanaaaaaaaaaaaaaaaaaaaaaagggggggtgggggggtgggggggggtnnncncccccccccccccccccaaaagcgggggggggcgcacccccaacccacaac

SEQ ID NO: 23162 - DNA, 704 bp, Zea mays
  misc_feature: Ceres CLONE 1393301-F
  misc_feature: Encodes the peptide sequence at SEQ ID NO. 23163
  misc_feature (564)..(564): n is a, c, t, g, unknown, or other
  misc_feature (565)..(565): n is a, c, t, g, unknown, or other
tggagctccccgcggtggcggccgctctagaactagtggatcccccgggctgcaggaattcgcacgagaccattacctagaacatcctaatcgaaaactttcctctccgatccggatctccccacccgctccggcgagccatcgccgcgtcgcctccacgcgaccgactacttctcatatcaatctatctatccggcttacccgccgccgcacgcaccaaggttgcgttcaccatattacctgtttgcttatcttctcccgagcccagcaaaccctagccgccgccacccatggacatagaggccgacggacgattcggcaacaaacgagtgcacaatcgcctaggcccgggctccggcggcgctccaccatctaccaacggaaaggtctgcaactactggcgtgccggtcggtgcaaccgctttccgtgccccttcctccacagcgagctccccgaggctgcgcccgcccagcgccccactggacccggggggaacgtatggcgcaacccccacaccggaggacgaggaggtggcatccacatagatgggggaaggggcaagnnaggggcagcgggattgcgagccacaggccgcctgaaaggccttgcaagactttctccgcgttaccggatggacctttgggaagaggggcggttttccgcaaggtactggataaaggataatatccggaggttaccctgc

SEQ ID NO: 23163 - protein, 138 aa, Zea mays
  misc_feature: Ceres CLONE 1393301-F
  misc_feature (92)..(92): Xaa is any aa, unknown, or other
MDIEADGRFGNKRVHNRLGPGSGGAPPSTNGKVCNYWRAGRCNRFPCPFLHSELPEAAPAQRPTGPGGNVWRNPHTGGRGGGIHIDGGRGKXGAAGLRATGRLKGLARLSPRYRMDLWEEGRFSARYWIKDNIRRLPC

SEQ ID NO: 23164 - DNA, 677 bp, Zea mays
  misc_feature: Ceres CLONE 1393302-F
  misc_feature: Translation starting site: 155
  misc_feature: SWISSPROT Homolog: EC 2.5.1.8 tRNA isopentenyltransferase
tggagctccccgcggtggcggccgctctagaactagtggatcccccgggctgcaggaattcgcacgagaccattacctagaacatcctaatcgaaaacattgaatttggccgagtaacagaaccgtgtctgtttttaattcctgacggttagagatggcccacccctccgccgccgccgtatcctccacggcgctcgctgcaaaccctagctctggcgccagcgaggaaggaggcgcccgctctccgccgtcgccgtctcagagggggcgggccaaggtggtgatcgttatgggcgccacggccgccggcaagtcgcgggtgggcgtcgacctcgcggcccacttcgccggggtcgaggggtccacgccgactccatgcagctctaccgcggcctcgaagtcctcaccaacaaggctcccctcacgaggaagaaaggtgttcctcatcatctaattaagcgggattggtccctctggcaaatttcatttggccgggatttcccggaccggggccctgcaaattaaaaaggaaaaaatgggaccggggcggcgtcccctgggggcttgccgcccagaaaatcttttaacctgcgagctccccggaaagccattctctttcgggacgaattccgccgaaacacaccccgcccccggcccctcggaaaataccccttagc

SEQ ID NO: 23165 - DNA, 673 bp, Zea mays
  misc_feature: Ceres CLONE 1393304-F
  misc_feature: Encodes the peptide sequence at SEQ ID NO. 23166
  misc_feature (291)..(291): n is a, c, t, g, unknown, or other
  misc_feature (300)..(300): n is a, c, t, g, unknown, or other
  misc_feature (673)..(673): n is a, c, t, g, unknown, or other
aagctggagctccccgcggtggcggccgctctagaactagtggatcccccgggctgcaggaattcgcacgagaccattacctagaacatcctaatcaaaaaacaacaccagaatccgcgaatcacagacgcgtctatctcagcttgctgcactgcactaccctgccctgccatcatatcgtacgtgagcccggccgagcgagagcgagggagaggcatggctgctccgaactcgcgacgctggcgctggccgtgctcctggcggcgaccgtggtggctcccccggccgcgntgcgcgcgncgatgtcgtgctccaccgtgtacagcacgctgatgccgtgcctgccgttcgtcaagatgggcggggccctgcccgcccaggcggggttgcgacgtcatcccgcaccctgctggagaaggccaccaacccccccgaccggcgcaccatttggcggttgcctctagaacggcccccaacggggccaacgggaaccgcaccctaatttagggggggccgcgccggttgcccacaaaaggggcggcggtccccccgccccaaaaaagagccagcaccaaaggttatcttcgccatcctatcataaatatacgggactggggggcgggcccgtcagcgcccgcccctaactcccacaccgtcccttttttcggccctn

SEQ ID NO: 23166 - protein, 153 aa, Zea mays
  misc_feature: Ceres CLONE 1393304-F
  misc_feature (97)..(97): Xaa is any aa, unknown, or other
  misc_feature (100)..(100): Xaa is any aa, unknown, or other
AGAPRGGGRSRTSGSPGLQEFARDHYLEHPNQKTTPESANHRRVYLSLLHCTTLPCHHIVREPGRARARERHGCSELATLALAVLLAATVVAPPAAXRAXMSCSTVYSTLMPCLPFVKMGGALPAQAGLRRHPAPCWRRPPTPPTGAPFGGCL

SEQ ID NO: 23167 - DNA, 667 bp, Zea mays
  misc_feature: Ceres CLONE 1393305-F
  misc_feature: Translation starting site: 211
  misc_feature: Pfam Name: DUF315 Pfam Description: Domain of unknown function (DUF315)
  misc_feature (432)..(432): n is a, c, t, g, unknown, or other
aagctggagctccccgcggtggcggccgctctagaactagtggatcccccgggctgcaggaattcgcacgagaccattacctagaacatcctaatcgaaaaagttccatcgctttcccctcctccccagtccccactcccagatgcgatttccctctccaccgccacagcgcctagcttagccagccagccggcggccatcgccgccgcaatggcgaccgcgtcggaggacgaggccgcctcggaccgctgcagcggcagctacagccccagcgccgacgtcagcgagtccgaaacctccagtgactgctccgcgcccaccacgcgccgcttcgcctcctcctcctcggcctccgccaccgtctcccgcctcgcgtcctcctcctcgtcgctccccacccccggatcggccaccgccttctacctctccagncaacccccgacctctccgagatcgacatgatgaaggagcgcttcgcgaagctcctgctcggcgaggacatgtcggcaaggggaagggcgtctgcaccgcgctcgccatctcaaatgccatcaccaacctctccccccaccggggttcggcgagcttgtggaaggctggacccgctccccgaaggcaagaaagggcatggaacccgggaaaaagaaggcgcttccctccccctccc

SEQ ID NO: 23168 - DNA, 662 bp, Zea mays
  misc_feature: Ceres CLONE 1393309-F
  misc_feature: Encodes the peptide sequence at SEQ ID NO. 23169
  misc_feature (218)..(218): n is a, c, t, g, unknown, or other
  misc_feature (327)..(327): n is a, c, t, g, unknown, or other
  misc_feature (412)..(412): n is a, c, t, g, unknown, or other
  misc_feature (438)..(438): n is a, c, t, g, unknown, or other
  misc_feature (452)..(452): n is a, c, t, g, unknown, or other
  misc_feature (481)..(481): n is a, c, t, g, unknown, or other
  misc_feature (606)..(606): n is a, c, t, g, unknown, or other
aagctggagctccccgcggtggcggccgctctagaactagtggatcccccgggctgcaggaattcgcacgagaccattacctagaacatcctaatcaaaaaattgttcgcgtcgtccgccttctctctctctctaacccactgccagccacctcttcgaccgtcgcgaccactcgccaagtaaattttcttccgcccacctgactacgcctcgacctncggcctcggcgccgcctccgtccgccggacgcggcagccatggcgccagcggtggggctcaagcgctccgccacgcagaccatcactctgccgccgcccgacacgcggntggctgtgcgcgatgtcatgcgctccacgatcccgtcgcagcccgccgtggcgccggcgtccacggagaggcaggcgcccgccgncgcgttgcaggggttcctgtgcccgnagggagtggacggnaggcggtgcactacggggtggacgggggnaccccaaaggagacgaacagcgcaggccccccccccgggggcccaccctcggactccaccccctatgcgagccctcaccgcggcggcaaagagaaacgaggaaatgacgggacgaacgcaggaangccgcgcagagagtggataagatgagagtggagacccacgagctcgcccgcgcgcg

SEQ ID NO: 23169 - protein, 122 aa, Zea mays
  misc_feature: Ceres CLONE 1393309-F
  misc_feature (24)..(24): Xaa is any aa, unknown, or other
  misc_feature (52)..(52): Xaa is any aa, unknown, or other
  misc_feature (61)..(61): Xaa is any aa, unknown, or other
  misc_feature (75)..(75): Xaa is any aa, unknown, or other
  misc_feature (117)..(117): Xaa is any aa, unknown, or other
MAPAVGLKRSATQTITLPPPDTRXAVRDVMRSTIPSQPAVAPASTERQAPAXALQGFLCPXGVDGRRCTTGWTGXPQRRRTAQAPPPGAHPRTPPPMRALTAAAKRNEEMTGRTQEXRAESG

SEQ ID NO: 23170 - DNA, 732 bp, Zea mays
  misc_feature: Ceres CLONE 1393316-F
  misc_feature: Encodes the peptide sequence at SEQ ID NO. 23171
  misc_feature (282)..(282): n is a, c, t, g, unknown, or other
  misc_feature (643)..(643): n is a, c, t, g, unknown, or other
aaagctggagctccccgcggtggcggccgctctagaactagtggatcccccgggctgcaggaattcgcacgagaccattacctagaacatcctaatccaaaaacggtaaaggcacaacgaagaagagagatcaactactcatgcaagcactgcggtatttaatttaggttcttaggaacaaaaacaccaagcaccaactttgtacatattaatggacgccatgcacatggtgatcgatcggtctatatagaaagacaggcgggtactagagaggttgtgtgntgtccaagctacacacgggatgctactaactagctgcaggcaagggcgaggaatggcaagcctttcatgtgctcgggcggacggtgttgtccgttccggcgctctgcccggcaagctgttgctgtgcgccagctgctgcttccctacggcggctccagtcgcggacgaagaagtgcaggtgcttgcctgccgccaacattctccacggtttgccgaggcgtaaggatctcccgtcgcaagggcccgggccgtcgccatcctcagttcgccggcctccacaagaagcggcgacaaggcggcctttgaagcttgcccagggccacggtccacctcgggggtcccggggttccaaaaccggggnccgccctgaacccgcccgcccggccggctcccgtccacaattttccggtgggaaaaaaatgttgcatctcccacaaccgggggccgggg

SEQ ID NO: 23171 - protein, 67 aa, Zea mays
  misc_feature: Ceres CLONE 1393316-F
MLLTSCRQGRGMASLSCARADGVVRSGALPGKLLLCASCCFPTAAPVADEEVQVLACRQHSPRFAEA

SEQ ID NO: 23172 - DNA, 736 bp, Zea mays
  misc_feature: Ceres CLONE 1393318-R
  misc_feature: Pfam Name: PUA Pfam Description: PUA domain
  misc_feature (736)..(736): n is a, c, t, g, unknown, or other
cagattgggtaccgggccccccctcgaggtcgacggtatcgataagcttttttctttttttttttcactccccttctcatcagctgcatcaacctcctccttgacctccacagctttagctgatcttgattcccccttgcctttctttttcttcttctcactcttctccccttccactgcttcagcagcttcctcaaccttgatcttcttcgcaggaatagaagcatcggcatcattgttctcatcatccttccgcctcttctttttattctccttgacttcttcagtcacagctgtgtcctgctccaccttcaccttctctggctcaggagcagctgcaatgctggcaattgagacatcaccaccagtgggaagcaccacattccgaagccattcagctggcgttttctcatttggcttcccatgcttgtcaaggagaccctcagcaaccagttttttcttcttgagtgccaccgggccaagcccccacttcctcgggtatgtatctctgtccatcaccaccctcttgatctttgcaactgcaccatgatcacaggtcgccatcacagcagtagtcatctcagcaataccaatagcaatagcctcccctttcgtcgtcatgagaaccacctcctccccagtctcaatatcattctcaaatcggagcaacccaggaatcataagcttagcaccatagcagatagcatttacagcagagtccttcacaaacagcctn

SEQ ID NO: 23173 - DNA, 667 bp, Zea mays
  misc_feature: Ceres CLONE 1393318-F
  misc_feature: Pfam Name: DKCLD Pfam Description: DKCLD (NUC011) domain
  misc_feature: Pfam Name: TruB_N Pfam Description: TruB family pseudouridylate synthase (N terminal domain)
  misc_feature (460)..(460): n is a, c, t, g, unknown, or other
  misc_feature (478)..(478): n is a, c, t, g, unknown, or other
  misc_feature (618)..(618): n is a, c, t, g, unknown, or other
  misc_feature (665)..(665): n is a, c, t, g, unknown, or other
aaagctggagctccccgcggtggcggccgctctagaactagtggatcccccgggctgcaggaattcgcacgagaccattacctagaacatcctaatcaaaagcgctcactccgccactcccactcccccctccgccgctccacttctcctccgtcgcgaaaaccctagaaactaccgaccccctctacccgccgtcatgtcgtccccgccgccggctgtcgcgtcgcctgcctctgagcatgccaaatcgaagaagaagaagcataaatcgaagaacgacaccgttgccgctgacccgccgtcgcttgctgaggccgaggagaaactgatggctacctcatcaagccgcagccccttgtaccttccctcgacacctccacctgggcgctcctcctcaagaactacgaccgccctcaacgtcgcaccggccactacaccccgctaccctcccggcactcgncgctcaagcgccccctcngcgagcatctccgttacggcgtcatcaaccctcgacagccgtcgacccgtcctccccacgaggtggtcgcctgggatcagcgcatcctcccgcgcgagaagaccggtcacagcggcacgctcgaccccaaggtcacaggnaatctcatcgtctggatcgaccggcgcacgcgctcgtaaagtcgaanaa

SEQ ID NO: 23174 - DNA, 677 bp, Zea mays
  misc_feature: Ceres CLONE 1393322-F
  misc_feature: Encodes the peptide sequence at SEQ ID NO. 23175
  misc_feature (327)..(327): n is a, c, t, g, unknown, or other
  misc_feature (452)..(452): n is a, c, t, g, unknown, or other
agagctggagctccccgcggtggcggccgctctagaactagtggatcccccgggctgcaggaattcgcacgagaccattacctagaacatcctaatcgaaaaatctgtctatcttgatctcatctcctatcttcttcctcctagattctttcttccgcgcgccctctctctctctctccttcctgccttctgcctgcgggcggcccatgtccgtggcgcccctcctgccctgcgagctgcttctccagcgaaaaggttgctgcgccttgacgcaccaccgatccaccgccgcccaacccgagcgttctgtccggcagctaggtaggnagctgcgcggtggctgcgaccggaagcagggaggggaacagcgcagcgaacgccgggcgattgccttgcttgcctgtgtgctccgcccggcgcgagttggtcgcccgctccctgcctgcatgatnaggaatttatctcccaggcccgcctggcagctttcctaccagcaggagggggccgccccaccggggccttcgggggccgcgggcgggtttccacccgccgcccccggcttcgccggtcggtcgcccgcccctccgcacgttggccgctagacacccattggccggcgcacccactctgaaccccctccccccagcccccgcgcgacgccgcaaaccgcccgcgcc

SEQ ID NO: 23175 - protein, 131 aa, Zea mays
  misc_feature: Ceres CLONE 1393322-F
  misc_feature (41)..(41): Xaa is any aa, unknown, or other
  misc_feature (82)..(82): Xaa is any aa, unknown, or other
MSVAPLLPCELLLQRKGCCALTHHRSTAAQPERSVRQLGRXLRGGCDRKQGGEQRSERRAIALLACVLRPARVGRPLPACMXRNLSPRPAWQLSYQQEGAAPPGPSGAAGGFPPAAPGFAGRSPAPPHVGR

SEQ ID NO: 23176 - DNA, 663 bp, Zea mays
  misc_feature: Ceres CLONE 1393324-F
  misc_feature: Translation starting site: 454
  misc_feature: SWISSPROT Homolog: EC 3.4.16.5 Carboxypeptidase C
  misc_feature (308)..(308): n is a, c, t, g, unknown, or other
  misc_feature (322)..(322): n is a, c, t, g, unknown, or other
  misc_feature (346)..(346): n is a, c, t, g, unknown, or other
  misc_feature (403)..(403): n is a, c, t, g, unknown, or other
  misc_feature (461)..(461): n is a, c, t, g, unknown, or other
aaagtggagctccccgcggtggcggccgctctagaactagtggatcccccgggctgcaggaattcgcacgagaccattacctagaacatcctaatcaaaatcgcacgagaccattacctagaacatcctaatcaaaaatctctctcgctttctctagccatgacgctggtgaggatgccttgccgcctctgctgcttcctgctcgtcgtcgccgcctccgccgtctccgggcggggggcggtggtcaccaccctcccggctacgaaggccgcctcccctttccactcgaaacaggtatgtggaggtgnacgaggacgccggngcggagctcttctactacttcgtnccgggcgagtccggcgccgacgacagcgacaccccgttcgtcctccggatccccggnggccaacgctgctccgccttcagcggcctcgcctacgagatagtcccatcatgttcgncgtggagccctacaacggaagtttgccggcctgcgctacaacaaaactcggggacaaaggtgcgcatattctttttggggattcgcagtttggggcccggttttccttctcaaaaatggcaagggtacaaggtggagcggtatcaccacgctgaacttgggaaagtcctcaaaaaggggtccacaaccttccggagtacctg

SEQ ID NO: 23177 - DNA, 673 bp, Zea mays
  misc_feature: Ceres CLONE 1393325-F
  misc_feature: Encodes the peptide sequence at SEQ ID NO. 23178
  misc_feature (454)..(454): n is a, c, t, g, unknown, or other
ggagctccccgcggtggcggccgctctagaatagtggatcccccgggctgcaggaattcgcacgagaccattacctagaacatcctaatcgaaaatcaagccaacagcttccgaaaagtttccgaaagctccttcagatctgttggttaatggatacactcatcctgtacctatgtctactgctggctggccaaccaatgctagtttagtggctgttcagagcactggatcaatgactgcaactggtttgccacccaatggtgggtcaaatgcttttccaagtactgcatctctatcagctgctggtaattacaacattaaccagtcgcttcccaggtcttccgttggttgggctggcaatggtggacaaagtgttattcctagcattgctccaagatttgaactcgtgcagcctggtgaagagcctgtttcagctggacaagcagtggtgacnagaatgttggtactcaaaaaaagcacacaggttacttttccaagatggtatgtctgaaccacttgatctgcatcaagggtcccaacggttcagtagcactgatttattcaaaattttctcaggggaaaaaaaatgttccttaaggaatggactgaatactgccaattaaactgggaaatggttatttaaaagagaactgccaccccaacaatgggtggg

SEQ ID NO: 23178 - protein, 112 aa, Zea mays
  misc_feature: Ceres CLONE 1393325-F
MSTAGWPTNASLVAVQSTGSMTATGLPPNGGSNAFPSTASLSAAGNYNINQSLPRSSVGWAGNGGQSVIPSIAPRFELVQPGEEPVSAGQAVVTRMLVLKKSTQVTFPRWYV

SEQ ID NO: 23179 - DNA, 654 bp, Zea mays
  misc_feature: Ceres CLONE 1393326-F
  misc_feature: Encodes the peptide sequence at SEQ ID NO. 23180
cgctcttaactagtggatcccccgggctgcaggaattcgcacgagaccattacctagaacatcctaatcgaaaattttcccctcctccctcctcggctcgtctctgttcccctttccctcctgcgcaccccgtcttctcctccccgcgtcaaaccccagcacaaaaagcaaccgcccgccgcctcctcgctcctctcccgaatcagccgtcgcggtgcctaatccggccgaccccccctccgatccgcgggtgcccgccgcagaggcggcgcctccgggcctcccccgatgtatagcaacttcaaggagcaggcgatcgagtacgtcaagcaggcagtccaggaggacaatgccggcaactacgtcaaggcgttccctctctacatgaacgcgctcgagtacttcaaaacccacctcaagtacgagaagaaccccaagatcaaggaggccatcaccgccaagttcaccgagtacctccgccgcgccgaggagaacccgggcggtcctcgatgaggggcggcgcaaggcctggggcccaacggtgccgaacccacctgtcgccccgcggcccccagaccagggctaaggtagggggaccgaagcgcaccgggagggtatgaactcccaagaacccccaagttggggggccggccc

SEQ ID NO: 23180 - protein, 74 aa, Zea mays
  misc_feature: Ceres CLONE 1393326-F
  misc_feature (5)..(68): Pfam Name: MIT Pfam Description: MIT (microtubule interacting and transport) domain
  misc_feature: SWISSPROT Homolog: EC 2.7.11.1 Non-specific serine/threonine protein kinase
MYSNFKEQAIEYVKQAVQEDNAGNYVKAFPLYMNALEYFKTHLKYEKNPKIKEAITAKFTEYLRRAEENPGGPR

SEQ ID NO: 23181 - DNA, 667 bp, Zea mays
  misc_feature: Ceres CLONE 1393327-F
  misc_feature: Translation starting site: 258
  misc_feature (271)..(271): n is a, c, t, g, unknown, or other
  misc_feature (277)..(277): n is a, c, t, g, unknown, or other
  misc_feature (278)..(278): n is a, c, t, g, unknown, or other
  misc_feature (287)..(287): n is a, c, t, g, unknown, or other
  misc_feature (372)..(372): n is a, c, t, g, unknown, or other
  misc_feature (562)..(562): n is a, c, t, g, unknown, or other
tccccgcggtggcggccgctctagaactagtggatcccccgggctgcaggaattcgcacgagaccattacctagaacatcctaatcgaaaaaactacaatactgctgcgcgctagcggtagcgctcgcgctcccactcgcaccacagcacgccaccgctgctgccggctcctccccgcgctcgcattgcgatttgcgacctagcgcgagggtaccgggggtggtgcgcgtgctccgtgatccggaaagcgccgcgagatggccgggggcgnaggcgnncgtgccccncccaagcacgacgacttcacgccgcaccccgtcaaggaccagctccctggggtctcctactgcatcaccagccctcccccgtggnctgaagccgttctttctggggttccaacattatctggtcatgcttggtaccactgtgatcataccaactgcacttgttccacaaatgggaggaaaacatgaggacaaagcagtggttatcaagacattgctggttcgttgcaggtatcaacaccctcctgcagagtttctttggaccatggtgcctgcangtgatcggcggacaaaacaccttgggtctgcctaccatttcatcatcccttggtggacgttatgctaatgaacctaatccacatattaatttccccgcatcatgg

SEQ ID NO: 23182 - DNA, 616 bp, Zea mays
  misc_feature: Ceres CLONE 1393331-F
  misc_feature: Encodes the peptide sequence at SEQ ID NO. 23183
  misc_feature (250)..(250): n is a, c, t, g, unknown, or other
  misc_feature (412)..(412): n is a, c, t, g, unknown, or other
  misc_feature (422)..(422): n is a, c, t, g, unknown, or other
  misc_feature (467)..(467): n is a, c, t, g, unknown, or other
  misc_feature (473)..(473): n is a, c, t, g, unknown, or other
  misc_feature (500)..(500): n is a, c, t, g, unknown, or other
  misc_feature (518)..(518): n is a, c, t, g, unknown, or other
tggagctccccgcggtggcggccgctctagaactagtggatcccccgggctgcaggaattcgcacgagaccattacctagaacatcctaatcgaaaacctcgcgcgcacgttctgccgcgcgcatacgcccgcatcccgcagccgcggcagcgccgcagccgctccttccatcctccgccctccttccatcctccgcggatcccagctctccctcccgcgcccgcccgcagccgcaccgcatcccgcagnccggcgtcggcgcaacggctgatgctcaaggggtgtgagtcgctgctacagcggcagtgccggccgcgcacccccgcggggtacatggagcccacgccgctaccgggtggcggtgaagagcagggggacagataagcccaaggcagcaaggggaacgtcgancagacccccnacagcctgactccaacactttttttgttcgctggtgcttgcggcnaaacgnggctggcaagctctcccggggtggggntcggggagggtccaaggncaccgggggttcgggggaagaaggggaaaccacccaaaccggggggaagggggcccgcccctgcttggcctttggaggttccccccataagaatcaag

SEQ ID NO: 23183 - protein, 127 aa, Zea mays
  misc_feature: Ceres CLONE 1393331-F
  misc_feature (83)..(83): Xaa is any aa, unknown, or other
GAPRGGGRSRTSGSPGLQEFARDHYLEHPNRKPRAHVLPRAYARIPQPRQRRSRSFHPPPSFHPPRIPALPPAPARSRTASRXPASAQRLMLKGCESLLQRQCRPRTPAGYMEPTPLPGGGEEQGDR

SEQ ID NO: 23184 - DNA, 649 bp, Zea mays
  misc_feature: Ceres CLONE 1393334-F
  misc_feature: Encodes the peptide sequence at SEQ ID NO. 23185
  misc_feature (290)..(290): n is a, c, t, g, unknown, or other
  misc_feature (307)..(307): n is a, c, t, g, unknown, or other
  misc_feature (385)..(385): n is a, c, t, g, unknown, or other
  misc_feature (394)..(394): n is a, c, t, g, unknown, or other
  misc_feature (395)..(395): n is a, c, t, g, unknown, or other
  misc_feature (649)..(649): n is a, c, t, g, unknown, or other
cgctctagaactagtggatcccccgggctgcaggaattcgcacgagaccattacctagaacatcctaatcgaaaaataaagattactcatagattaaagtagggtttggacgtctgcctgtccatttcggcgtctgttcttagcggccgacaagcggaatctggatcaagtcccctgcttcaacccatcccctctcatcgattcattgccacaaggcagctgattgctcacagcgttggatgtgagaattggattcggacccaccgatcgatatgccgttcggccaccgncggctcgatgtccgggntccgccgcagtcgtcctacctctgctgctcccaaccaccgtcgccgtattcgtcgcgctctgcctggggggtgtgtgnatggcgtcnntcatgctcgtcacccctggcgagttccctccatttcagtccaaagtgcgtccactgagggctcatgactctcctcctgccaccggaagcttaaccagggctgatcagggcgatgccatcaccccccatgatgatccaccacctgctacacaacaattgcctcctggaaaaaaagggatggatgggggaaaatcaccaacaaaaacttttcactacagagcgggggaccatgggtcaaccaaggctggaacaacn

SEQ ID NO: 23185 - protein, 88 aa, Zea mays
  misc_feature: Ceres CLONE 1393334-F
  misc_feature (4)..(4): Xaa is any aa, unknown, or other
MASXMLVTPGEFPPFQSKVRPLRAHDSPPATGSLTRADQGDAITPHDDPPPATQQLPPGKKGMDGGKSPTKTFHYRAGDHGSTKAGTT

SEQ ID NO: 23186 - DNA, 704 bp, Zea mays
  misc_feature: Ceres CLONE 1393335-F
ggagctccccgcggtggcggccgctctataactagtggatcccccgggctgcaggaattcgcacgagaccattacctagaacatcctaatcgaaaaagtgtttcgcactttgctattcagcttcgttcttcaccggttcaccctagccgccaccccaacccccagcgacagggaccttcgccgccaggccgcccccaatccctagcgactgcgagcaccgtcgccaggcgccgtgcagcgagcgtcgccgcctggcgaagtcgcgcgactcgtgccctgcagcgagcgccgctgtcccgcacccaccgtcgaacggctgccgatgcccaacgccctgcagcgagttgcgccgtcgtccgcttcctctcgctggtaacctcgtgtttcgatttggacagattgctcgtgacttggtgtttgcgcgccgaccgagcctcctttccctaagtccctaaccgtaagtcctaaatcttgggtgagttctgttcatgtgcatttgagcttacgcatctatgatacgcgccttaggggattgtgatctgggaattagggggtggtgaaattgagatgccatttttaaggaattgggggaaagtgtgaaactggggccttaatggaaaaccaaaaatgcctttttggacaatgtttttcaacatattttttgttggaatgtggcggagggttatgaagaaccttttcccgga

SEQ ID NO: 23187 - DNA, 652 bp, Zea mays
  misc_feature: Ceres CLONE 1393336-F
  misc_feature: Encodes the peptide sequence at SEQ ID NO. 23188
  misc_feature (523)..(523): n is a, c, t, g, unknown, or other
gctctataactagtggatcccccgggctgcaggaattcgcacgagaccattacctagaacatcctaatcgaaaaacgtagggaggggattggagacgccgagctccaccggaggcgaaggcggaggcgcgtggcgcgccctcggactcctcgctgtcttgtttttcaggacaaaatggaccttgcacctcagggtttgataacacagcaacaaaaggcaaatgagcgaaggccagttggtagctcacaaatttggacacggtatggtgttctgcttccaagccagcagactcgaaagctaaaagaatggattctgactgatgagcagcaacagcttgttaatgctagtggtcttggacatctggcacttaccactgggtttaccattgaccgttctttgctgacatctttttgtgaaagatggaataatgaaacaaatactgcacttttcatgggatttgagattgcgccttcacttcgtgatgtttcatatattcttggcattccagtgactggtcatgtgntgacccgcagagcaatttgttgatgaagctggtgaagcggatgtgcttgcattattttaggagagagccctggaaatggagagcaactggtgtggcttatttagggtggacttggtttggataaggaat

SEQ ID NO: 23188 - protein, 123 aa, Zea mays
  misc_feature: Ceres CLONE 1393336-F
  misc_feature (70)..(119): Pfam Name: DUF1723 Pfam Description: Protein of unknown function (DUF1723)
  misc_feature: SWISSPROT Homolog: EC 3.1.3.16 Phosphoprotein phosphatase
  misc_feature (117)..(117): Xaa is any aa, unknown, or other
MDLAPQGLITQQQKANERRPVGSSQIWTRYGVLLPSQQTRKLKEWILTDEQQQLVNASGLGHLALTTGFTIDRSLLTSFCERWNNETNTALFMGFEIAPSLRDVSYILGIPVTGHVXTRRAIC

SEQ ID NO: 23189 - DNA, 641 bp, Zea mays
  misc_feature: Ceres CLONE 1393337-F
  misc_feature: Encodes the peptide sequence at SEQ ID NO. 23190
  misc_feature (221)..(221): n is a, c, t, g, unknown, or other
  misc_feature (228)..(228): n is a, c, t, g, unknown, or other
  misc_feature (315)..(315): n is a, c, t, g, unknown, or other
  misc_feature (316)..(316): n is a, c, t, g, unknown, or other
  misc_feature (411)..(411): n is a, c, t, g, unknown, or other
cgctctagaactagtggatcccccgggctgcaggaattcgcacgagaccattacctagaacatcctaatcaaaaagaagctctaaaataatctcttcccgacgtctctggaaggtcagcatctgaacccaggtagcctccagcgctggagacgtgccgtactcaaaccctagccaccaatggcagccggcggcggggctccgtgggcggagcgcgcgcggntggtggnaacgcagatccgcaacaggttccgcgtggcgcccgtggaccaccggtcgctgtggctggcggcggacggtcgtgtcgccactgaggnngtccggcggtggtcggatcgcgttcgggccctgctgcagaggggccggagcgcggatcggaactccacatcgacggagacatcacctgagggggnggcaaagccttcgtccagcgttttgagattctacagaaagagagtgggcaaagaagttatggggatggaagactctgttattttccgttcgcttcaaggatgggctgttcctcttatgggaatgcatgctatgtttttagcatgctcctaactccagtcaggttatgggggaaaaaagttcctcggggatttcagggaagcctaaagggaggctcttctaaggccagaat

SEQ ID NO: 23190 - protein, 127 aa, Zea mays
  misc_feature: Ceres CLONE 1393337-F
  misc_feature (15)..(15): Xaa is any aa, unknown, or other
  misc_feature (17)..(17): Xaa is any aa, unknown, or other
  misc_feature (46)..(46): Xaa is any aa, unknown, or other
  misc_feature (78)..(78): Xaa is any aa, unknown, or other
MAAGGGAPWAERARXVXTQIRNRFRVAPVDHRSLWLAADGRVATEXVRRWSDRVRALLQRGRSADRNSTSTETSPEGXAKPSSSVLRFYRKRVGKEVMGMEDSVIFRSLQGWAVPLMGMHAMFLACS

SEQ ID NO: 23191 - DNA, 696 bp, Zea mays
  misc_feature: Ceres CLONE 1393338-F
  misc_feature (475)..(475): n is a, c, t, g, unknown, or other
  misc_feature (577)..(577): n is a, c, t, g, unknown, or other
tggagctccccgcggtggcggccgctctagaactagtggatcccccgggctgcaggaattcgcacgtgaccattacctagaacatcctaatcgaaaagccacaacatcacgaaaggaccggatcttggtgagctcgagggtacatgacgcggttcttcctatcgcggcaggtgaccaggacctctatcccctccttgatggaggtcggggactgggatggaggccagggactcgacggcggtgggcctggaggtggcggcaaaggcctcggcgtcgacggccgcggcggtgcgcatttctcggctcgttcattcttgtgccctccttcgattacttcatttcgtcgcgtcccaaatcggtcgatggaaaatggaatctcgatggctttttgtaaatctggattgctatgcatgtctagcgatgcactttggatttttgggtacagtgagattggtagccgcacatggggaatctncgatggcttttgtaaaatctggattgctatgcatgtctagcgatacacttgggatttctggtacccgtgaagattggtagttgcagatgggatacagggggncccttagttgaagtggcagcagaagactggaataatggggggggggacacatcctcttcatcctggacgttgaaggcaatgccttccagttccctggggggggggggcggattaatgct

SEQ ID NO: 23192 - DNA, 633 bp, Zea mays
  misc_feature: Ceres CLONE 1393341-F
  misc_feature: Translation starting site: 247
  misc_feature: SWISSPROT Homolog: EC 1.2.1.3 Aldehyde dehydrogenase (NAD(+))
  misc_feature (47)..(47): n is a, c, t, g, unknown, or other
  misc_feature (308)..(308): n is a, c, t, g, unknown, or other
  misc_feature (309)..(309): n is a, c, t, g, unknown, or other
  misc_feature (360)..(360): n is a, c, t, g, unknown, or other
  misc_feature (394)..(394): n is a, c, t, g, unknown, or other
ggagctccccgcggtggcggccgctctagtactagtgggatcccccngggctgcaggaattcgcacgagaccattacctagaacatcctaatcaaaaacctcctctgcctgccgcttctcctgctgcgggcggtcacggctgcaagtactagaggaggacatccgcttccattactgcgcctgcggaggatcggaggaaccagtagcggaggcttcgattttcggcgggcgcaataaatttcccgcatggctcggagggccgcgtcctcgctcgtctccccgctgctcctggcgagggcccctggcgnngcgccgcccgctgccccctctgcgctgcgcaggacagtgcctgcagatggnatgcacaggctggtgcccagtgtccttcagaggntcagcactgcagcagcagtagaggagccatccacgcgtcagtccatgtgaactacacaaagctcctcattatgggaaacttttgttgattcggcatcgggaggacctttcccaatctggaccctcgaaaaggggaaggggatggctcatggggctggagggtgacccaaaagaatttaaccggggaaaaactgggcgctccaagggtttttgatgaaagcccttggcccaaaatcctgc

SEQ ID NO: 23193 - DNA, 744 bp, Zea mays
  misc_feature: Ceres CLONE 1393342-F
  misc_feature: Encodes the peptide sequence at SEQ ID NO. 23194
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (25)..(25): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (37)..(37): n is a, c, t, g, unknown, or other
  misc_feature (38)..(38): n is a, c, t, g, unknown, or other
  misc_feature (46)..(46): n is a, c, t, g, unknown, or other
  misc_feature (329)..(329): n is a, c, t, g, unknown, or other
gggccccccccnnnnnnnnnnntcncaacaannnttnnttgttttntttcccaagctggagctccccgcggtggcggccgctctagaactagtggatcccccgggctgcaggaattcgcacgagaccattacctagaacatcctaatccaaaaatttcgggctgggtccgggaacctcgaatctatctcctaaccctatcaagctagctagctgcgatgccgagcttccctccgccgggcgccgtcaccatctgcgagatcaaccgcgacctcgttgcggtggatgccctctccgacgaccgcgccaaggacgcatatggggatgtccntcgggatggtgttcgccccgattccgttccagccggaggctcttcttctcgccagccgcgagcctgctgctcctgccgcggaccaagtcgagcctgctgacactgtgcccaccgctgggtttggcagccaccatatccgacttcttcaagcgggatggtcttccctccactagacccaaatctgctagaagaatttgacacgcagaaaagtaagttggaatccatacaagcattgcttagcattcgtgtcgtgggaagaaccagggtactggccaaggattttgaggactccggatgctaaaggacccatgcattttaacaaatgatcatcaaacggatggttaaggcttggtggggggacaccaaataggggcgatagatgattggccctcgccttgcaaggaagggatttggg

SEQ ID NO: 23194 - protein, 70 aa, Zea mays
  misc_feature: Ceres CLONE 1393342-F
  misc_feature (38)..(38): Xaa is any aa, unknown, or other
MPSFPPPGAVTICEINRDLVAVDALSDDRAKDAYGDVXRDGVRPDSVPAGGSSSRQPRACCSCRGPSRAC

SEQ ID NO: 23195 - DNA, 679 bp, Zea mays
  misc_feature: Ceres CLONE 1393344-F
  misc_feature: Encodes the peptide sequence at SEQ ID NO. 23196
  misc_feature (244)..(244): n is a, c, t, g, unknown, or other
  misc_feature (245)..(245): n is a, c, t, g, unknown, or other
  misc_feature (262)..(262): n is a, c, t, g, unknown, or other
  misc_feature (269)..(269): n is a, c, t, g, unknown, or other
  misc_feature (270)..(270): n is a, c, t, g, unknown, or other
  misc_feature (276)..(276): n is a, c, t, g, unknown, or other
  misc_feature (298)..(298): n is a, c, t, g, unknown, or other
  misc_feature (300)..(300): n is a, c, t, g, unknown, or other
  misc_feature (317)..(317): n is a, c, t, g, unknown, or other
  misc_feature (564)..(564): n is a, c, t, g, unknown, or other
  misc_feature (640)..(640): n is a, c, t, g, unknown, or other
  misc_feature (659)..(659): n is a, c, t, g, unknown, or other
aagctggagctccccgcggtggcggccgctctagaactagtggatcccccgggctgcaggaattcgcacgagaccattacctagaacatcctaatcgaaaaataccactccacaatcacacatttgacaccgccaatccatggccttggcgacgccgctgcggctccgccgccacctcctcctccccgccgggccgtccccggcgacccaccgcgccctgtcgctgcggcggggccgcctctcnncagcagcctgtcgtccngcgcggnnggcggncggccgacggtgctggtgacgnanacgctgggttccgcggngctggacctggtgcgcgccttcgccacggggactgctcctacgagctgacgggcggaggacatccgcgccaaggtgtcgctcgaggaccccctggcggcgcacaatcgcaagaaggggacgcggggaggtgcccagggcccccccggtaaaatccccacaagctacggcgaaagaaggcaattgggggagaggaacacaaaaggaaggggcaacccatcctcccgggcgcgggagcgccccacccgnaaacgcgtggcgcaccgcgcaaagacaccgggaaagcacccaaacccggggacccacacccctcccctcccaccgnaaccaaacccgaagggggngaaaaaaccggggacacgac

SEQ ID NO: 23196 - protein, 51 aa, Zea mays
  misc_feature: Ceres CLONE 1393344-F
  misc_feature (36)..(36): Xaa is any aa, unknown, or other
  misc_feature (44)..(44): Xaa is any aa, unknown, or other
  misc_feature (46)..(46): Xaa is any aa, unknown, or other
MALATPLRLRRHLLLPAGPSPATHRALSLRRGRLSXAACRPARXAXGRRCW

SEQ ID NO: 23197 - DNA, 616 bp, Zea mays
  misc_feature: Ceres CLONE 1393345-F
  misc_feature: Pfam Name: S-methyl_trans Pfam Description: Homocysteine S-methyltransferase
  misc_feature: SWISSPROT Homolog: EC 2.1.1.10 Homocysteine S-methyltransferase
  misc_feature (179)..(179): n is a, c, t, g, unknown, or other
  misc_feature (185)..(185): n is a, c, t, g, unknown, or other
  misc_feature (195)..(195): n is a, c, t, g, unknown, or other
  misc_feature (227)..(227): n is a, c, t, g, unknown, or other
  misc_feature (285)..(285): n is a, c, t, g, unknown, or other
  misc_feature (309)..(309): n is a, c, t, g, unknown, or other
  misc_feature (319)..(319): n is a, c, t, g, unknown, or other
  misc_feature (434)..(434): n is a, c, t, g, unknown, or other
  misc_feature (435)..(435): n is a, c, t, g, unknown, or other
  misc_feature (518)..(518): n is a, c, t, g, unknown, or other
cgctctagaactagtggatcccccgggctgcaggaattcgcacgagaccattacttagaacatcctaatcgaaaaaacgccgcctactccgcgctcctccaaaccaaactgaaccctatcctagcacgagtgcacgacggtggcagcaggagatggtggggacggcggaaggcgcgcgnagaggngcgtgcgcgntggtggaccccgccgcgggcgctggtcctggnacgcggctggcacggagctcgaggccacggcgccgacctcaacgacccgctctggagngccagtggctcctctcctccccgnactcatgcgnagggtcatatggactacctaggagccggggcgacattatatcacagcatcgtatcagctactatcccagggtttggatcaaagggctttttcaaagacaaagtgaaacttgttanncaagagtgtcagattgcctgaagccccggagatgttctttgaggacatttggagaatcccctcctatcagatcctattctggntgagagccttaggggagtatgggcttatcttgctgatgctctgagaccggggggattatgtggaactggcaccaagaattcctgaggacttcctcggg

SEQ ID NO: 23198 - DNA, 667 bp, Zea mays
  misc_feature: Ceres CLONE 1393347-F
  misc_feature: Encodes the peptide sequence at SEQ ID NO. 23199
  misc_feature (383)..(383): n is a, c, t, g, unknown, or other
  misc_feature (506)..(506): n is a, c, t, g, unknown, or other
  misc_feature (587)..(587): n is a, c, t, g, unknown, or other
  misc_feature (637)..(637): n is a, c, t, g, unknown, or other
  misc_feature (645)..(645): n is a, c, t, g, unknown, or other
aaagctggagctccccgcggtggcggccgctctagaactagtggatcccccgggctgcaggaattcgcacgagaccattacctagaacatcctaatcgaaaactgttttgttctccttctcattcgactctgatgatgacgagacggttatcgttccccttctggttcggtggagatcgccgccgttggcgtttcgatcgccatatttaaccagtctccaggtctgcatctaccctctcgttagcgtcacaacgtcgttcgtcgcggaggaagacgcgatcatcagtaagggcgtccgaggaaacagcagccaggaggaggacgtggagaaagcctcccacgtgggctttgatccggagaccagcaatctgcatgcatctggncctgcaggtatggcagaatgcgtgaactcgtgtatccctacggagtgcgcagcaaatccctctggcaggcaagggcggtgcgagaaagagtacgtggcgtcggtcacgtcggcgctaatagtncggttcatttctcggctgcttcaggccgtcttcctggtcctttcggcagatcgtgtcaccaatctgggggtggtaagtcgnatccccgatgaaggggcctgcgttggctaccttacgataaggttcttggnggccccgnttgggttgtgctcggcattgaa

SEQ ID NO: 23199 - protein, 91 aa, Zea mays
  misc_feature: Ceres CLONE 1393347-F
  misc_feature (82)..(82): Xaa is any aa, unknown, or other
  misc_feature (85)..(85): Xaa is any aa, unknown, or other
MAECVNSCIPTECAANPSGRQGRCEKEYVASVTSALIVRFISRLLQAVFLVLSADRVTNLGVVSRIPDEGACVGYLTIRFLXAPXGLCSAL

SEQ ID NO: 23200 - DNA, 692 bp, Zea mays
  misc_feature: Ceres CLONE 1393350-F
  misc_feature: Encodes the peptide sequence at SEQ ID NO. 23201
  misc_feature (439)..(439): n is a, c, t, g, unknown, or other
aagctggagctccccgcggtggcggccgctctagaactagtggatcccccgggctgcaggaattcgcacgagaccattacctagaacatcctaatcgaaaagcgattttaccgtggacgactggagagggcgacggggacgaacgagacgaccgtacattcgttatcggactgggaagcagcggcggtacaaagtgtgggagagaaaggagaagagacttgatgtcctcgcagtttgtccaatagatctcctcgccgcctcacccgtctcctcctccgcagcttccccgcgatcccgaccatggagggcgacggtaccaaccttgatgcggcgatagagtcgctcctgaatgtcgagaagcagatgaggctgggccggagatgtcgccggcacttcggaagccgtcatcgacatcgtcgagctctgctacaggggcggnggcgtgggagacgctaaacggaccagatcgttctcctatctaaggaggagaggccagcttaagcaggctattacctgctatggttcagaaaagcaatggagtaatattaattttgaccccaggcttttgacacaagcatcgagctaataaaaacactgaggcagtggctctggtggcaaaattctatgtttgagatagaagagagcaagattggttcaaagggtttgcaaaaataaaagaggggcaggggacg

SEQ ID NO: 23201 - protein, 51 aa, Zea mays
  misc_feature: Ceres CLONE 1393350-F
  misc_feature (47)..(47): Xaa is any aa, unknown, or other
MEGDGTNLDAAIESLLNVEKQMRLGRRCRRHFGSRHRHRRALLQGRXRGRR

SEQ ID NO: 23202 - DNA, 665 bp, Zea mays
  misc_feature: Ceres CLONE 1393352-F
  misc_feature (331)..(331): n is a, c, t, g, unknown, or other
  misc_feature (665)..(665): n is a, c, t, g, unknown, or other
ggagctccccgcggtggcggccgctctagaactagtggatcccccgggctgcaggaattcgcacgagaccattacctagaacatcctaatcgaaaaacttccccatcccgcttgctccgtgccgtggtctccgaggtcggggttcctttccgatttgatccgcccagctggaaaacgaaaatcgctgatgggttttggaaggaaagcgtcatttcttggtgaggtttcccgtttctggatcgactggctgatcgatcgtactagccgccatggcgtcgtcgtgcttcccggccggcggcatccggctgccggacctgaagatggtccaggncgcgccggcgccgccggcgccccggccggggggaatcaggggcggcctccacgctctcgggaggggtcaactcgtccccagcctcctcggtggtggtgggggccgttgccgtcaagccgccccgaacgccgccgaatgggccccagccaaagtacaacgaggggggccccctcttttgcgccatgaacccctccgtttccccccccccgggggctatgggcgactcgagtgggccgccaccgtctcttccgggctccctcgtggctgggcgggaaggggccgagcgcgggcttgcccttcactaccacgccgggcgggcatgccgggtctgacn

SEQ ID NO: 23203 - DNA, 693 bp, Zea mays
  misc_feature: Ceres CLONE 1393353-F
  misc_feature (246)..(246): n is a, c, t, g, unknown, or other
  misc_feature (279)..(279): n is a, c, t, g, unknown, or other
  misc_feature (308)..(308): n is a, c, t, g, unknown, or other
  misc_feature (312)..(312): n is a, c, t, g, unknown, or other
  misc_feature (319)..(319): n is a, c, t, g, unknown, or other
  misc_feature (334)..(334): n is a, c, t, g, unknown, or other
  misc_feature (335)..(335): n is a, c, t, g, unknown, or other
  misc_feature (344)..(344): n is a, c, t, g, unknown, or other
  misc_feature (345)..(345): n is a, c, t, g, unknown, or other
  misc_feature (357)..(357): n is a, c, t, g, unknown, or other
  misc_feature (358)..(358): n is a, c, t, g, unknown, or other
  misc_feature (362)..(362): n is a, c, t, g, unknown, or other
tggagctccccgcggtggcggccgctctataactagtggatcccccgggctgcaggaattcgcacgagaccattacctagaacatcctaatcgaaaaactactagtgatcagaccagtgagctagcgactgtaccatgcagcagctgtaggagagcctggtggtaggtaggataggagtagcgccagccgccaagtgcgcgtccgggctggctgcttcgacgagcaggaggagccgcaccgccggnctcccgcaatgtcgcctcctccgccccccgcgntggtgcgcaacgagctgtcgcgccagacngcgntgctggncctgccgcctgtggnntgctgtggnncatcccgtcggnnccgncttcgtgctggtcctcgggcccatctccctccacccgccgggggggcggggggggcgcccctttaggggccgcgcgcccggtcccgcgccccgggccgggggttcgtgcctccccccctttgcgtccggtgggccctttggcgccccggttgccgggggggtgtggcgggcccggtcgggggtcgggcgtttggctggccgtgccgccgcggtggtcgctccctgtgcgtcgtgggggcgtgctgggcggcgtctcgccccgccgcgccgccgtcgtgcttccccgccgcggcgggctgtggggcggcgggcgggccgcgcgcccgccccc

SEQ ID NO: 23204 - DNA, 675 bp, Zea mays
  misc_feature: Ceres CLONE 1393356-F
  misc_feature: Translation starting site: 576
  misc_feature: Pfam Name: VHS Pfam Description: VHS domain
  misc_feature (383)..(383): n is a, c, t, g, unknown, or other
  misc_feature (384)..(384): n is a, c, t, g, unknown, or other
  misc_feature (389)..(389): n is a, c, t, g, unknown, or other
  misc_feature (393)..(393): n is a, c, t, g, unknown, or other
  misc_feature (394)..(394): n is a, c, t, g, unknown, or other
  misc_feature (426)..(426): n is a, c, t, g, unknown, or other
  misc_feature (473)..(473): n is a, c, t, g, unknown, or other
aagctggagctccccgcggtggcggccgctctagaactagtggatcccccgggctgcaggaattcgcacgagaccattacctagaacatcctaatcgaaaacggttccattccaagtccacctgcccctcctccctccctatctatcctgtactctctctcagtttctctctccccccgttctccgttccacatcgcgtgcgcattgagacgacgagtttctagagcgccgtaccgcgcacggctcccgagccccaccgcaaagcgccggaatcgtgagcgcgtccggcctcgcctagctgctccgcgccgagaggcggccgaggaggacgggcgatgtacccggtgttgaccggccacgccgccggcgcggctgcccggggnncgtcncggnntggacaaggccacgagccacctgctgcagggncccccgactgggccgtcaaccctcgaaatctgcgacaccctcaacgnccgaccgctggcaaacggaaggatgtagtaaaagctggtgaagaagcgattgcagcatagggatccaaaaggtaaattctttactttgacggtattggaacaatgatgaagaactgtggtgaaatgttccattttgaagttgttgatcagcatgttttaaagaaatttgtaaaatggccaaaagagcttgatatgcaggtga

SEQ ID NO: 23205 - DNA, 684 bp, Zea mays
  misc_feature: Ceres CLONE 1393357-F
  misc_feature (405)..(405): n is a, c, t, g, unknown, or other
  misc_feature (423)..(423): n is a, c, t, g, unknown, or other
  misc_feature (484)..(484): n is a, c, t, g, unknown, or other
aaagctggagctccccgcggtggcggccgctctagaactagtggatcccccgggctgcaggaattcgcacgagaccattacctagaacatcctaatcgaaaaataaaaaaaactgagcctgcccgcccgcccgcccgcgcgctccgctccgtgaactatatctatctatcacctgctgctccaaggaggcggacagaggcaggcaggaaggcactcacttctccaggagcccggagtcggcagcaagagagaatggccgccgacgccgccgccgccgccacccttcgtactgctctctcccaaggtctggtgctgtggcatgtttagtgcaatcttcattgcttgctgtcttgctgcatttaacacagcacgagcttcagagaatagtcaaagccctatctgtgnttgccaagagatctcatnccaaggtttacggcaatgaaccatttctaaggcacaaaagaccgtgatgtctttatcattncatcaggagagcaaatgggcgtccaacaggaggtcacccgaccgaggcgggtccccaactaaacccccgaggggggcccttggacgggggaaaaaggttctgggggcccaacgccccccgggatcagggccacagggggggttggaaaaaaattttccccgccccccccccgaaaaattttctcccccgggggggggggg

SEQ ID NO: 23206 - DNA, 682 bp, Zea mays
  misc_feature: Ceres CLONE 1393359-F
  misc_feature: Encodes the peptide sequence at SEQ ID NO. 23207
  misc_feature (407)..(407): n is a, c, t, g, unknown, or other
  misc_feature (529)..(529): n is a, c, t, g, unknown, or other
  misc_feature (682)..(682): n is a, c, t, g, unknown, or other
aagctggagctccccgcggtggcggccgctctagaactagtggatcccccgggctgcaggaattcgcacgagaccattacctagaacatcctaatcgaaaaactctccaatctcgccgccaagcctcaccgcaccatggcgaccttcaccgcggcctcctccctctccctcctcttctcccacccgcactcccactcccgccaaccatccgcccaggggcccaccgccagctcccacctccacctgcatccgcgcgccagccgcgcgcgctgcgcctcttccgacacgacggccacgaagcaccgccgcccagcggaggagaacatccgcgaggaggcggcgcggctccgaggcccggcccagggtttctctgcgtggtacgagcccttcccgccggcgcccggcgncgacccgaacgagcgctactcgctggacgaggtcgtctaccgctccaagctcggggggccctcctcgacgtgcgccacgacatggaaggcgctggcccggctaccccggggccctactggcngtgacctctccgactcccgcgtcggccgcaccgcctgcccctacgggtccggcgtctggtcaaaaaaaaggagttcggggctccccgaaaacgactccaaacacttcgcccccctcttcgaagggaactccaccctcttctgggggggaagcn

SEQ ID NO: 23207 - protein, 182 aa, Zea mays
  misc_feature: Ceres CLONE 1393359-F
  misc_feature: SWISSPROT Homolog: EC 4.2.3.1 Threonine synthase
  misc_feature (91)..(91): Xaa is any aa, unknown, or other
  misc_feature (132)..(132): Xaa is any aa, unknown, or other
MATFTAASSLSLLFSHPHSHSRQPSAQGPTASSHLHLHPRASRARCASSDTTATKHRRPAEENIREEAARLRGPAQGFSAWYEPFPPAPGXDPNERYSLDEVVYRSKLGGPSSTCATTWKALARLPRGPTGXDLSDSRVGRTACPYGSGVWSKKRSSGLPENDSKHFAPLFEGNSTLFWGGS

SEQ ID NO: 23208 - DNA, 615 bp, Zea mays
  misc_feature: Ceres CLONE 1393361-F
  misc_feature: Encodes the peptide sequence at SEQ ID NO. 23209
  misc_feature (322)..(322): n is a, c, t, g, unknown, or other
  misc_feature (388)..(388): n is a, c, t, g, unknown, or other
  misc_feature (510)..(510): n is a, c, t, g, unknown, or other
  misc_feature (528)..(528): n is a, c, t, g, unknown, or other
  misc_feature (574)..(574): n is a, c, t, g, unknown, or other
  misc_feature (578)..(578): n is a, c, t, g, unknown, or other
tccccgcggtggcggccgctctagaactagtggatcccccgggctgcaggaattcgcacgagaccattacctagaacatcctaatcgaaaaaaaatagcaatttttccccctgggagcccgagacgcagcgcgaggtgcggccccgtcccctcgccaccggaggagcaggacgacgaggtggcgtcggcgcgaggtagtcgcgcgcctggaagagcggcggcatcggagtcgcaggcggaggcgaggaagtgaggggagagccctatagccaccgccgcggggcgtcgtgctcgctgcacgcactcccaccattttgtcccnactcgaagctcagactcgtgctgtcgtgctgtgcacgacccctcccctagcatcccaagctcctanctgagaaaacaggagatgggaagagacggggaacagactaggcgccggagccgcaagagatcccgcgacgcctccccctcctcgtcggattccgatttcttcgactccccatcctctcgagnagtagccctgagcgacgnagccgcagcagtaggcggaatagatcatcctcatcgcaccgcacangcgnagaaaagcgaccgggtcgcggagatcccgcgacgaga

SEQ ID NO: 23209 - protein, 70 aa, Zea mays
  misc_feature: Ceres CLONE 1393361-F
  misc_feature (36)..(36): Xaa is any aa, unknown, or other
  misc_feature (42)..(42): Xaa is any aa, unknown, or other
  misc_feature (57)..(57): Xaa is any aa, unknown, or other
  misc_feature (59)..(59): Xaa is any aa, unknown, or other
MGRDGEQTRRRSRKRSRDASPSSSDSDFFDSPSSRXVALSDXAAAVGGIDHPHRTAXAXKSDRVAEIPRR

SEQ ID NO: 23210 - DNA, 679 bp, Zea mays
  misc_feature: Ceres CLONE 1393364-F
  misc_feature: Encodes the peptide sequence at SEQ ID NO. 23211
  misc_feature (284)..(284): n is a, c, t, g, unknown, or other
  misc_feature (529)..(529): n is a, c, t, g, unknown, or other
aagctggagctccccgcggtggcggccgctctagaactagtggatcccccgggctgcaggaattcgcacgagaccattacctagaacatcctaatcgaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccnactcttccgatgcgctggacaagatcaggttcgagagtctcactgacaagagcaagctcgatgcgcagcctgagcttttcatccaccttgtcccagacaaggccacgaacacgctctccatcatcgacagcggcatcggcatgaccaagtccgaccttgtcaacaacctcggtaccatcgccaggtccgggacgaaggagttcatggaagccccttgctgccggcgctgatgtgtccatgatggnccagttcgggcgtcggtttctactctgcctacctcgtcgcccgatagagttgtcgtgaccaccaaggacaacgatgacgagcagtacgtggtggagtcccagcggggcgggtcgttcactgttactcggtgaacgtcaggggagcaggtt

SEQ ID NO: 23211 - protein, 114 aa, Zea mays
  misc_feature: Ceres CLONE 1393364-F
  misc_feature (39)..(39): Xaa is any aa, unknown, or other
MASETETFAFQAEINQLLSLIINTFYSNKEIFLRELISXSSDALDKIRFESLTDKSKLDAQPELFIHLVPDKATNTLSIIDSGIGMTKSDLVNNLGTIARSGTKEFMEAPCCRR

SEQ ID NO: 23212 - DNA, 758 bp, Zea mays
  misc_feature: Ceres CLONE 1393366-F
  misc_feature: Encodes the peptide sequence at SEQ ID NO. 23213
gctctattactagtggatcccccgggctgcaggaattcgcacgagaccattacctagaacatcctaatcgaaaaaaaaaccccgacgcgtccccacctccgtcgccgatgacaccgcgtgccccgcagcttcggcatcacccgccgcacctcctcctcgccgaggctgtcgcctcctggcaccccttccacaagaagccctgtctcacggaccgctccacggctcccccctcctcggcccgcctccctgatgcggagactccgacgcctgccctctcggggggcggaagcgccggatccttcccggtggttccggctccgcaagcggcgccgccgcggtccgggctcgcggcccgtgtccggccgaagcagcgaccgccggaaaacccggaaggggctccgacttccatttccacgtgcggcccccggtggtggtggccgggggccgcgcccactgactcccaccgggaaaaaaggggctcctcggattgtcccgaaagttggggaatgaaggaacctggcccgaagggggaacgaatctccgcccccgcccccccctgtttgtggcccatttgggcgcccggcaaggggagggggtccgacgcttgcaccgggagagcaaacaacccacccactttctgaaaataggggaagcggaaccctgggctaccccctgctcaagggggggaaccttggtatattggaaaaaaaaaaacccccacaaaaaaggcagcaggcctgcggcgaggtccacccagg

SEQ ID NO: 23213 - protein, 177 aa, Zea mays
  misc_feature: Ceres CLONE 1393366-F
MTPRAPQLRHHPPHLLLAEAVASWHPFHKKPCLTDRSTAPPSSARLPDAETPTPALSGGGSAGSFPVVPAPQAAPPRSGLAARVRPKQRPPENPEGAPTSISTCGPRWWWPGAAPTDSHREKRGSSDCPESWGMKEPGPKGERISAPAPPCLWPIWAPGKGRGSDACTGRANNPPTF

SEQ ID NO: 23214 - DNA, 701 bp, Zea mays
  misc_feature: Ceres CLONE 1393370-F
  misc_feature (599)..(599): n is a, c, t, g, unknown, or other
aaactggagctccccgcggtggcggccgctctagaactagtggatcccccgggctgcaggaattcgcacgagaccattacctagaacatcctaatcgaaaaagctcactcgctggtcgttgcctgctgcggattgcccccactcactccgctgctgatatttcgtttggttctcctttccgtcttgtccgtcgccgaggccttccgctcgctcggtcgctccccagctccagcaggcagatcagatccatccaaccacgaacaggaaggtgagcgccgggaacgagccctccgtcctcctactagctgcgatccgtagccttgcgtcgctttcgcgcctagatcgccacgttctagatctgtggtgttttactttcccgggtgcgggtggtcgaatccttccatccaccaggagagctcgtggggtcgttttggttttttcggtgccgtgagccagaatacgaacgaagggggcttgtctttgattcgctcggtctcccctgtgcccgtgatctgatatacgtccggatctgtctgctgtatcatcaggaaggtagagccctgagggctgggctgaagttgacatgattgccgtcgcgnttccgtcgtcgctgaccccgaggcgccgtcttaatccggcgcgctgttgaaggtggagacttcccgccgcaggggtggaactctccccacacggcggttccg

SEQ ID NO: 23215 - DNA, 750 bp, Zea mays
  misc_feature: Ceres CLONE 1393375-F
  misc_feature: Encodes the peptide sequence at SEQ ID NO. 23216
  misc_feature (348)..(348): n is a, c, t, g, unknown, or other
aagctggagctccccgcggtggcggccgctctagaactagtggatcccccgggctgcaggaattcgcacgagaccattacctagaacatcctaatcgaaaaaacaacaacaacaacccgcacaacggcacgattctcctcctccgtccgcgtagctctcggtttcggcgatgtcggggcgcggcaagggcggcaaggggctgggcaagggcggcgccaagcgccaccgcaaggtgctgcgcgacaacatccagggcatcacgaagccggcgatccgtaggctggccaggaggggcggcgtcaagcgcatttctgggctcatctacgaggagacccgcggcgtgctcangatcttcctcgagaacgtcatccgcgaccgcgtcacctacaccgagcacgcccgccgcaagaccgtcaccgccatggatgtcgtctacgcgctcaagcgccagggccgcacgctctacggtttcggcggctaggccgcctccccttctgatgctttgatggacggccgtggtccggtgggtgtctagttgcccgccaactggaagttgttccggatctccgttccagggggtcccagttccaacccctttgggggaaaatttcccctggtataaacaaaggaaagcccccggttttttcctcaaaaaaaaaaaaaaaaaggtttatcgataccctccaacccctgaggggggggccccgaaccccaattccccccaaagggggggcggattaccgcccggtg

SEQ ID NO: 23216 - protein, 103 aa, Zea mays
  misc_feature: Ceres CLONE 1393375-F
  misc_feature (25)..(94): Pfam Name: Histone Pfam Description: Core histone H2A/H2B/H3/H4
  misc_feature (60)..(60): Xaa is any aa, unknown, or other
MSGRGKGGKGLGKGGAKRHRKVLRDNIQGITKPAIRRLARRGGVKRISGLIYEETRGVLXIFLENVIRDRVTYTEHARRKTVTAMDVVYALKRQGRTLYGFGG

SEQ ID NO: 23217 - DNA, 711 bp, Zea mays
  misc_feature: Ceres CLONE 1393376-F
  misc_feature: Translation starting site: 253
  misc_feature: SWISSPROT Homolog: EC 5.3.1.1 Triose-phosphate isomerase
  misc_feature (404)..(404): n is a, c, t, g, unknown, or other
  misc_feature (468)..(468): n is a, c, t, g, unknown, or other
  misc_feature (469)..(469): n is a, c, t, g, unknown, or other
  misc_feature (484)..(484): n is a, c, t, g, unknown, or other
tccccgcggtggcggccgctctagaactagtggatcccccgggctgcaggaattcgcacgagaccattacctagaacatcctaatcgaaaaatcagaggccacaaacctcaccccacctatattatcccgtgccccttgtctttcttcctccacaagcagcgaaatccaatctagaagcgcccctctccctctctctctctctcttcgccgtccgaagctccgcaccccaatctaatcgacacctcgccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgnggccaagaagcagctgcgccaagagttccatggtgcggctcagaactggctgggtaaagaaggnnagtgcttttcaccgntgaagtcagtgctgagatgctcgtcaaccttggtgttccctgggccattcttgaacactctagaagggaaagtctggctggaagaatcaatgaattggttggaaacaaggttgcgatgccctgctcagggactaaaggcattgcatgggttgttgaaacctgagacaaaggaggtggttctacatggaaggtgtgctgccaaaaaaacgatttgttgaaaaatcagg

SEQ ID NO: 23218 - DNA, 735 bp, Zea mays
  misc_feature: Ceres CLONE 1393378-F
  misc_feature: Translation starting site: 157
  misc_feature (303)..(303): n is a, c, t, g, unknown, or other
  misc_feature (314)..(314): n is a, c, t, g, unknown, or other
  misc_feature (348)..(348): n is a, c, t, g, unknown, or other
  misc_feature (349)..(349): n is a, c, t, g, unknown, or other
  misc_feature (376)..(376): n is a, c, t, g, unknown, or other
  misc_feature (429)..(429): n is a, c, t, g, unknown, or other
  misc_feature (433)..(433): n is a, c, t, g, unknown, or other
aagctggagctccccgcggtggcggccgctctagaactagtggatcccccgggctgcaggaattcgcacgagaccattacctagaacatcctaatcgaaaaattttcccgtagcacggcagacgcgctcccttctgatttctgaatccccgacgccatggcctccgcaccgacgccgccgcccctcctcccggtgaccaaccctgcgtccggatcgtccccggccgccgccggaggctccgatgcgccgatcgctacgccggctttccggctcttcctgagccggatctccgactcggcgcgncgctcgctgtncgatcgcccggcgtggggagagctcctcgaccgnntcggcgtctcgaaagcagactctctcntcgacgcacccctccgctgcgtcgcaacctcgcttacttccgcgtcactacgnccgncgtggtcgccttccgcgctgggggctccgctctggggacccctttctcgtctcatcctctggggctcctcgcggctggggtttccttaacttttccgccctccgaaaaagctgtgtgtctctttggccgaaacttttccgacccggaaaccttgtgggggtcttccccgggcccccttaacccgggtttttttcccccgcgggggggttaaattttcccggggtgttcccgggggggccccttcccgggggaagggggttttctggggggggggaaagtcctttttccagaaacacaaaggc

SEQ ID NO: 23219 - DNA, 717 bp, Zea mays
  misc_feature: Ceres CLONE 1393381-F
  misc_feature: Encodes the peptide sequence at SEQ ID NO. 23220
  misc_feature (629)..(629): n is a, c, t, g, unknown, or other
tccccgcggtggcggccgctctatcccagtggatcccccgggctgcaggatttcgcacgagaccattacctagaacatcctaatcgaaaaattctcctcttcgtcttcggttgcaagaaagaaaaaggtcacccctctaacaccacgccgccgccgtttgctgctcggcgcctctcctcacaacccgtacgccaacgtctccaatctcgtatactttcgtgctcagcatcatggacggcttccccaagagcgtcggcggtggcggccctaacattccggcgggatcccaccccgcaggcgggagccaggcggcggcaggaggaggcgcgacgcagcggacgcagtatccgtatgtgactggtaattcagtcattgccttgaaatacaaggatggtgtgatcatggcatgtgacactggagcctcttatggatcaactttgagatacaagagtgtggaacgcattaaggcagttggcaagcataagcatccatggagcaagcggagaagtcagtgacttccccagaagattttgcgctatttggatgaactaactctggctgaaacatatgtgggatgatggaaaactccgtgtgggccccaagagaatcacaggtatttttgacaaganaaggatgtacaccggcgcaacagtttgaccccctccgggactcatctggaacttggtgggggggaaaaagggcacaaaggggatgaga

SEQ ID NO: 23220 - protein, 94 aa, Zea mays
  misc_feature: Ceres CLONE 1393381-F
  misc_feature: SWISSPROT Homolog: EC 3.4.25.1 Proteasome endopeptidase complex
MDGFPKSVGGGGPNIPAGSHPAGGSQAAAGGGATQRTQYPYVTGNSVIALKYKDGVIMACDTGASYGSTLRYKSVERIKAVGKHKHPWSKRRSQ

SEQ ID NO: 23221 - DNA, 714 bp, Zea mays
  misc_feature: Ceres CLONE 1393382-F
  misc_feature: Encodes the peptide sequence at SEQ ID NO. 23222
  misc_feature (426)..(426): n is a, c, t, g, unknown, or other
  misc_feature (562)..(562): n is a, c, t, g, unknown, or other
  misc_feature (568)..(568): n is a, c, t, g, unknown, or other
ggagctccccgcggtggcggccgctctataactagtggatcccccgggctgcaggaattcgcacgagaccattacctagaacatcctaatcgaaaaaacattagcaaggcgatagataagaggaaggaaagaacataggcagccgaagcgactgtcgcgaggcaaggccatcgtccgccatgacgctctccctctccacctctttcctccccatccccgccgccgcgaggaccaccgcccgcaccctacgctccgtcgtcccctcccaggggatgcgctgctcgatgcgcaagaagggggaggacagcggcgaccgctgcccttgcgagaagcagtgcgagggccaccacgaccgggaaagcaggcagcagtgcgtccaggcttgcgagcgccggcgacagcagcgcggcggcagccgtgactccnacgtcgacgaggacgacagcgaccggcggtgccagatgaaatgccggcgccacagcgatcggcaggcgaaggcagtggtgcgtgcagcgctgcgagcgtaagcaacaggaggaggacgccgccgccgacgacgacnacagcnggcggtgccagaagagatgcagcaccacagcgatcggaggccgagcaagtggtgcgtgcagcgctgcgagcgtagcaacagggagacgccgccgccgacgacgacgagaacagcgaccggtgccagaaaagatgcagcagcacagc

SEQ ID NO: 23222 - protein, 84 aa, Zea mays
  misc_feature: Ceres CLONE 1393382-F
  misc_feature (52)..(52): Xaa is any aa, unknown, or other
MRCSMRKKGEDSGDRCPCEKQCEGHHDRESRQQCVQACERRRQQRGGSRDSXVDEDDSDRRCQMKCRRHSDRQAKAVVRAALRA

SEQ ID NO: 23223 - DNA, 731 bp, Zea mays
  misc_feature: Ceres CLONE 1393383-F
  misc_feature: Encodes the peptide sequence at SEQ ID NO. 23224
  misc_feature (540)..(540): n is a, c, t, g, unknown, or other
tccccgcggtggcggccgctctataactagtggatcccccgggctgcaggaattcgcacgagaccattacctagaacatcataatcgaaaactgcgctccgaataccccagacccccgatcctcccaatggccaccgcattttcgctgcgcgctgcggccccggccaccgctccccgcgccgtctcccgatccacctccgcggcgagggtcgtgcccgtggcctcggcactggcgggacgcggaaggctggtggcgcgtgcagcagttacagcaaaggcggatgtaccatcgagcacgtccgacggccatgaggtcttgctgtttgaagctcttcgtgaggccttgatggaagagatggaattagatccaacagtgtgtgtatttggtgaagatgttggccattacggtggttcttacaaggtgacaaaaggtttggctgatacgtttggagaccttcgagttctggacacccctattgcggagaactcgtttactggcatgggaagtggagcggaaatgaaagggctgacgcccgtcgntggaagcatgaacatgggattcctgctccttgctttacacagatctcaataactgtgggatggctcataacccttccgggggcaattcaaatcccacttgggacggggcccccgggggggggggccccccgcttggaaaaaaacctcccaggcctggaaccgtatttcaggccatccgggccgggagtggc

SEQ ID NO: 23224 - protein, 154 aa, Zea mays
  misc_feature: Ceres CLONE 1393383-F
  misc_feature: SWISSPROT Homolog: EC 1.2.4.1 Pyruvate dehydrogenase (acetyl-transferring)
  misc_feature (138)..(138): Xaa is any aa, unknown, or other
MATAFSLRAAAPATAPRAVSRSTSAARVVPVASALAGRGRLVARAAVTAKADVPSSTSDGHEVLLFEALREALMEEMELDPTVCVFGEDVGHYGGSYKVTKGLADTFGDLRVLDTPIAENSFTGMGSGAEMKGLTPVXGSMNMGFLLLALHRSQ

SEQ ID NO: 23225 - DNA, 734 bp, Zea mays
  misc_feature: Ceres CLONE 1393388-F
  misc_feature (370)..(370): n is a, c, t, g, unknown, or other
  misc_feature (485)..(485): n is a, c, t, g, unknown, or other
  misc_feature (502)..(502): n is a, c, t, g, unknown, or other
  misc_feature (507)..(507): n is a, c, t, g, unknown, or other
  misc_feature (525)..(525): n is a, c, t, g, unknown, or other
  misc_feature (534)..(534): n is a, c, t, g, unknown, or other
  misc_feature (535)..(535): n is a, c, t, g, unknown, or other
aaactggagctccccgcggtggcggccgctctagaactagtggatcccccgggctgcaggaattcgcacaagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtgncgccgctcctggtgctcaacctcatcatgtacatcatcgtcatcggcttcgcgagctgaaacctgaaccacttcatcaacgggcagacaactaccccggcgtggccgggaacggncgcgacgttctactccntggtngttcgcatccctggcggncgtggtggnncgcgcgtccaagctagcggcggtgcaccagtggcgcgctggggccagaaagcctggccaccacgccgggtcgtccgtaatcgccggggcatcaggggcctcccttcgggtggcctggaagaaatccaatcggggaaacccggttggcccctgccggggttgagcctttttaatacccgccctaccgaaatccctaaggg

SEQ ID NO: 23226 - DNA, 735 bp, Zea mays
  misc_feature: Ceres CLONE 1393393-F
  misc_feature (655)..(655): n is a, c, t, g, unknown, or other
  misc_feature (684)..(684): n is a, c, t, g, unknown, or other
  misc_feature (694)..(694): n is a, c, t, g, unknown, or other
  misc_feature (695)..(695): n is a, c, t, g, unknown, or other
  misc_feature (702)..(702): n is a, c, t, g, unknown, or other
tccccgcggtggcggccgctctagttctactggatcccccgggctgcaggaattcgcacgagaccattacctagaacatcctaatccaaaaacggtaaaggcacaacgaataagagagatcaactactcatgcaagcactgcggtatttaatttaggttcttaggaacaaaaacacctagcaccgactttgtacatattaatggacgccatgcacatggtgatcgatcggtctatattaaaagacaggcgagtactatagaggatgtgtggtcgccaagctacacacgggatgctactaacgaccctgcaggcaagggcgaggaatggcaagcctttcatgtgctcgggcggacggtgttgtccgttccggcgctctgcccgccaagctgttgctgtgcgccagctgctgcttccctacggcggctccagccgcgtacggagaggtgcaggagcttgcctgccgccagcatctccaccgcttgcctaggcgacaggatctccgcgcccgacgcccgcgccgtcaccatcctctgctcgatcggcctccaccagcacgcggggactcgtcggaccgttgttgctgggcctcgccgccgcaccccctccagggtcccgcggctcctaacccggcccgccccgggagccgccgccggncgccgcgcccgtcggcgagcttcccgccnggatagaagnntgcaacnccacaacccggggccggcggaaaggggagcctc

SEQ ID NO: 23227 - DNA, 666 bp, Zea mays
  misc_feature: Ceres CLONE 1393395-F
  misc_feature: Translation starting site: 218
  misc_feature (312)..(312): n is a, c, t, g, unknown, or other
  misc_feature (315)..(315): n is a, c, t, g, unknown, or other
  misc_feature (318)..(318): n is a, c, t, g, unknown, or other
  misc_feature (321)..(321): n is a, c, t, g, unknown, or other
  misc_feature (357)..(357): n is a, c, t, g, unknown, or other
  misc_feature (408)..(408): n is a, c, t, g, unknown, or other
  misc_feature (500)..(500): n is a, c, t, g, unknown, or other
aagctggagctccccgcggtggcggccgctctataactagtggatcccccgggctgcaggaattcgcacgagaccattacctagaacatcctaatcgaaaatataagcacggcggggtggaaccggacgtccctcgctcccaaatatctctccccacctcccctgagcttctcccgacctttggtcaggcaaaggaggcggccaacaaggacgagcgatggtgaccaaggtcatctgcttcctggtgctcgcatccgtgctcctcgccgtcgcttttcccgtgtctgctctgcggcagcaggtgaagaaggncgncgncgntgaaggcggaggcggaggcagtgttagcggaagcgnaggcggcaacctgaatccctgggagtgctcgcccaaagtgcgggtcgcggntgctccaagacgcagtacaggaaggcctgcctcaccttatgcaacaagtgctggcgccagtgcctctgcgtgccaccgggggttctaccggnaacaaggcggctgcccctggtacaacaatggaaaaccaagaaggagggcccaggggccctaaaaaatcaccgcaagttccggtcgccatttgtccccttccttcgaatttggaaggggttgtcatcttccaccccccctagggttggattttaataccaagaaaag

SEQ ID NO: 23228 - DNA, 703 bp, Zea mays
  misc_feature: Ceres CLONE 1393396-F
  misc_feature: Encodes the peptide sequence at SEQ ID NO. 23229
  misc_feature (489)..(489): n is a, c, t, g, unknown, or other
aagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtggacgcctacgtctcccgctcgggnaaggggcgagtgccgccgccagtgcctgcgccgccacgagggccagccgtgggagaaccaggatggcatgaggcggtgccgcccgcgcggactggccgtcgacatggaagcaagagtacggtcgcggcagcgagagcgcgggcaagtggccgggagaggtgcgagcgccacacccgcggggactggttgggagaggcagcgctgcctgatgact

SEQ ID NO: 23229 - protein, 163 aa, Zea mays
  misc_feature: Ceres CLONE 1393396-F
MGKGSVGASWWAFLLLAGVLLVVAATAGAEDGVVERDRKEDLRWCKQACEWQYGKDTPRKRECESECRERHQQADAGEDGDSGVDAYVSRSGKGRVPPPVPAPPRGPAVGEPGWHEAVPPARTGRRHGSKSTVAAARARASGRERCERHTRGDWLGEAALPDD

SEQ ID NO: 23230 - DNA, 737 bp, Zea mays
  misc_feature: Ceres CLONE 1393399-F
  misc_feature: Encodes the peptide sequence at SEQ ID NO. 23231
  misc_feature (531)..(531): n is a, c, t, g, unknown, or other
  misc_feature (581)..(581): n is a, c, t, g, unknown, or other
  misc_feature (686)..(686): n is a, c, t, g, unknown, or other
aaagctggagctccccgcggtggcggccgctctagaactagtggatcccccgggctgcaggaattcgcacgagaccattacctagaacatcctaatcgaaaaacagctagcatcgatccgccattgctcaccgcacaagtgcacgctcacctcacacacgcagctaagtagctaacgccgtaggcgagaacaagaaaaggctcgacatggccgaggagaagaagcagggcctgcagctgctggacttctgggtgagcccattcgggcagcgctgccgcatcgcgctggacgagaagggcctggcctacgagtacctggagcaggacctgaggaacaagagcgagctgctcctccgcgccaacccggtgcacaagaagatccccgtgctgctgcacgacggccgccccgtctgcgagtccctcgtcatcgtgcagtacctcgacgaggcgttcccggcggcggcgccggcgctgctccccgccgacccctacgcgcgcgcgcaggcccgcttctgggcggactacgtcgacnagaagctctacgactgcggcacccggctgtggaagctcaagggggacggncaggcgcaggcgcgcgccgagatggtcgagatcctcgcacgctggaggcgcgctcgcgagccccttttttttggttgggggacccctccggtttttctccacgtngttttggggcctttcggtcttggtcctccctacgaccggttcgggggggtc

SEQ ID NO: 23231 - protein, 177 aa, Zea mays
  misc_feature: Ceres CLONE 1393399-F
  misc_feature (7)..(80): Pfam Name: GST_N Pfam Description: Glutathione S-transferase, N-terminal domain
  misc_feature: SWISSPROT Homolog: EC 4.4.1.5 Lactoylglutathione lyase
  misc_feature (109)..(109): Xaa is any aa, unknown, or other
MAEEKKQGLQLLDFWVSPFGQRCRIALDEKGLAYEYLEQDLRNKSELLLRANPVHKKIPVLLHDGRPVCESLVIVQYLDEAFPAAAPALLPADPYARAQARFWADYVDXKLYDCGTRLWKLKGDGQAQARAEMVEILARWRRAREPLFFGWGTPPVFLHVVLGPFGLGPPYDRFGGV

SEQ ID NO: 23232 - DNA, 695 bp, Zea mays
  misc_feature: Ceres CLONE 1393401-F
  misc_feature (323)..(323): n is a, c, t, g, unknown, or other
  misc_feature (326)..(326): n is a, c, t, g, unknown, or other
  misc_feature (337)..(337): n is a, c, t, g, unknown, or other
  misc_feature (341)..(341): n is a, c, t, g, unknown, or other
  misc_feature (359)..(359): n is a, c, t, g, unknown, or other
  misc_feature (372)..(372): n is a, c, t, g, unknown, or other
  misc_feature (376)..(376): n is a, c, t, g, unknown, or other
  misc_feature (379)..(379): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (565)..(565): n is a, c, t, g, unknown, or other
  misc_feature (568)..(568): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (600)..(600): n is a, c, t, g, unknown, or other
  misc_feature (601)..(601): n is a, c, t, g, unknown, or other
aaagctggagctccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcaccctgcacctncgntgcatctcccnacgncgggtcacctgcccgcgncgggtcactgccnacgncgntccatgtggccggcccgccgggttttattttggccggccgggcccccagggggcccttaaaacccccaattttttttnnnnnnnnnnnnnnnnnnnnnnnnnnnnnnnnccccccgcccnnnnctttnnnnnnnnnnntcacccnnntnnnnnnnnnnnnnnnnttnnnnnccccccctccccccnccncccccccccccnnnnccnnnnnnnnnnncccnncccaccctccccccccccccccccccgggcgcgcgggggggggaaaggaaaaaaaaaaaagggggggggggggggggggggggggggggggggc

SEQ ID NO: 23233 - DNA, 712 bp, Zea mays
  misc_feature: Ceres CLONE 1393402-F
  misc_feature: Encodes the peptide sequence at SEQ ID NO. 23234
  misc_feature (572)..(572): n is a, c, t, g, unknown, or other
  misc_feature (573)..(573): n is a, c, t, g, unknown, or other
  misc_feature (606)..(606): n is a, c, t, g, unknown, or other
  misc_feature (623)..(623): n is a, c, t, g, unknown, or other
  misc_feature (624)..(624): n is a, c, t, g, unknown, or other
  misc_feature (682)..(682): n is a, c, t, g, unknown, or other
aaagtggagctccccgcggtggcggccgctctagaactagtggatcccccgggctgcaggaattcgcacgagaccattacctagaacatcctaatcgaaaaacagaaatccagtcggcggggctgccgcctgccgcatcctcccctcgcccaccgtcgacgacttgatcccctcccaccgttgaggccgcctcctcacggcagcgagccagcgactcctctcttcttcgtctcctacaagtagccagacaccactccgactttgccggcaacccgtcgacagcgacgaggcgcagcataaggcatacgggcacggcggccatggcgaccagctccaaacccgccgcgcccgtggaccccatggtcgtgctcgcccacgagttccccgaggtgtcattcgactacgacgagagggatgtagcgttgtacgcgctcggggttggtgcctgcggcgatgacgccgtcgacgagaaggagcttcacttcgtgtaccacagggatgggcagccacacattaagacccttcctacttttgtttctttatttcccaaacagaaacagcatgggcttggnnattgtgatgtgcctggccttaactttgatgcangccttctactgcatggnntcacatacatagagatctataggccaatccctccgtatgccagtggtgtaaacagggntaaagtagctggttcgcatgacagggggaa

SEQ ID NO: 23234 - protein, 130 aa, Zea mays
  misc_feature: Ceres CLONE 1393402-F
  misc_feature (85)..(85): Xaa is any aa, unknown, or other
  misc_feature (96)..(96): Xaa is any aa, unknown, or other
  misc_feature (102)..(102): Xaa is any aa, unknown, or other
  misc_feature (121)..(121): Xaa is any aa, unknown, or other
MATSSKPAAPVDPMVVLAHEFPEVSFDYDERDVALYALGVGACGDDAVDEKELHFVYHRDGQPHIKTLPTFVSLFPKQKQHGLGXCDVPGLNFDAXLLLHGXTYIEIYRPIPPYASGVNRXKVAGSHDRG

SEQ ID NO: 23235 - DNA, 712 bp, Zea mays
  misc_feature: Ceres CLONE 1393404-F
  misc_feature: Encodes the peptide sequence at SEQ ID NO. 23236
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
aaagctggagctccccgcggtggcggccgctctagaatagtggatcccccgggctgcaggaattcgcacgagaccattacctagaacatcctaatcgaaaaccggtcctccacactccactgtctctcacactcacacagtctcacaaaggctcgtgggctcgtggcctggcctctataaacccccgcccagccggtcacccccaccccatcgcaaatcctcgctcgggcaagaagagccaactgaaaagtattcatccaagaacaccaccccacccgctccaagcacaagtttcgtcttgaagagagccgccaccaccaatggcttgttacaacactgcatctttagcggcgactctgctggcgttcgcgctgacgtttcagggctgcctcgccgggaggaggctcaccgcgctggtgcaggagcccgccatacccatgaggtaccacaagggcgcgctcctgtcgggcccctcgccgtcaacttcatctggtacggggacttctccgcgccccagcggggcggagataaccgacttcttctcgtcccttacgggggggggcccccgcccgggggaaacccggaacccgcccggggccccgtggttttaaaaaccaaagtcgaaaaaatctctcaacaaaacgtcgaacattctgatgaaagtcatctctacagctccgnnnnnnnnnaaaagggaaattggttcccttgg

SEQ ID NO: 23236 - protein, 96 aa, Zea mays
  misc_feature: Ceres CLONE 1393404-F
MACYNTASLAATLLAFALTFQGCLAGRRLTALVQEPAIPMRYHKGALLSGPSPSTSSGTGTSPRPSGAEITDFFSSLTGGGPRPGETRNPPGAPWF

SEQ ID NO: 23237 - DNA, 716 bp, Zea mays
  misc_feature: Ceres CLONE 1393406-F
  misc_feature: Translation starting site: 204
  misc_feature (365)..(365): n is a, c, t, g, unknown, or other
  misc_feature (411)..(411): n is a, c, t, g, unknown, or other
  misc_feature (457)..(457): n is a, c, t, g, unknown, or other
  misc_feature (468)..(468): n is a, c, t, g, unknown, or other
  misc_feature (514)..(514): n is a, c, t, g, unknown, or other
  misc_feature (515)..(515): n is a, c, t, g, unknown, or other
  misc_feature (552)..(552): n is a, c, t, g, unknown, or other
  misc_feature (634)..(634): n is a, c, t, g, unknown, or other
  misc_feature (670)..(670): n is a, c, t, g, unknown, or other
ggagctccccgcggtggcggccgctctataactagtggatcccccgggctgcaggaattcgcacgagaccattacctagaacatcctaatcgaaaaaaagggaaaggaaacctagacaagcgaggcggcggccccgcgttctccgtctccgtctccgtccgcccggcgtaaagaaaagcctccctcaccacagccgccacgccatggccgaggagaccgacaccaggcctgcctccgcgagctcccgaggccgccccgcgcccgaggacgacgacggggaggagggcgagatcaccgacatcgcctgcgctcctttcccgcccgcacgcacccgctcgagcactcctggaccttctggttcgacnacccgcagagcaagtccaagcagggcgcctgggggagctccatccngccaatacacaccttctccaccgtcgaggaattctgggggcttttnacatacattantcaccctagcaaattgatcgtgggagctgatttccattgcttcaanngacagatcgagccaaaatgggaagaccctatttgtgncgatggtggtaaatggaccatcagctgtgggaagagaaaatctgatacgttttggctgcacactctgctggctatgagtggngaccattcgactatggggatgaaatttggggcgcanttgccagtgtgcgtgggaagcaggaaaaattgctatttggacaaaa

SEQ ID NO: 23238 - DNA, 712 bp, Zea mays
  misc_feature: Ceres CLONE 1393407-F
  misc_feature: Encodes the peptide sequence at SEQ ID NO. 23239
  misc_feature (256)..(256): n is a, c, t, g, unknown, or other
  misc_feature (281)..(281): n is a, c, t, g, unknown, or other
  misc_feature (580)..(580): n is a, c, t, g, unknown, or other
  misc_feature (615)..(615): n is a, c, t, g, unknown, or other
aagctggagctccccgcggtggcggccgctctagaactagtggatcccccgggctgcaggaattcgcacgagaccattacctagaacatcctaatcgaaaaatccaacccatcagtacccaaccttcccctacaccagaaaaatccccagttctttggtccgcgtcagagaggcggcggcgatgtctgggcgcggcaagggcggcaagggtctgggcaagggcggcgcgaagcgccaccggaaggtgctccgcgancacatccagggcatcaccaagccgncgatccggaggctggctaggaggggtggcgtgaagcgcatctcggggctcatctacgaagagacccgcggcgtgctcaagatctttctcgagaacgtcatccgcgacgccgtcacctacaccgagcacgcgcggcgcaagaccgtgaccggcatggacgtcgtctacgcgctcaagcggcagggccgcaccctctacggcttcggaggctaggctaggcgcctcctcctaatcggggactggttaggggacatggctctgggtgatggtttctgagggagaattggtgcaaaagctgtngaaccctccgcttctgcaaggaaaccgcttttaancatgctacacatgtgtgtgcctggggggggattttatttcctgggaagaacaagggattctttcccggaattttgggaaaaaacaagctcttttcgc

SEQ ID NO: 23239 - protein, 103 aa, Zea mays
  misc_feature: Ceres CLONE 1393407-F
  misc_feature (25)..(94): Pfam Name: Histone Pfam Description: Core histone H2A/H2B/H3/H4
  misc_feature (25)..(25): Xaa is any aa, unknown, or other
  misc_feature (34)..(34): Xaa is any aa, unknown, or other
MSGRGKGGKGLGKGGAKRHRKVLRXHIQGITKPXIRRLARRGGVKRISGLIYEETRGVLKIFLENVIRDAVTYTEHARRKTVTGMDVVYALKRQGRTLYGFGG

SEQ ID NO: 23240 - DNA, 719 bp, Zea mays
  misc_feature: Ceres CLONE 1393409-F
  misc_feature: Encodes the peptide sequence at SEQ ID NO. 23241
  misc_feature (649)..(649): n is a, c, t, g, unknown, or other
  misc_feature (654)..(654): n is a, c, t, g, unknown, or other
aaagctggagctccccgcggtggcggccgctctagaactagtggatcccccgggctgcaggaattcgcacgagaccattacctagaacatcctaatcgaaaaacggtgctttgcacggctgagtccctgacgacctcgttcccctccgctgtctcgcctctcccttggttcctcgcggcgacgactgtgcgagcgcctcctcccctccctcactccctccgtgagctcctcgccggcggcgcgcgccgccgcccgtcgccacgtcttctccgctgacgtgggctcaccaggttcaaggcaatatctgtgttaatcttggggaccttcagtagattgctgagagttctccttgatacaggggaataaagatccaaataagtttttgacattgatctgtagcccagtactgcaatggctatgaagcttgtggttctcggtatcccctgggatgttgacactgaagggttacgagagtacatggccaagtttggacccctagacgattgtgtcgtcatgaaagagcgttcttctgggcgatctcgcgggtttggctatgtaacattcgcctcagctgacgatgcaaagaatgttcttgattgcgagcatgttcttggggaggcgtacattagaaggtgaggtagctactccnaaggnaagaatgaaatcaccagggatcaagaaagctacaaggatattcgttgctcgattcccgcaatcgg

SEQ ID NO: 23241 - protein, 74 aa, Zea mays
  misc_feature: Ceres CLONE 1393409-F
  misc_feature (5)..(74): Pfam Name: RRM_1 Pfam Description: RNA recognition motif. (a.k.a. RRM, RBD, or RNP domain)
MAMKLVVLGIPWDVDTEGLREYMAKFGPLDDCVVMKERSSGRSRGFGYVTFASADDAKNVLDCEHVLGEAYIRR

SEQ ID NO: 23242 - DNA, 743 bp, Zea mays
  misc_feature: Ceres CLONE 1393410-F
  misc_feature: Encodes the peptide sequence at SEQ ID NO. 23243
  misc_feature (447)..(447): n is a, c, t, g, unknown, or other
aaagctggagctccccgcggtggcggccgctctagaactagtggatcccccgggctgcaggaattcgcacgagaccattacctagaacatcctaatcgaaaaatcgatccgccaccacgccacaaaatcctctcctactccggcagttctgctcgccgccgcctccacgatgacggaagacgtgcagatgaacgactcggagccccagcctgcggcctcagctcccgccgtcggggcgccggcgctctccacactacaccatctgaaggagatcgcgtccgtgatcgaggacggttctctgtccaaggagtccgccggatctcccgcgccttccgcctcaccgtcgcgctccgtcgccgcctcgacgcgcgggacgtctcccgcttcctcgccttcgcgatacccgcgtcctccgaagtctacggacgcctcactgccctggtgccnaggaagatgatactgagatggatgttgatgctgcagctccagcaactcagatttacatcaaacatggtctccctgagatagaaatatattgctacttgctcgtactgattttccttatcgatcataagaaatatgatgaggctagggcatgcgcaagtgtgagcattgctcgccatgaagaactaaaccggacaactgttgatgttttggcatcacgactgcacttctattactctgaggggtatgagactaccacagccctgctgaaatcgggggaatttgctggctctaaaaga

SEQ ID NO: 23243 - protein, 93 aa, Zea mays
  misc_feature: Ceres CLONE 1393410-F
MDVDAAAPATQIYIKHGLPEIEIYCYLLVLIFLIDHKKYDEARACASVSIARHEELNRTTVDVLASRLHFYYSEGYETTTALLKSGEFAGSKR

SEQ ID NO: 23244 - DNA, 696 bp, Zea mays
  misc_feature: Ceres CLONE 1393412-F
  misc_feature: Encodes the peptide sequence at SEQ ID NO. 23245
  misc_feature (447)..(447): n is a, c, t, g, unknown, or other
  misc_feature (508)..(508): n is a, c, t, g, unknown, or other
  misc_feature (509)..(509): n is a, c, t, g, unknown, or other
  misc_feature (614)..(614): n is a, c, t, g, unknown, or other
  misc_feature (615)..(615): n is a, c, t, g, unknown, or other
  misc_feature (619)..(619): n is a, c, t, g, unknown, or other
agagctggagctccccgcggtggcggccgctctagaactagtggatcccccgggctgcaggaattcgcacgagaccattacctagaacatcctaatcgaaaaattcgtccatcccaccctaccatggccaccgcctccggcactgacgccggtgcccagccgcgcgacgaccccagcctcctccccttcgcgtccttctcgctcggactctccatccgcgcgccggccacccccacattcgcctccgtcccctccaccctccacctccccactcagatctctacagtcgccgtctgcctccacccgtccgccgcgcagtcgtcctcccgtcgcaccacccgcctcaattccgccacctcctccgtcatcgcaccgctgccctcatcaaagcccggactctcccgctcattcccattcggggagaccgccgcagcagggcgccgccgnacgctcgtctggttccgcgacgacctccgcctaccacgacatgagccgtttccacgcgcanntggggcgtcatcctccctcctcccgttttcgtcttcatccgcgggacttcggaagtccccctcggggtcggacgggacgggcccgtaccgcgcaacttcctggtnnatcngtcgccgaccggagcggagcccccccccccgggtgtggacttgttggagggcggggtaagccccaaatggtctttcc

SEQ ID NO: 23245 - protein, 184 aa, Zea mays
  misc_feature: Ceres CLONE 1393412-F
  misc_feature (129)..(129): Xaa is any aa, unknown, or other
  misc_feature (164)..(164): Xaa is any aa, unknown, or other
  misc_feature (166)..(166): Xaa is any aa, unknown, or other
MATASGTDAGAQPRDDPSLLPFASFSLGLSIRAPATPTFASVPSTLHLPTQISTVAVCLHPSAAQSSSRRTTRLNSATSSVIAPLPSSKPGLSRSFPFGETAAAGRRRTLVWFRDDLRLPRHEPFPRAXGASSSLLPFSSSSAGLRKSPSGSDGTGPYRATSWXIXRRPERSPPPRVWTCWRAG

SEQ ID NO: 23246 - DNA, 736 bp, Zea mays
  misc_feature: Ceres CLONE 1393413-F
  misc_feature: Encodes the peptide sequence at SEQ ID NO. 23247
  misc_feature (410)..(410): n is a, c, t, g, unknown, or other
  misc_feature (411)..(411): n is a, c, t, g, unknown, or other
  misc_feature (421)..(421): n is a, c, t, g, unknown, or other
  misc_feature (451)..(451): n is a, c, t, g, unknown, or other
  misc_feature (548)..(548): n is a, c, t, g, unknown, or other
  misc_feature (639)..(639): n is a, c, t, g, unknown, or other
  misc_feature (640)..(640): n is a, c, t, g, unknown, or other
  misc_feature (670)..(670): n is a, c, t, g, unknown, or other
aaagctggagctcaccgcggtggcggccgctctagaactagtggatcccccgggctgcaggaattcgcacgagaccattacctagaacatcctaatcgaaaaactgcagtctccagagtctagagacctccaccgtccactccaaagacgagcagcgggcaaacccaagcacccgcccaatccggttcgccttccttctcaccccgcccggactctgcggagagatctggcagcggtggctatgccattgggcgacgacgcggcggcggacttcgcgctgccggacgagctcctggcggcgctgccgcgggacccctacgagcagctggatctggcgcgccgcatcaccgcgctggcggtgggcgggcgggtgtccgggctggagcggaaggcggggcgcctgcgcgcgnnaggccgcggngaaggaccgcgagagcgccgagctccgggnagcgggtggcgctgctcgacgccgcgcttcaggagaccaacgccaggctcccgcgcgcgctcgaggacaatattaagctcagcaaggagcgggactncgctggcgcagacgtccaagaagctggcacgcgacctgcacaagctggagtcattcaagaggcatctgatgcagtcattgcgtgatgatanngtcatcacacagggaacagttgacattacngacgtgtgatcagccagtagcatcaaaagatcatccagtggagatggggggatctgtcagcaacct

SEQ ID NO: 23247 - protein, 145 aa, Zea mays
  misc_feature: Ceres CLONE 1393413-F
  misc_feature (57)..(57): Xaa is any aa, unknown, or other
  misc_feature (103)..(103): Xaa is any aa, unknown, or other
  misc_feature (133)..(133): Xaa is any aa, unknown, or other
MPLGDDAAADFALPDELLAALPRDPYEQLDLARRITALAVGGRVSGLERKAGRLRAXGRGEGPRERRAPGSGWRCSTPRFRRPTPGSRARSRTILSSARSGTXLAQTSKKLARDLHKLESFKRHLMQSLRDDXVITQGTVDITDV

SEQ ID NO: 23248 - DNA, 734 bp, Zea mays
  misc_feature: Ceres CLONE 1393414-F
  misc_feature: Encodes the peptide sequence at SEQ ID NO. 23249
  misc_feature (378)..(378): n is a, c, t, g, unknown, or other
  misc_feature (407)..(407): n is a, c, t, g, unknown, or other
  misc_feature (426)..(426): n is a, c, t, g, unknown, or other
  misc_feature (430)..(430): n is a, c, t, g, unknown, or other
  misc_feature (437)..(437): n is a, c, t, g, unknown, or other
  misc_feature (438)..(438): n is a, c, t, g, unknown, or other
  misc_feature (442)..(442): n is a, c, t, g, unknown, or other
  misc_feature (455)..(455): n is a, c, t, g, unknown, or other
  misc_feature (457)..(457): n is a, c, t, g, unknown, or other
  misc_feature (458)..(458): n is a, c, t, g, unknown, or other
  misc_feature (518)..(518): n is a, c, t, g, unknown, or other
aagctggagctccccgcggtggcggccgctctagaactagtggatcccccgggctgcaggaattcgcacgagaccattacctagaacatcctaatcgaaaactccttcccctccctctttccacgacaccaaaagaaaccgaaaaccatcgacgcgctccgtccaccctcccctaccccgcgtcctcctcccctacgcctcccagcccagcggcaaaacctaaccctagatgggcgccgtcacctctacggtcgcggcgcgctttgcctttttcccgccgagcccgccgtcgtacgggttcgagcagccggcgccgcttccggcccctgccacacccgagcctccggccccggccacatccaagccgccgcctccggncccggcacacccaaagcgccgtctccggnccggtcacacccaaagcgnctgncagcggnnaagnaaaaggcgggtgncnncgttggtggacctcacgggcgccccgcggaggtttaaacgtggaggcccggcggctgccnaactaccggggccacggaaggtgggccgggatggacgtgggccagggggggggccaaggtaagggtgcttcaactcccagggaaagccccccaaacccgggcaaaaggaagaagtcttttgggggaggtcaggggcccccctaagggaaacccgaggggggaaagaaatatttcggggtgggggaaccccagcgggggagccctatgggaaaaaaa

SEQ ID NO: 23249 - protein, 116 aa, Zea mays
  misc_feature: Ceres CLONE 1393414-F
  misc_feature (50)..(50): Xaa is any aa, unknown, or other
  misc_feature (60)..(60): Xaa is any aa, unknown, or other
  misc_feature (66)..(66): Xaa is any aa, unknown, or other
  misc_feature (67)..(67): Xaa is any aa, unknown, or other
  misc_feature (70)..(70): Xaa is any aa, unknown, or other
  misc_feature (71)..(71): Xaa is any aa, unknown, or other
  misc_feature (76)..(76): Xaa is any aa, unknown, or other
  misc_feature (77)..(77): Xaa is any aa, unknown, or other
  misc_feature (97)..(97): Xaa is any aa, unknown, or other
MGAVTSTVAARFAFFPPSPPSYGFEQPAPLPAPATPEPPAPATSKPPPPXPAHPKRRLRXGHTQSXXQRXXKRRVXXLVDLTGAPRRFKRGGPAAAXLPGPRKVGRDGRGPGGGPR

SEQ ID NO: 23250 - DNA, 721 bp, Zea mays
  misc_feature: Ceres CLONE 1393415-F
  misc_feature: Encodes the peptide sequence at SEQ ID NO. 23251
aaagtggagctccccgcggtggcggccgctctagaactagtggatcccccgggctgcaggaattcgcacgagaccattacctagaacatcctaatcgaaaaacccgtccatccgtattcccgtcacgcccccaacacccccacaacccgaagcagcgaaagctcccctaaccctctccgcgcatccgatcgcaagggaagaagagggagatgagctactacgggcagcagccccccgtcggcgtcccgccgcagcaaggctacccgggcaaggacggctacccgccagcggggtacccgccggccggctaccccccgccgggggagggctaccctccgcagggctacccgccgcagtacgcgcaggcgccccctccacaggaggaggagagcaggggggctttccttcatgggagggatgcttggctgccctctggctgctgctgcctcctggaagcctggttctgagaaggagaggggccgaaccgacggattcaacccggggagcagggaaactactagcttttctatgggaaggaaaaaaaaaaaagaacttggaattggaatgagcccggaaatggtatcggggtatttctaggtttggaagaagaatattatggcgccccagggttttatttcctccctgggaaggggggacgggaacagaagggggggggggggattcctgccctggggaaatgtcccggggttcttggggaaaa

SEQ ID NO: 23251 - protein, 85 aa, Zea mays
  misc_feature: Ceres CLONE 1393415-F
MSYYGQQPPVGVPPQQGYPGKDGYPPAGYPPAGYPPPGEGYPPQGYPPQYAQAPPPQEEESRGAFLHGRDAWLPSGCCCLLEAWF

SEQ ID NO: 23252 - DNA, 765 bp, Zea mays
  misc_feature: Ceres CLONE 1393416-F
  misc_feature (313)..(313): n is a, c, t, g, unknown, or other
  misc_feature (359)..(359): n is a, c, t, g, unknown, or other
  misc_feature (365)..(365): n is a, c, t, g, unknown, or other
  misc_feature (368)..(368): n is a, c, t, g, unknown, or other
aaagctggagctccccgcggtggcggccgctctagaactagtggatcccccgggctgcaggaattcgcacgagaccattacctagaacatcctaatcgaaaaagtttcgacagtcgtcgtcccctctactctcccggcttccgcagaatcccagcttctctggccctctcactccaaacatcgggctccaggccgtctcccgccaacccaaattcgcttcccgccgctccccattaaacccgcttgaaaggtcgcgccctcgagcagagcaacccctgaccacaaatccgatccgtagccgccgtgcctcganttcgtctcttcccctctgctcgagtacgagcggctactcccggcgncggcgncgncggcggcgatgagcgcggtgagctcgaccatatcagggagctgatcaggtgggaacagactacatcctcaaaaccttcaatcatctgctgacccgataaacgggattgtccctcaggggggtggaggtgacccctctaaagggagaagcagcctaaggaccattacgggtgggtggaacccaggggattcgactacaaaagggccggccccggggggggcacctctggcaaaaaataagggctgaaaaaggggtgggccccccggggtggagttttcaaagggggtaagggaaaaaaaaaaccatctccccaaaaatttcttcaaaggggccaaaaccccgtttaaaaatttgagaaagggggggggggggggaaaaacaccccccctggggttttc

SEQ ID NO: 23253 - DNA, 719 bp, Zea mays
  misc_feature: Ceres CLONE 1393417-F
  misc_feature: Encodes the peptide sequence at SEQ ID NO. 23254
  misc_feature (719)..(719): n is a, c, t, g, unknown, or other
agagctggagctccccgcggtggcggccgctctagaactagtggatcccccgggctgcaggaattcgcacgagaccattacctagaacatcctaatcgaaaacacataaataacacacaaagttgtccgatcaaagcttgcgcgtttacaatggtctgaacgatcaaggcacttcacaatgtccacccttctcgctacgagcttcttctttgtactcctatgcagctcgctacaagtacgtggcgtgaactacacgttcgtggaggacgcggcgctggccccccagcgtggcgtactaccactacatcatcggggccggcggcaacggccgggtggccgctggccgccacgctgtcgaagcccttccgcgggctgctgctggagggggggccctccccctaagacgacgaccggtttgggaaaatggccccgcttcgcgaaaccgttgccggacacctccccggctcccccgggaagggcttcgtggcggaagacggcgtcctcaactcccgccccgcggttggtggcgggggaaacttcatcacccccggtttctaaccgggggccagcaaccactacgtggggggcggtcggtgggaccctggccccccccccgggaggtataaccggggggtgggaaaaacagggggagccctcccacccgcagctggggacccctgggaaagcccccgccttgaaaggcggcccctcgtctcagn

SEQ ID NO: 23254 - protein, 44 aa, Zea mays
  misc_feature: Ceres CLONE 1393417-F
MAPLRETVAGHLPGSPGKGFVAEDGVLNSRPAVGGGGNFITPGF

SEQ ID NO: 23255 - DNA, 710 bp, Zea mays
  misc_feature: Ceres CLONE 1393420-F
  misc_feature (710)..(710): n is a, c, t, g, unknown, or other
aagctggagctccccgcggtggcggccgctctagaactagtggatcccccgggctgcaggaattcgcacgagaccattacctagaacatcctaatcaaaagaagaaaaacacaccccggatggtcgggcacgtaagccccgtctcgtcctccagatatcggccgccaccttcacctccaccgccccggcgcacgtgcgcgtctccatcgtcgccgcctctcctccttcggacacgactgaccttccactggcgccgacgaagaagacacataggaagaagctcaccgccaaacctcatccagatccagtcgctaccctccgaaagccgcatacggaacgtctcgtctcttcctttggatccggcagccggtgctcctcctccggatccggtggtcaactccatcacccgcagctcccactcccttagtccccctccatccgccctcacccaccgcttctatatcgccacctctctcgttgtaaaagacactgaggatctgggaaagtgaagccgttccgccgtgaaacagcgccaccccttgccatccgcccgaccgttgggaagcagggcccacgtctccaggcttcctacaggaagagcctgccccccttcccaaggacaaaaatattaaggaggaatgaaagccccccaagctgtttgaaaatctgaagaaaagaaaggaagccaaagttgttttcaaagctttgan

SEQ ID NO: 23256 - DNA, 709 bp, Zea mays
  misc_feature: Ceres CLONE 1393422-F
  misc_feature: Encodes the peptide sequence at SEQ ID NO. 23257
  misc_feature (546)..(546): n is a, c, t, g, unknown, or other
  misc_feature (555)..(555): n is a, c, t, g, unknown, or other
  misc_feature (660)..(660): n is a, c, t, g, unknown, or other
  misc_feature (661)..(661): n is a, c, t, g, unknown, or other
  misc_feature (699)..(699): n is a, c, t, g, unknown, or other
aaagctggagctccccgcggtggcggccgctctagaactagtggatcccccgggctgcaggaattcgcacgagaccattacctagaacatcctaatcgaaaaactgatggatcactcctgcagctgcagctgcagtgcgtcgccgctactccatcgtctattaattcctcgtgtagctccagcgctcggcttagacaagcctctccaacatgaagctcctgggttggatgcaccggaagttacgacagaacagtaatgatgtgttcaaagagttcaacaacgctggaggtgggacgtgcaactgcatcaccgggctggccgcgtcggacccggccactttcctcgccaccgccaacgaatacttcgccgccgacaacgacttcaccaacaatcatccatcgtcgccggccgccgacctcttcacctttggtggcagcggcctcctcaccattggcacgctaggcatcgccgccgtcgcggtgtctgcagatgctgatgaaagtgattacgacgtcgacggcgatgctgactccgactttgacgacnacgacgacnccggccggtgatgacgaagacccagtcgacagcgccgtcacgccccacgtcacatatgcagcgccgcctccgggagaagacgccacggtcgtcgagaagctgcannttgccggggtttgaagccctggcccaagaaggacgacnacccacccat

SEQ ID NO: 23257 - protein, 118 aa, Zea mays
  misc_feature: Ceres CLONE 1393422-F
  misc_feature (113)..(113): Xaa is any aa, unknown, or other
  misc_feature (116)..(116): Xaa is any aa, unknown, or other
MKLLGWMHRKLRQNSNDVFKEFNNAGGGTCNCITGLAASDPATFLATANEYFAADNDFTNNHPSSPAADLFTFGGSGLLTIGTLGIAAVAVSADADESDYDVDGDADSDFDDXDDXGR

SEQ ID NO: 23258 - DNA, 741 bp, Zea mays
  misc_feature: Ceres CLONE 1393423-F
  misc_feature: Encodes the peptide sequence at SEQ ID NO. 23259
  misc_feature (318)..(318): n is a, c, t, g, unknown, or other
  misc_feature (355)..(355): n is a, c, t, g, unknown, or other
  misc_feature (358)..(358): n is a, c, t, g, unknown, or other
  misc_feature (361)..(361): n is a, c, t, g, unknown, or other
  misc_feature (364)..(364): n is a, c, t, g, unknown, or other
  misc_feature (367)..(367): n is a, c, t, g, unknown, or other
  misc_feature (390)..(390): n is a, c, t, g, unknown, or other
aaagctggagctccccgcggtggcggccgctctagaactagtggatcccccgggctgcaggaattcgcacgagaccattacctagaacatcctaatcgaaaaaagatgaatgctacgtaggtagacagtgttcttgtggtgacgtgacctccacagagtgcagagatgggagaagctgaagaagcgccaggagacagcaatggtgaggcactggagctcctcatggtcatggcgtcctcttcgctgggctgctctgtctcgcagttcccagccaagtggcagtcccatcagggacagctccagctgctctgctgcagnctcaattcactctggcggcggcgcggtgaccacgacnacnacnacnacnaggagcttcgtgtggtggctgancttctgcggctggcttcagcaaccggggaggacatccagggtctttgcttctagtggaacgacggttcatacagggggggaaggcttcctctgagggggaacctggacaactggaattgaagcttgatgcgcaaatgaaccatttaagggaattggcctttcctccggggcgccccccccgtccaaggcctttgttcccctcagcccacgcccaagccaagggggggataaaaacccttttacccggggtttttttttcgagaaaggggtgggggcccccccaaaaggggcgggcgtgggcccccaagggggggtgggggggagaaaattcttcttgggggggtgttcccc

SEQ ID NO: 23259 - protein, 92 aa, Zea mays
  misc_feature: Ceres CLONE 1393423-F
  misc_feature (51)..(51): Xaa is any aa, unknown, or other
  misc_feature (64)..(64): Xaa is any aa, unknown, or other
  misc_feature (65)..(65): Xaa is any aa, unknown, or other
  misc_feature (66)..(66): Xaa is any aa, unknown, or other
  misc_feature (67)..(67): Xaa is any aa, unknown, or other
  misc_feature (68)..(68): Xaa is any aa, unknown, or other
  misc_feature (75)..(75): Xaa is any aa, unknown, or other
MGEAEEAPGDSNGEALELLMVMASSSLGCSVSQFPAKWQSHQGQLQLLCCXLNSLWRRRGDHDXXXXXELRVVAXLLRLASATGEDIQGLCF

SEQ ID NO: 23260 - DNA, 708 bp, Zea mays
  misc_feature: Ceres CLONE 1393425-F
  misc_feature: Encodes the peptide sequence at SEQ ID NO. 23261
  misc_feature (319)..(319): n is a, c, t, g, unknown, or other
  misc_feature (320)..(320): n is a, c, t, g, unknown, or other
  misc_feature (362)..(362): n is a, c, t, g, unknown, or other
  misc_feature (574)..(574): n is a, c, t, g, unknown, or other
  misc_feature (575)..(575): n is a, c, t, g, unknown, or other
  misc_feature (578)..(578): n is a, c, t, g, unknown, or other
  misc_feature (593)..(593): n is a, c, t, g, unknown, or other
  misc_feature (594)..(594): n is a, c, t, g, unknown, or other
  misc_feature (665)..(665): n is a, c, t, g, unknown, or other
  misc_feature (667)..(667): n is a, c, t, g, unknown, or other
aaagctggagctccccgcggtggcggccgctctagaatagtggatcccccgggctgcaggaattcgcacgagaccattacctagaacatcctaatcgaaaaacggtccaccgacgactcttcttcctcacctcctcccgctccagctccagctcgtctctctcctcgcctcgcgtagggtttcgcttcccgtctcgccgccgtcagcatgggggacaactacgatgacgaaggcgagccgatcgtgaacctcgacgaacgggaaccctcccctgagcatcagccgtacgaaagacctcgatgacgacctcgacggcggnnggcgataggacccgcgaccggtctccgacccccgtccacggngacgacggcggggcagggtcctccctccggcccccaaaagggccttctcaagaggggcggcggtggaggcatggcccggcgatgaagggctggaataacttttgggtttgaaaggaaaaagaaccccgaaccctttccgtttggaggggggggaaaaaaaaaaaggggtccccccccccccttggaagggcccccccccccagggggggggnnggncgcggccccccccgnnaaaaaaaaaaaaaacctcaaaaaaaaaaaaaaagggggggggggggggcggcccacccccgccccgcgagncncgggggggggggggggaagacacaccactccgggggtttga

SEQ ID NO: 23261 - protein, 31 aa, Zea mays
  misc_feature: Ceres CLONE 1393425-F
MGDNYDDEGEPIVNLDEREPSPEHQPYERPR

SEQ ID NO: 23262 - DNA, 689 bp, Zea mays
  misc_feature: Ceres CLONE 1393427-F
  misc_feature: Encodes the peptide sequence at SEQ ID NO. 23263
caaagctggagctccccgcggtggcggccgctctagaactagtggatcccccgggctgcaggaattcgcacgagaccattacctagaacatcctaatcaaaaagacccaaaatcgatgggcaaaagcggaaagaaaccgagggaatcgcaccggcagggccgcggccggcgggcgtcgcagttctgcgacgaggacggctacgacttaccttcgtcagcctacgatgcgacgccgcgccaaaacgaggaatcctctgaagacaacgacgacaccagcgaagcaacagcggaggacgaaccagagagggatacggaagcaggcgagcaggaccaatggcaaggatcaatgccttccaagtttcacctataccagctctccgtgcagtcgccgaagggggacatcagctacttgcagaagttcttcctgatgtatgtcggcgggcgcgcccctctccacctgcaggaggatttctgtggcacggccctcctcagcaccgagtggatccgtactgatgcaagaaggacagcaattggcttagacttggatcttgagtcacttgagtggtgccttgaaacaacctaagcagattggagctgatgggtattcaggaatgttgctttcccatgggaatggtctacaccaatgaaatcccgtcttgtcagcaaaagttactaatcttgggcatggc

SEQ ID NO: 23263 - protein, 155 aa, Zea mays
  misc_feature: Ceres CLONE 1393427-F
MGKSGKKPRESHRQGRGRRASQFCDEDGYDLPSSAYDATPRQNEESSEDNDDTSEATAEDEPERDTEAGEQDQWQGSMPSKFHLYQLSVQSPKGDISYLQKFFLMYVGGRAPLHLQEDFCGTALLSTEWIRTDARRTAIGLDLDLESLEWCLETT

SEQ ID NO: 23264 - DNA, 722 bp, Zea mays
  misc_feature: Ceres CLONE 1393430-F
  misc_feature (395)..(395): n is a, c, t, g, unknown, or other
  misc_feature (425)..(425): n is a, c, t, g, unknown, or other
aagctggagctccccgcggtggcggccgctctagaactagtggatcccccgggctgcaggaattcgcacgagaccattacctagaacatcctaatcgaaaaacacacggaagaagccactagctctccgctctcgcctctcggccttctccttgtgccgccgaacaccctcacaagagtcggcctctcgatttctcagtccagccgcagcagcccccttccctccctcctccatcaggtgttgcctcccgcagatccaagtcggaattcggtccttcgtccccaaaccaccaatccggttgcattctttgggtttgctcacagcgcacacaaagccattttactgctgggaatggtggctggcacttagcgtctccggctcttgagtgatctccnagtcctttggaatgctacagggaagtgaangtgatgggggagtgcgaggaacgcaggagtacaggtgctgggaggagctgctgccggacggctgggcctcatcttccgaactggcggtggaagaggtggtcacggcctggcgggggtgggccagtcctggggggggggggggggccggcccctactgtgggagggaatcaaatccggggggggggcccgcacaaaaacaagccggaaaaaatccccccaaggggcaaataaaccgggggcccaaaaccccgttctggggcgccaaaaagggtttccgggccgggcccggggaacggg

SEQ ID NO: 23265 - DNA, 747 bp, Zea mays
  misc_feature: Ceres CLONE 1393431-F
  misc_feature: Encodes the peptide sequence at SEQ ID NO. 23266
  misc_feature (1)..(1): n is a, c, t, g, unknown, or other
  misc_feature (248)..(248): n is a, c, t, g, unknown, or other
  misc_feature (412)..(412): n is a, c, t, g, unknown, or other
  misc_feature (413)..(413): n is a, c, t, g, unknown, or other
  misc_feature (418)..(418): n is a, c, t, g, unknown, or other
  misc_feature (463)..(463): n is a, c, t, g, unknown, or other
  misc_feature (469)..(469): n is a, c, t, g, unknown, or other
  misc_feature (502)..(502): n is a, c, t, g, unknown, or other
  misc_feature (503)..(503): n is a, c, t, g, unknown, or other
  misc_feature (537)..(537): n is a, c, t, g, unknown, or other
  misc_feature (538)..(538): n is a, c, t, g, unknown, or other
nagagctggagctccccgcggtggcggccgctctagaactagtggatcccccgggctgcaggaattcgcacgagaccattacctagaacatcctaatcgaaaaacattattcaggtccaggtcacatgatgcacagacagcccgtccgacgccgcgttagctacttgcctacttcagctatatgaaacggcaaaagtcttcccctcgttccccaatctcctctccatcgaaaccctagcacgacgcanttcccgtcttcccacgccgtgtcgccgttgctatgggcaagaagcggaagctcgagcccaaatcggcggcagggttcacgccggttaaggcctccccgaccaccaggtctgccacccgctagggcgctggtctatccgaggtcctcgcccccgtcgaggctacnnatganaagctgccgcagggggcaggcggcgaggatgtaaagaaatcgagnaggtgnaggtccagaggaaatggaagtgaaaaggaaaannaggggagagcgaccagctttcgatcaggggctgnntggattcgtccccaaggacagctcggcaagttgttaccggaccctccatcgttcagggggacgggttaacccccttccgggggggggcccaccccacccgttcaagggaaatttttccaaacgggcccggtgtgaaacccaaccaaccccccccgggaggctttgcccataagggggaaaaggggtttccgggggccccccacccaaaa

SEQ ID NO: 23266 - protein, 29 aa, Zea mays
  misc_feature: Ceres CLONE 1393431-F
MGKKRKLEPKSAAGFTPVKASPTTRSATR

SEQ ID NO: 23267 - DNA, 732 bp, Zea mays
  misc_feature: Ceres CLONE 1393432-F
  misc_feature (597)..(597): n is a, c, t, g, unknown, or other
  misc_feature (632)..(632): n is a, c, t, g, unknown, or other
aaagctggagctccccgcggtggcggccgctctagaactagtggatcccccgggctgcaggaattcgcacgagaccattacctagaacatcctaatcaaaaaacgtctcgtcagtttttttccctttttcccgtggcccgtgggtgtgcgtcctaggtgtgcggcgggcggtgcgccgtgcgcctcctctcctcgccgcgacgctgccgtgttcgcgattcagcgccgtgctcgacgcccctcctcccttcagaagtcagcgccgcatctccggttgcagagacttgcgctgccacctctccgcttttcgtccttcagttgctcgacgcccctcctcccctcagaagtcagcgcagcgtctccactctccacgccgtcgcgtcggcgacgcgggtccttcgaataagacggtttgttctcgcatcgggcgtcagccggattcgagggacatagatgatggaagtcgatcttgggtgccaccacgtcgaagcggcttgtgctgtgtagatccggcgaaagcgcgcaggcaaagcccggggtctgcgtcgtcattggcctcatgatcttcgtattgccatcgcgctaaagggaacgaangcgacgaggtcttaaactttgattgatatatgcgnatatgaaaatgcatgcaactacatgctagaagtctgtctttgggttgtgtggagaaaattctttggtacgtttttgttgatagtgttgagtgccaaaatg

SEQ ID NO: 23268 - DNA, 689 bp, Zea mays
  misc_feature: Ceres CLONE 1393433-F
  misc_feature: Encodes the peptide sequence at SEQ ID NO. 23269
  misc_feature (309)..(309): n is a, c, t, g, unknown, or other
aaagctggagctccccgcggtggcggccgctctagaactagtggatcccccgggctgcaggaattcgcacgagaccattacctagaacatcctaatcgaaaaatgaccgactagcccatggtctctctccgctccgacgcgcccgacccaccaccacatccctcatggctgccctcgccgacatcgactcctcggcacttccgccgtccgagtcatccaaaggcaagggcaagatggacaaggaggaggaggacgaggcgaagggcgcggagaagatgtgcggcatctgctatctcgacggccggcggnccatccgcggcgagctcgactgctgcgcccatttcttttgctttgtctgcatcatggcttggggccgcgtcgagtcccgctgtcccttctgcagggcccgcttccacacatccgccgcccgcccgttcgcgggcggttccccgacgagcgaatcgtctcgatccaagagcgcaaccaggtacaccatcctcagggcaacgggagcagcatagtgggcgaagatccttacgtgaacacataatgcaccgtttgcagcagctccagcgatgactagctgctgctactctgcgaggtctgcgactcagctgcacacatttactggtgtcgggctggggaccaccgtgccagagggggggactgttttctgcaaagacatgcgt

SEQ ID NO: 23269 - protein, 118 aa, Zea mays
  misc_feature: Ceres CLONE 1393433-F
  misc_feature (49)..(49): Xaa is any aa, unknown, or other
MAALADIDSSALPPSESSKGKGKMDKEEEDEAKGAEKMCGICYLDGRRXIRGELDCCAHFFCFVCIMAWGRVESRCPFCRARFHTSAARPFAGGSPTSESSRSKSATRYTILRATGAA

SEQ ID NO: 23270 - DNA, 714 bp, Zea mays
  misc_feature: Ceres CLONE 1393434-F
  misc_feature: Encodes the peptide sequence at SEQ ID NO. 23271
  misc_feature (1)..(1): n is a, c, t, g, unknown, or other
  misc_feature (543)..(543): n is a, c, t, g, unknown, or other
naaagctggagctccccgcggtggcggccgcctctagactagggcgtcccccgcgtgtggcaccctgcaagaggtaccattacctagaacatactaatcgatgaactagcacggacgttcagaaggactccgtcaacccgccaccagatccacacgacgccgcgactgaccatggacatgcccgtcactccttccacgagtccaccgccgccaccccgaataatagcatcccaacacagctttgcaccaaggaccggatcgatctattctcgtctgaagcaattcgcccctgacgagagcagaatcctacagctcgtattcgcctcatctcgcagcatcagcagaacaacagggatatggcgaatgatgcccgtcccgactgaaacgtcctgctcaagtgtagcctcgaccacggcgacaggaccaactcgccgcgtgctctcagcgaggaatacagaacatggatcatgaatgctatgcaagccaacactgcagatgttgcgatgaggatgaaggagatcgctcctgtgatgatgacaccanaagatgtcttgcagactcatgacgtgaccctggagatcattgaccatatggtagatgatctacacgagcatgttgcatgcattgacttgaaaaatgatctacttgctatcgccggcatggatcctctaactattactaggaaactcagatgctggcatcgagcagggaaaa

SEQ ID NO: 23271 - protein, 82 aa, Zea mays
  misc_feature: Ceres CLONE 1393434-F
  misc_feature (26)..(26): Xaa is any aa, unknown, or other
MNAMQANTADVAMRMKEIAPVMMTPXDVLQTHDVTLEIIDHMVDDLHEHVACIDLKNDLLAIAGMDPLTITRKLRCWHRAGK

SEQ ID NO: 23272 - DNA, 738 bp, Zea mays
  misc_feature: Ceres CLONE 1393435-F
  misc_feature: Encodes the peptide sequence at SEQ ID NO. 23273
  misc_feature (551)..(551): n is a, c, t, g, unknown, or other
  misc_feature (561)..(561): n is a, c, t, g, unknown, or other
aagctggagctccccgcggtggcggccgctctagaatagtggatcccccgggctgcaggaattcgcacgagaccattacctagaacatcctaatcgaaaaaccacaaagcggtgaaggagaaccaaggtaatcgaacccggaagcgaccttcttgagcccgaagcaaaaggcactgctcatcgatccgccactacgccacaaaatcctctcctactccggcagttctgctcgccgccgcctccacgatgacggaagacgtgcagatgaacgactcggagccccagcctgcggcctcagctcccgccgtcggggcgccggcgctctccacactacaccatctgaaggagatcgcgtccgtgatcgaggcccggtctctgtccaaggagggtcgccggatctccccgcgcttccccgctcacgtcgggctccgtcgccggctcggcgggggggacggctccgccttccctcgcttcgcgctacccgcgtcctccgaagctacgaacgcctcactggcctggtgccaaaggaagagatactggaaatggatgtngatgctgcanttccgcaaattaaatttcaatcaacatggccttccctgaaattggaaataattgcaacttgcccgaacggattttccttatggaccaaaaaaaatggtgggggctagggttgctcaaggggaactttgccccccgaaaaatcaacccggaaaaatgggggaggttttgaaccccaac

SEQ ID NO: 23273 - protein, 117 aa, Zea mays
  misc_feature: Ceres CLONE 1393435-F
  misc_feature (102)..(102): Xaa is any aa, unknown, or other
  misc_feature (105)..(105): Xaa is any aa, unknown, or other
MTEDVQMNDSEPQPAASAPAVGAPALSTLHHLKEIASVIEARSLSKEGRRISPRFPAHVGLRRRLGGGDGSAFPRFALPASSEATNASLAWCQRKRYWKWMXMLXFRKLNFNQHGLP

SEQ ID NO: 23274 - DNA, 732 bp, Zea mays
  misc_feature: Ceres CLONE 1393438-F
  misc_feature: Encodes the peptide sequence at SEQ ID NO. 23275
aaagctggagctccccgcggtggcggccgctctagaactagtggatcccccgggctgcaggaattcgcacgagaccattacctagaacatccgaatcgaaaaatcgcagaaattctccgcaacttcacagcgtatcatcgttttccatcgctcctactcctatcatccagaaaatctgagcggtattgatggcgcccaaggcggagaagaagccggcggcgaagaaggtggcggaggaggagccctcggagaaggcggctccggcggagaaggcccccgcggggaagaaggccaaggcggagaagcggctacctgcgggcaagtccgccggcaaggagggcggcgacaagaaggggaggaagaaggcgaagaagagcgtggagacctacaagatctacatcttcaaggtctccgttctcccccaattcgccttcacctcgccgcttcctccttgaccgccacgcgttgacgtcgtctttccggcgaggtagctcgccggaagacctcacctggacttttccgacgcaccctccacacactctttaaccctccggaatggccgcctgcttctagctcgtcgacgccccaatctccgcttgcttcctcgacagccccatccgcctcttctcgctctcgctacggctcctctggctgttccgccatggcgatccgcatcaccgtctcctactccggctaacgtggcgcagaacctcgccgcgtcgctcggccacg

SEQ ID NO: 23275 - protein, 88 aa, Zea mays; identical to SEQ ID NO: 7324
  misc_feature: Ceres CLONE 1393438-F

SEQ ID NO: 23276 - DNA, 714 bp, Zea mays
  misc_feature: Ceres CLONE 1393439-F
  misc_feature: Translation starting site: 165
  misc_feature: SWISSPROT Homolog: EC 1.6.99.5 NADH dehydrogenase (quinone)
  misc_feature (622)..(622): n is a, c, t, g, unknown, or other
aaagctggagctccccgcggtggcggccgctctagaatagtggatcccccgggctgcaggaattcgcacgagaccattacctagaacatcctaatcgaaaagatctccccaatccgaccagaccggcaggcaccttcgactcgagcggagcaggcgaggcagagatggcgctgcgacgggcgctcctcagatcggtcaacttctcccccgacagcaaggctgcaattgagtacttttattctttctcaagggcacagtctgcttgttctctcaatggtgctggtctttgtcctgctagtagatcatttagcacccaggctgccactacgtcaagcacaccacagcctccacctccaccaccccctccagagaagactcactttggtggtctcaaagatgaggatcgcattttcaccaacctctatggtctgcatgacccttttctgaaaggcgcggtgaagagaggtgactggtataggaccaaaggatttggtgattaggggggcagactggatagttaatgaaatggaagaatcaggtcttcggggtcgtggaggtgcaggttttccctctggtctgaaatggtctttatgcccaggtttctgagggacgccttcttatncgggtgtaatgctgatgagagtgacctgggacttgcaaagatagagaatcatgcgccaagaccccacaagctctgggaagatgccttatggg

SEQ ID NO: 23277 - DNA, 709 bp, Zea mays
  misc_feature: Ceres CLONE 1393441-F
  misc_feature: Encodes the peptide sequence at SEQ ID NO. 23278
  misc_feature (552)..(552): n is a, c, t, g, unknown, or other
  misc_feature (639)..(639): n is a, c, t, g, unknown, or other
cagagctggagctccccgcggtggcggccgctctagaactagtggatcccccgggctgcaggaattcgcacgagaccattacctagaacatcctaatcgaaaaaaggttgttttgttgcttccttgtcccgctctcaccagcaatcccgtcgatcacccagacctccacggcactgctccgtctcctccgttccgttccgaaccgcaagctcccaacccttccgcgatggacctcacctcgccgtcgcccgcggcgcgccgcgccgccgccatcgcgcgccacctcgccgcagccgccgcccccatcccggcgagcagcgccctggaaccttcctgctgcctcagctacgtcccgccggagtccacggagcgggcgggcggcgtttgcgccggccgacctcaggcttctgctggacgggcacgacctgcccacgcgggactggctcttccgcgccatggaggagagcccccttttccgcagccggagttcgcggacgggatccagggtggtcgtggcgccggacttcaacgacggcaaggaagggcagcggnaagccaccatgcggcggatcgcgtacctgaatcgcgcgcggtgttccgggtgttccccccggaggacggggctgcccgcgagctccnaaactagggctctcgactgatcggcactatgacactcttcgccattgagattggagccacttctcctctg

SEQ ID NO: 23278 - protein, 67 aa, Zea mays
  misc_feature: Ceres CLONE 1393441-F
  misc_feature (33)..(33): Xaa is any aa, unknown, or other
  misc_feature (62)..(62): Xaa is any aa, unknown, or other
MEESPLFRSRSSRTGSRVVVAPDFNDGKEGQRXATMRRIAYLNRARCSGCSPRRTGLPASSXTRALD

SEQ ID NO: 23279 - DNA, 698 bp, Zea mays
  misc_feature: Ceres CLONE 1393443-F
  misc_feature: Encodes the peptide sequence at SEQ ID NO. 23280
  misc_feature (356)..(356): n is a, c, t, g, unknown, or other
  misc_feature (384)..(384): n is a, c, t, g, unknown, or other
  misc_feature (447)..(447): n is a, c, t, g, unknown, or other
  misc_feature (453)..(453): n is a, c, t, g, unknown, or other
  misc_feature (519)..(519): n is a, c, t, g, unknown, or other
  misc_feature (540)..(540): n is a, c, t, g, unknown, or other
  misc_feature (588)..(588): n is a, c, t, g, unknown, or other
  misc_feature (616)..(616): n is a, c, t, g, unknown, or other
  misc_feature (624)..(624): n is a, c, t, g, unknown, or other
aaagctggagctccccgcggtggcggccgctctagaactagtggatcccccgggctgcaggaattcgcacgagaccattacctagaacatcctaatcgaaaaattttacactgccatgccacagccacagcatcacgtccactcattagcaaggtagcccgtgctgcacctgcctgccagccgcagctgtcctgcctttgccttcccatagcatagccatggacatttggaagtccaaggtgttgcccaagatcaagctcgtcttcgtcaagagcgccggcaagaaggccgccgccgccgccgagctcgtcaagtccttcgacgagtccaaggaggggatcgatggcgagttccangagaagaaggctgatctccagcccaggntcgtcgagatctacgagtctgcccctgcaccactcaaggtcctgatcaaggagaggagcaggntgtccnggatcaaaagaactcccgccgcatcaccaagttcttcgaagagctggccaagatcgaattccctgnaggcaagcaagtgagcgacgncattctccaggccggcccgggccctgctgtcccgcccatctttcgcanggttcggagaagtctcacgctgctcccntgtcgtcnctgccgaagagcccggcaaaggagcccccgccccccccggccactgaggagggcacccacaaaggagcgcccgt

SEQ ID NO: 23280 - protein, 104 aa, Zea mays
  misc_feature: Ceres CLONE 1393443-F
  misc_feature (1)..(98): Pfam Name: DREPP Pfam Description: DREPP plasma membrane polypeptide
  misc_feature (46)..(46): Xaa is any aa, unknown, or other
  misc_feature (56)..(56): Xaa is any aa, unknown, or other
  misc_feature (77)..(77): Xaa is any aa, unknown, or other
  misc_feature (79)..(79): Xaa is any aa, unknown, or other
  misc_feature (101)..(101): Xaa is any aa, unknown, or other
MDIWKSKVLPKIKLVFVKSAGKKAAAAAELVKSFDESKEGIDGEFXEKKADLQPRXVEIYESAPAPLKVLIKERSRXSXIKRTPAASPSSSKSWPRSNSLXASK

SEQ ID NO: 23281 - DNA, 749 bp, Zea mays
  misc_feature: Ceres CLONE 1393445-F
  misc_feature: Encodes the peptide sequence at SEQ ID NO. 23282
  misc_feature (326)..(326): n is a, c, t, g, unknown, or other
  misc_feature (531)..(531): n is a, c, t, g, unknown, or other
  misc_feature (532)..(532): n is a, c, t, g, unknown, or other
  misc_feature (587)..(587): n is a, c, t, g, unknown, or other
  misc_feature (625)..(625): n is a, c, t, g, unknown, or other
  misc_feature (629)..(629): n is a, c, t, g, unknown, or other
  misc_feature (630)..(630): n is a, c, t, g, unknown, or other
  misc_feature (647)..(647): n is a, c, t, g, unknown, or other
  misc_feature (728)..(728): n is a, c, t, g, unknown, or other
caaagctggagctccccgcggtggcggccgctctagaactagtggatcccccgggctgcaggaattcgcacgagaccattacctagaacatcctaatcgaaaaaccgcaggacaggagaagcttgggtctcctatcctccccacccctctctcggtctcttccccaccgcgtcttcgtcgtctcgtcttcctgcctccttcgcccgagaaaggagagaatggggagcagcgagaagaccgttaccgcttacggcgagtacacctacgctgagctggagagggagccctactggccgagtgagaagctgaggatttcgattactggnggctggtggtttcattggatcccacattgctcgccgtctgaagaacgagggccattcatcattgcctctgactgtaagaagaacgagcacatgaccgaggacatgttctgccatgagttccacctcgttgatctcagggtcatggacaactgtctcaaggtcacccagggtgtcgaccatgtcttcaatctcgctgctgatatgnngtggcatggggttcatccagtcaaatcacttctgtgatcatgtacaacaacaccnatgatcagttttaacatgctggaggctgcacgtatcantggnnggtgaagaggttcttcntatgcttcgagtgcatgcattttaccctggagttcagcagctcgacacaaatggtgagcttgaaggaatctgatgcctggnctgctgagcctcaagacggct

SEQ ID NO: 23282 - protein, 116 aa, Zea mays
  misc_feature: Ceres CLONE 1393445-F
  misc_feature: SWISSPROT Homolog: EC 5.1.3.18 GDP-mannose 3,5-epimerase
  misc_feature (105)..(105): Xaa is any aa, unknown, or other
MGSSEKTVTAYGEYTYAELEREPYWPSEKLRISITGGWWFHWIPHCSPSEERGPFIIASDCKKNEHMTEDMFCHEFHLVDLRVMDNCLKVTQGVDHVFNLAADMXWHGVHPVKSLL

SEQ ID NO: 23283 - DNA, 654 bp, Zea mays
  misc_feature: Ceres CLONE 1393446-R
cagattgggtaccgggccccccctcgaggtcgacggtatcgataagcttttttttttttttttttggaattctacaatccaattcacttatttctcaattcacttatttctgaaattcacagtccaactcagggcttattcggtttgatgttaatccatgtacattggatgagattgagtcggtttaaatccataacaagtcaaaatacatatcaatcccgctcaatccacttcgatccatacggattggaaataaccaaacaatacggattggaaataaccgaacaagcctcacttatttctgacacagaccctcattgcacacaccaagtcacctaagattggtactcttgctgttcgcttattcctaaaactacatgaaactagaaagagtctccaggtccaaggatgctcggttgagcgtttggttgcattctcgataaccaaaacgcggccacagcatgactagcaaaagtacatcattctgctacacttaactccctttcaatctcttcaagtgatctccccttggtctcgaccacattcccagctatgtacagaactgcaagggcacatactgatgcaaatcccagatacacgttgctgatcccaaacttgctgacgacactcaggaagtacaggccaatgaaaaag

SEQ ID NO: 23284 - DNA, 716 bp, Zea mays
  misc_feature: Ceres CLONE 1393448-F
  misc_feature (193)..(193): n is a, c, t, g, unknown, or other
  misc_feature (570)..(570): n is a, c, t, g, unknown, or other
aaagctggagctccccgcggtggcggccgctctagaatagtggatcccccgggctgcaggaattcgcacgagaccattacctagaacatcctaatcgaaaataggctttcagccgctctcctagtctcctactctcctctcagccgtcgccgtcgctctccacaccgctctcctctctcctccgagccgcagntcttctctctccctctcccctgcgtgccgccactgcgggcaccctgcacgccgccgctgcgtggccctacacgccaccgctacgggtgccctacgcgccgccgtcactgctccagctctcctctggttcccagccaatgcccgcgctctaactccccaaggcatcgccccgacgacggctcaacgaagccccgtcgacgcctcgcggacgccctgcgccgcagcgggcgctttacgctccatggcaaggcgcgtagatggctcagggtccacagggcgcttagcgcctaagcgacgctaaggcggcgcttcaaatagccatgcttttgaaataggatgtaagggattaagggtcatgtgaagaattctaggactacnatgggtatcaaggcgggtgcttttcttatttctcaataccctcacccaggctcctggatgttaagggattcagtaagaagaaggcattccgttgcctaagaactaccttgggggcctgatcttaccccccccccccaggatcctag

SEQ ID NO: 23285 - DNA, 690 bp, Zea mays
  misc_feature: Ceres CLONE 1393452-F
  misc_feature: Translation starting site: 308
  misc_feature: SWISSPROT Homolog: EC 6.3.2.1 Pantoate--beta-alanine ligase
  misc_feature (247)..(247): n is a, c, t, g, unknown, or other
  misc_feature (281)..(281): n is a, c, t, g, unknown, or other
  misc_feature (294)..(294): n is a, c, t, g, unknown, or other
  misc_feature (356)..(356): n is a, c, t, g, unknown, or other
  misc_feature (378)..(378): n is a, c, t, g, unknown, or other
  misc_feature (533)..(533): n is a, c, t, g, unknown, or other
  misc_feature (599)..(599): n is a, c, t, g, unknown, or other
  misc_feature (690)..(690): n is a, c, t, g, unknown, or other
agagctggagctccccgcggtggcggccgctctagaactagtggatcccccgggctgcaggaattcgcacgagaccattacctagaacatcctaatcgaaaaattttatcgtcaacaatttcgtcttctcagtttctgacttattccggggcatttttttattgtttcgagcctgtgagtctgattccattttgacccatggcggcggctgcggttcatgagccggaggtgatccgcgacaaggcgncgatgcgcgcgtggtcgcgccgcccgcgcgcggnaggaaagccgtcnctttagtcccacgatgggcttcctcacgagggacacctctcgctcatctccgcgggcgtggnggcctccgccgacccccatcgncgtcgtcgtctccatctacgtcaaccccagccagttcgcccccaccgaggacctcgccacctaccccctcgacttcggccggggacctccgcaagctggctgccaccggggtcgtcgacgcagtattttgccccccggacctctacgtccgcggnagcgctgatcgcccctccgcggcgcgcgtcgggggggcgtgtttgctggagaggataggaggtggncatgcccacaaacctggattcgggtgagcggttgaaaaagggctgtcggaacaacagcccttctctccgggggggggcacggggccccatn

SEQ ID NO: 23286 - DNA, 730 bp, Zea mays
  misc_feature: Ceres CLONE 1393453-F
aagctggagctccccgcggtggcggccgctctagaatagtggatcccccgggctgcaggaattcgcacgagaccattacctagaacatcctaatcgaaaaaatgtctacttgtctaccgtcgctgcgctagccctcctccctgcttcttgcttttgcctgagcctgcagcctgctgcaagcttttgctttggtttaggtgcttcttttccacccctttactgtccccccacttttgcttgctttgtcacgcacacgaaaagctcctgcctttaccttatctccgcacccgtagtggggattggtgggagctgcgctgctcgcccctcgcgtttctttgctcagtggggggtcacggtcacgcccccgcggtgctgcgcgtgctcgtggggcggcggaaattcgggggtcttgcggcggccccgtccccctcggggattgcggacgctctcttgagatcttcgcgaaactccgggagcgcgccggagaataactgggggcccgcccaacagttggccgccggggtcgggcgccctcttgctccttcaacctgaactgggaccaggttatgggcggccaccaagttcgaccggggggttagttcgagggcctccccccccgggggcaaatctaaagggccgcccccggggttactggagggccggcgttctccaaggggaattcctcccgaagaggaggaagggagggcatctcggttaaatttccccccca

SEQ ID NO: 23287 - DNA, 642 bp, Zea mays
  misc_feature: Ceres CLONE 1393454-F
  misc_feature: Encodes the peptide sequence at SEQ ID NO. 23288
  misc_feature (510)..(510): n is a, c, t, g, unknown, or other
aaagctggagctccccgcggtggcggccgctctttaatagtggatcccccgggctgcaggaattcgcacgagaccattacctagaacatcctaatcgaaaaaagccccccattcccattctaccaccgacccgtcccgtcccactgcctgccagcgtctcccccgctccctctcctcgagagatctcgcgctccggcgatcgggcgcggcgggcggagggtcgcgaagtgccctgcccacccccgatgctcttcccgaagcgcatcaactacgtggccccgatgctcgcctccgccgccatcctgctcctcctcctctcgggctacttcgagctcccctccatctccaccccggcgccgctcctcgcgggcgcagcgcgcttccccaccgcgctcgactccgtcggatcgcgcgaccgcgaccccttcacctcgctcctcgaggccttcgcgtcctgggacgccgccgtcggctgcccccgcgtctgcgccaagctcgccgccccggggnttggggctggcccccgggcctggccgctgccgaattgcgagcggcaacggccagccctaaagggcaccgcggaaggacccctggcgggaggggtttcgttcaggcggcggcccccccttcggccccggaact

SEQ ID NO: 23288 - protein, 132 aa, Zea mays
  misc_feature: Ceres CLONE 1393454-F
  misc_feature (89)..(89): Xaa is any aa, unknown, or other
MLFPKRINYVAPMLASAAILLLLLSGYFELPSISTPAPLLAGAARFPTALDSVGSRDRDPFTSLLEAFASWDAAVGCPRVCAKLAAPGXGAGPRAWPLPNCERQRPALKGTAEGPLAGGVSFRRRPPLRPRN

SEQ ID NO: 23289 - DNA, 718 bp, Zea mays
  misc_feature: Ceres CLONE 1393462-F
  misc_feature: Encodes the peptide sequence at SEQ ID NO. 23290
  misc_feature (718)..(718): n is a, c, t, g, unknown, or other
tccccgcggtggcggccgctctagaactagtggatcccccgggctgcaggaattcgcacgagaccattacctagaacatcctaatcgaaaagagcaacccggcgaaagccccccaaaccctcgcaccctaaaacagcggcgcacaagatgtccgacgaccccaccaacggcggcggcggtgatcgcgtggaggacgtcgtccgcaccgagggtgaaacacaacctcgtgatgatggcttgtcgaaatccaaggatagggacaaagatagagaaaagggacaggacagagatcgtcgcagagaccgtgacagagatcgagggaggagacaggaaccgtgataaggacagggacagggatcgggacagaacaagaatcgccaaagtaggccatccccgggaaagacgggaaacgggaagcccgtccttgttgatccccgaagcccgggattttttaaaaaaaaaaaaaaaccccaaaaaaaagggggaattgggagaggtttgtttttcgggtctcctttaaagggggaaaaaaatccaaaaatttagggccccctttaaaaaaaaaaaggggttttttgggtttttttgggccccccccccccgaagaaagggggggcaaaaatttttccggttttcccccccccccaaggggaaccccggggctcttctttttctaaaaaagggggggggaggggtttccaaaaaaatctccccctcn

SEQ ID NO: 23290 - protein, 63 aa, Zea mays
  misc_feature: Ceres CLONE 1393462-F
MSDDPTNGGGGDRVEDVVRTEGETQPRDDGLSKSKDRDKDREKGQDRDRRRDRDRDRGRRQEP

SEQ ID NO: 23291 - DNA, 642 bp, Zea mays
  misc_feature: Ceres CLONE 1393465-F
  misc_feature: Encodes the peptide sequence at SEQ ID NO. 23292
  misc_feature (604)..(604): n is a, c, t, g, unknown, or other
  misc_feature (642)..(642): n is a, c, t, g, unknown, or other
ggagctccccgcggtggcggccgctctagaactagtggatcccccgggctgcaggaattcgcacgagaccattacctagaacatcctaatcgaaaacccccacagaaccgtctccccagcccggcgcctcacggtcgcaatttattgcttgcgcaccgcctcgccgctttggcgtggggcgtttgcctgtgtggcgctgggcatgtgccgtgcccgtggcttgcttcgtcgtgctcactagtcacgagagagggaggaggctctgcttctgctgccgcttcttcttctcctgctgctcttccggagataagcagggggccgggacagctgactagctgagaggcatggggatggacgccggcggcggcaagctgccgtacagctacgccggccagcaggacggcgagaagctggtgaagagcgtcagccgcgtggagccgcgcaggttcggcctgagcctcgtggcgggcttcctcgtcgtcacctgcgcctacttctccaccgccaagttcgacgccatccagatcgccatgaccagccgacccgtctccagcaatgcggctggcgtcggagtccgctcgctgagagtgggcgccgccgccgncgacaccctcaacgcctcccagcagggattagatttgn

SEQ ID NO: 23292 - protein, 99 aa, Zea mays
  misc_feature: Ceres CLONE 1393465-F
  misc_feature (87)..(87): Xaa is any aa, unknown, or other
MGMDAGGGKLPYSYAGQQDGEKLVKSVSRVEPRRFGLSLVAGFLVVTCAYFSTAKFDAIQIAMTSRPVSSNAAGVGVRSLRVGAAAXDTLNASQQGLDL

SEQ ID NO: 23293 - DNA, 584 bp, Zea mays
  misc_feature: Ceres CLONE 1393472-R
gacggtatcgataagctttttttttttttttcttgtttattcattgcaacgtgacagcttacaggttgctcacgaggtcgttggcgtcaaactgtcccttggaggaacctcgactgaacacatttagccagaagatgatatgttgctcaccacatcctttgcattcaacaaacgtttggagggatgtcgaccgcattcaatacatccaccaaaccaaaacgccatgatatgcgacattctgggttcactttgactaccaacattattggcggcgaaaaaaagactccattggaaatgcacttcagcttatcacccccaaaaaacacctggaaatcaggttgtcaaaatcaggtcatgcaagcgctggggccggagtgcctccagtggcaacttgcaatgtcttctgtacagagctgttacttctttgtgatgaaaccgaataaatgtgtccacaggaaactcaaacttctacccaatttgtttccggcatcagaagtgcccatcctttttacaaggggggtggaccccaaaagaaccgcctttagataccaaggcttcttccacctcctaatacatttgaacaa

SEQ ID NO: 23294 - DNA, 648 bp, Zea mays
  misc_feature: Ceres CLONE 1393472-F
  misc_feature: Translation starting site: 110
  misc_feature: Pfam Name: DNA_photolyase Pfam Description: DNA photolyase
caccgcggtggcggccgctctttcacaatggatcccccgggctgcaggatttcgcacgagaccattacctagaacatcctaatcgaaaaattcgagcatcacacctaccatggtcaccgtctccggcactgacggcgggtggctgggcgggttgagatcccagtatactccccttcgcgaccttctagctcagactctgcatcggcgcgccggtcacattgcacagtcggctccggccccgtccagcctccacctccgcaatcagatctctacactcggcgtatggaaccacccctgcgccgagcaaccctcctcccggcgcaccacccggctcaattccgccacctcctccgtcatcgacgcgatgccctcctcaagggccggcctctcccgctgcttcacttcgagcgcgtccgtggcagcagaggggcgccgcatgctcgtctgattccgcgccgaccgccgcatccaagagcactgagccgcttcacggcgcagcggcgtcgtcgtcctccctcctccccggtttcgtcttagatccgcgagacttcgggaagtccccctcggggatcgaccggacggggccgtaccgcgccaacttcctgctcgattcggtcgccgacctgagccggagcctccgcgcccgcg

SEQ ID NO: 23295 - DNA, 674 bp, Zea mays
  misc_feature: Ceres CLONE 1393476-F
  misc_feature (495)..(495): n is a, c, t, g, unknown, or other
tggagctccccgcggtggcggccgctctagaactagtggatcccccgggctgcaggaattcgcacgagaccattacctagaacatcctaatcgaaaaaccatcccggaggtaatcttgcgccgattcggtgccgatttgcgccatccgcgaccggaggctccgccgggtcttgtgttcttgcggggcgggggctcaggacaacctggcctctgcttgattggattcggggcgttcggcgcctccagctcgcgatctttcctgccggtttcgtcgaccgctggtcaacctggccggtcggtcccgggggctcttcacctccgtgctgcctgccaccgtcgctttagtcaagtcttggccaagattttagctatctccggtcaaaaagctttaccgattctttggatggtggcttcttgggggcgagaaagccggtccctgttcgtctcttgtgctccagcatggtctgtagcacaccgggtccccatctccagtgnaggtcgctcgggtgctctttggttttgtgcctcccgaaaccgtccccgaaaagctactttttgcccgctgcggggatggcgtccaggccccaccaaaattgcccgaggggaaagaaaaacctgaaaaagccccgcagctttggaaaccaccaaaactattgggcctggcaaaaaaaatg

SEQ ID NO: 23296 - DNA, 731 bp, Zea mays
  misc_feature: Ceres CLONE 1393477-F
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (19)..(19): n is a, c, t, g, unknown, or other
  misc_feature (20)..(20): n is a, c, t, g, unknown, or other
gtggttttggccnnncccnnttttgtgtgtgccccccccagctaccacccaataaaaatggagctccccgcggtggcggccgctctagaactagtggatcccccgggctgcaggaattcgcacgagaccattacctagaacatcctaatcaaaaagaggcaaagccgttagccaatctgctgttgcgtgttgcaccgatcaacgtcggttcccagcgcttgctcgtcaagcgtgtcctgctgctgttctctgctcctgcttgccgcgagagctcctctcgctcatctacccaaggtccgacagcaacgacttcgtcgagctgctatgggagaacggccaggcggtggtgcacgggaggaggaagcagcatccccaggccgccttcccgcccttcacctgcggcgcggccagcagcagtagagctcaagaaaaccagccgggtactaccgacccggtctcgctgttcaagacgggaggcctcttcgccgacttctcgtccggcctagacgccgcccgtggcaacggtgaccttgacgacaccgtgccctggatccactgccccatcgtcgaggaagacagggccgcaccccgcacctgccctcgcggaggggctaccagcccagaatttcttcctcggagcctccatgccagcgggggtttagcaagccggcggtcggaaagagaccgaaccctccagcccttcctgcccacccacccggtccccaggaaaa

SEQ ID NO: 23297 - DNA, 766 bp, Zea mays
  misc_feature: Ceres CLONE 1393478-F
  misc_feature: Translation starting site: 346
  misc_feature (15)..(15): n is a, c, t, g, unknown, or other
  misc_feature (17)..(17): n is a, c, t, g, unknown, or other
  misc_feature (19)..(19): n is a, c, t, g, unknown, or other
ggggtgggggctttncntntttctccccccctccgccccccccgcttttcccccccctaaaaatggagctccccgcggtggcggccgctctataactagtggatcccccgggctgcaggaattcgcacgagaccattacctagaacatcctaatcaacaatctgtccccctttccctcctgcgcacccgtcttctcgtccccgggtgaaaccccagcacaaaaagcaaccgcccgccgcctcctcgttcctctcccgaatcagccgtcgcggtgcctaatccggccgatcccccctccgatccgcgggtgcccgccgcagaggcggcgcctccgggcctcccccgatgtatagcaacttcaaggagcaggcgatcgagtacgtcaagcaggcggtccaggaggacaatgccgggaactacggcaaggcgttccctctctacctggaacgcgctcgagttacttccaaacccacctccagtacgagaagaaccccaagatcaaggaggccatcaccgccaagttcaccgagaacctccggagggccgaggagaatccgggggccccccctccatggaggggaggcgcaggggactggtggccagccggtggccgaccgcacatgtcggccaatcggccccgcagaacccaggggcaaggcacgggggaccgggaggccaacgggaggggggactgaactccggaagaaggcccgaacgctggacgggccgccggctccaaaatgccggccacctcgtgtcccccggt

SEQ ID NO: 23298 - DNA, 645 bp, Zea mays
  misc_feature: Ceres CLONE 1393480-F
  misc_feature: Encodes the peptide sequence at SEQ ID NO. 23299
  misc_feature (402)..(402): n is a, c, t, g, unknown, or other
  misc_feature (403)..(403): n is a, c, t, g, unknown, or other
  misc_feature (414)..(414): n is a, c, t, g, unknown, or other
  misc_feature (417)..(417): n is a, c, t, g, unknown, or other
  misc_feature (418)..(418): n is a, c, t, g, unknown, or other
  misc_feature (465)..(465): n is a, c, t, g, unknown, or other
  misc_feature (504)..(504): n is a, c, t, g, unknown, or other
gctctgaactagtggatcccccgggctgcaggaattcgcacgagaccattacctagaacatcctaatcgaaaaacccatctctactcgagtctctgcgaatccgttgccggtagcctctctgcggtgagagttctgctgccgcctgctggagatgatggacgacggaggaggaggggtgcagtcgcagggcgtcaacccggactgccccaacgccgccaaccccttccaccgctgcgccgcgtactgccccgtccccgccccggcccccaccaaagccgccgccgccgccgtgcgcagcaagccgtctccgcctcgtccgagggcgacggcggtggcggcgcagaacgggacagccaagcacggagacggcgctgcgcgtgtcgctcccgcctccgacgcgnnagacgacgacnacnnacggagcgagagggaagagtcgcgggctgtcaactcgggctaccggncgtctccgcctcgtccgggggcgagggcgacccacgcgncgcaaaacgggaaccgccccccgcgacaaggttgaaggaggatggcgaaatcacccgtctccaacaattcggaggaacacggcgaaaaactttccaggacccccggagggcaggaacaagaacaaggaaggtcaccgggcg

SEQ ID NO: 23299 - protein, 128 aa, Zea mays
  misc_feature: Ceres CLONE 1393480-F
  misc_feature (84)..(84): Xaa is any aa, unknown, or other
  misc_feature (88)..(88): Xaa is any aa, unknown, or other
  misc_feature (89)..(89): Xaa is any aa, unknown, or other
  misc_feature (105)..(105): Xaa is any aa, unknown, or other
  misc_feature (118)..(118): Xaa is any aa, unknown, or other
MMDDGGGGVQSQGVNPDCPNAANPFHRCAAYCPVPAPAPTKAAAAAVRSKPSPPRPRATAVAAQNGTAKHGDGAARVAPASDAXDDDXXRSEREESRAVNSGYRXSPPRPGARATHAXQNGNRPPRQG

SEQ ID NO: 23300 - DNA, 643 bp, Zea mays
  misc_feature: Ceres CLONE 1393484-F
  misc_feature: Encodes the peptide sequence at SEQ ID NO. 23301
tggcggccgctctagaactagtggatcccccgggctgcaggaattcgcacgagaccattacctagaacatcctaatcaaaaaccaaaccagcgaggcagctaccgttttgtcgccatagcactcccgccgaccccctcgccgccgcctggaatggagaccagcaccaagaagcttagcagccttcgtatcacctccctggacgacgatgacgacgagaccgagatcccgcaccagccccctcaagcaggcctctccaccgctgaagcggattatgaggacgacgacgatgaggaggaagaagccgaagtgactcttggtgtccttagcaaaccgaagcacccaggcctcctcctccgccacttgttccccagcaaggccggtggcatcccggcgtggctagacccggtgaacttgccgtcgggaaagtccagctactgtggtttctgtggcgagcctctgcagttcgtcctccaggtgttttctttgtgtgcaatgaagttgccacactcgactgcttattgtttggatatcgacttggtcacagttaggcttggttgtgtttagatttatgcaccaattgaagataatgtagcagccttccaccgaacgctgttcatgttcatgtgcccatccatggcatgc

SEQ ID NO: 23301 - protein, 137 aa, Zea mays; identical to SEQ ID NO: 22894
  misc_feature: Ceres CLONE 1393484-F

SEQ ID NO: 23302 - DNA, 709 bp, Zea mays
  misc_feature: Ceres CLONE 1393485-F
  misc_feature: Encodes the peptide sequence at SEQ ID NO. 23303
  misc_feature (16)..(16): n is a, c, t, g, unknown, or other
  misc_feature (17)..(17): n is a, c, t, g, unknown, or other
  misc_feature (20)..(20): n is a, c, t, g, unknown, or other
  misc_feature (21)..(21): n is a, c, t, g, unknown, or other
tgttttatgccccccnnccnnccctctcacccccacagggaaattcaaacccccaccaacactcgcgctccccccggtggcggccgctctacaactagtggatcccccgggctgcaggaattcgcacgagaccattacctagaacatcctaatcgaaaatcctgctcgccgccgggtctgggctgggtgacgctgcctcggatgaggccgcgctgaccggagccgtagtcggaccacccgcccacccatggcgcgcccgcagcgcgtgtatgagtcttggaaagggaacaataaattcttctttggcgggaggctcatattcggacctgacgccaagtcactgatcctgtctgtttcgctcattgtggccccggtattggtcttctgcggattcgttgctcggcatcttcgtcaccacttcccggcttacaatgctggatatgcgattcctgcggtagctgtagtgtttatgatttatgtgctagtcctgctcttgattacatcagcgcaggatcctgggatcgttccccgcgcaccccacccgccggaggatgagtttcttatggcaacgctttgtctgggggcccgcctgggaggctacaattcccccgtgcaaaggaagtactgcttaatggcatgcctgatgacagagaagtattgagacacctgcatgattcatccgcctcctccgatgctccccccgttcccc

SEQ ID NO: 23303 - protein, 137 aa, Zea mays
  misc_feature: Ceres CLONE 1393485-F
MARPQRVYESWKGNNKFFFGGRLIFGPDAKSLILSVSLIVAPVLVFCGFVARHLRHHFPAYNAGYAIPAVAVVFMIYVLVLLLITSAQDPGIVPRAPHPPEDEFLMATLCLGARLGGYNSPVQRKYCLMACLMTEKY

SEQ ID NO: 23304 - DNA, 757 bp, Zea mays
  misc_feature: Ceres CLONE 1393486-F
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (20)..(20): n is a, c, t, g, unknown, or other
  misc_feature (21)..(21): n is a, c, t, g, unknown, or other
  misc_feature (28)..(28): n is a, c, t, g, unknown, or other
  misc_feature (29)..(29): n is a, c, t, g, unknown, or other
ggggtggggcnnnnnnnntnntcccttnnctctcttgcccccctttgaggccccccaaaactgccctcaccgcggtggaggccgctctagaatagtggatcccccgggctgcaggaattcgcacgagaccattacctacaacatcctaatcaaaaaataccccgtctcggttctcaaacaccgccgccgccgttctcccgacatctccccgtccaggtcgttgggtcagcccctatccttcaccttcacgacttcacctgcttctccactgcgcgccccgcccccggacccgtcgtgcgccctgctcagatccatcgcaccgggggttgccgcaccactgcgccaagcaaaaggtgcccggccagcggcgcgtgcgccacatcatgcactgtcgtcttatgaagatctgccaaggggagaaagaagatgaggaataaacagcgaaaatcatctgccctcggttcctgatgcaggatgtggatcttctttatcttgtattgtatggagctaggaggattttggacttgcctggcttccttttccttaaacatcaagcaaacacgtggccacaccccatgtttatttcagtccctccttcatgcgaaccaaaaaatctaggaggacatccgaggaagcatcatttcccactttgcccacctccctcacaagggcggaatccccccccgcaaattgcaaaaaggaaggaccaccctcccttaaaacacaccccaaagggccaattagaatggattcaacc

SEQ ID NO: 23305 - DNA, 671 bp, Zea mays
  misc_feature: Ceres CLONE 1393487-F
  misc_feature: Encodes the peptide sequence at SEQ ID NO. 23306
aagctggagctccccgcggtggcggccgctctattatactagtggatcccccgggctgcaggaattcgcacgagaccattacctagaacatcctaatcgaaaaacttccccatcccgcttgctccgtgccgtggtctccgaggtcggggttcctttccgatttgatccgcccagctggaaaacgaaaatcgctgatgggttttggaaggaaagtcgtcatttcttggtgaggtttccgtttctggatcgactggctgatcgatcgtactagccgccatggcgtcgtcgtgcatcccggccggcgggatccggctgccggacctggagatggtcaaggccgcgccgccgccgccgccgccccgcccggcgcactcagcgtcgtcctccacgctctcggaggcgtccaactcgtccccagcctcctcgtcgtcgttggcgtcgctgtcgctcaagcgcccgcgcacgccgcggaagcgagccagccagacgtaccacgaggcggcggccgctgctcgcgtccatgtacccctccgtattccccgccgccaggggctgagaggagccccgaagcgcccgccgccccgccctcttggcctctcctccgggctttgggcgacaaacccgtccttgctcccaacctccctcccttcggataccccccctccccgggg

SEQ ID NO: 23306 - protein, 131 aa, Zea mays
  misc_feature: Ceres CLONE 1393487-F
MASSCIPAGGIRLPDLEMVKAAPPPPPPRPAHSASSSTLSEASNSSPASSSSLASLSLKRPRTPRKRASQTYHEAAAAARVHVPLRIPRRQGLRGAPKRPPPRPLGLSSGLWATNPSLLPTSLPSDTPPPR

SEQ ID NO: 23307 - DNA, 636 bp, Zea mays
  misc_feature: Ceres CLONE 1393489-F
  misc_feature: Encodes the peptide sequence at SEQ ID NO. 23308
ggcggccgctctagaactagtggatcccccgggctgcaggaattcgcacgagaccattacctagaacatcctaatcgaaaaacattattcaggtccaggtcacatgatgcacagacagcccgtccgacgccgcgttagctacttgcctacttcagctatatgaaacggcaaaagtcttcccctcgttccccaatctcctctccatcgaaaccctagcacgacgcaattcccgtcttcccacgccgtgtcgccgttgctatgggcaagaagcggaagctcgagcccaaatcggcggcagggttcacgccggttaaggcctccccgaccaccaggtctgccaccgctaaggccgctggtctatccgaggtcctcgcccccgtcgaggctacgatggagaagctgccgcagggggcaggcggcgaggatgtagaggaaatcgaggaggtggaggtcgaggaggaagtggaagtggaagaggaagaagaaggcgagagcgaccaggcttcgatccaggcgctgctggattcgttccccaaggaccagctcgtcgagctgttacgcgacgctgccatcgctcacggcgacgtgctaaccaccatccggcgcgtggccgacgccgacccggctcagcggaag

SEQ ID NO: 23308 - protein, 126 aa, Zea mays
  misc_feature: Ceres CLONE 1393489-F
MGKKRKLEPKSAAGFTPVKASPTTRSATAKAAGLSEVLAPVEATMEKLPQGAGGEDVEEIEEVEVEEEVEVEEEEEGESDQASIQALLDSFPKDQLVELLRDAAIAHGDVLTTIRRVADADPAQRK

SEQ ID NO: 23309 - DNA, 715 bp, Zea mays
  misc_feature: Ceres CLONE 1393493-F
  misc_feature: Encodes the peptide sequence at SEQ ID NO. 23310
  misc_feature (34)..(34): n is a, c, t, g, unknown, or other
  misc_feature (70)..(70): n is a, c, t, g, unknown, or other
gttgtgccccctcctttttttttttcttagtgangcccaccaatatatataaacaaactgccactcaccncggtggcggccgctctagaactagtggatcccccgggctgcaggaattcgcacgagaccattacctagaacatcctaatcgaaaatcagacggactcacagctcgcagcacctgcaccacttgacaaccagccagctagctaaccaaccggcggagccaagaacaagcaagagacaacttgccccgtccaggcagcatgtgcaactccaacgtcaagtccgcgggcgtcgcccagatcgacggccgcccggtgctgcagccggcgggcaaccgcgtggcggcgccggacgccgcccgcccgctcaagaagtccctgcacaagtccttctccatgccgccttcctacgacaacaatgccaccgtgcccgcccgtcccgcccctgccgagaacacccgtgcggcgccggcgccgccttctctgctgcctcctacgacgccggccccggccccggccgccgcgagggcgaccaaggcggcgcccgccgcgcccgcggagaagcccaggtccaaggccaggaagcccggcgccgtgctgccggtggcgacgctcgcggcgccagaggcgttcgagccggcggggagcatcgccgccggcgcggaggtagaatggccgcgcaggcgcaagcacagcgcaagtcgacgaat

SEQ ID NO: 23310 - protein, 149 aa, Zea mays
  misc_feature: Ceres CLONE 1393493-F
MCNSNVKSAGVAQIDGRPVLQPAGNRVAAPDAARPLKKSLHKSFSMPPSYDNNATVPARPAPAENTRAAPAPPSLLPPTTPAPAPAAARATKAAPAAPAEKPRSKARKPGAVLPVATLAAPEAFEPAGSIAAGAEVEWPRRRKHSASRR

SEQ ID NO: 23311 - DNA, 666 bp, Zea mays
  misc_feature: Ceres CLONE 1393495-F
tggcggccgctctagaactagtggatcccccgggctgcaggaattcgcacgagaccattacctagaacatcctaatcgaaaagacgcaacttcccattccgatccacatcagccccgtcgctgtctctccaggatctggagaccctacccgcctgagccctcagccggccgcgcggtgcggcaccgcaccaccgccaccgagccacgaacccgccggagtaccgacccgcctgcgccctccgctggccgtgcggcgtggcagcgcaccacctacggcgggctgcggcaccgccccggccctcgcaccagttccgcggcgacgtggtccagcagcaccgccaggccgcctacggccatttcactcgcggcttctgagcatctacctgcacttcttcaattacctgcagctttcatcgtatttcctttgcattgcataccgtgcagccaccctctgcacatgatgtttcggatggtatcttattattaaaaaactagatttacctcatgtttttcctcctctggcattattgctgaattggaaactaatcttcctgggggggtttatgccctgttaatttttcccctggccattttaaggccaaatttggattccaaaccctctcatccgaagaaacggcccccaaaggtttttgggcccctcggata

SEQ ID NO: 23312 - DNA, 609 bp, Zea mays
  misc_feature: Ceres CLONE 1393497-F
  misc_feature: Encodes the peptide sequence at SEQ ID NO. 23313
  misc_feature (375)..(375): n is a, c, t, g, unknown, or other
  misc_feature (385)..(385): n is a, c, t, g, unknown, or other
gagctccccgcggtggcggccgctctagaactagtggatcccccgggctgcaggaattcgcacgagaccattacctagaacatcctaatcgaaaaattttctcggccgggagccgcaattccatcctgctgctagagttacatactcacccaatagaacaattctatgcccggtgattgtacctcctgaggtagaagagcatactgaagcagaactcgagtggtgttggatcgaaatggaaggcgggatgtcaagtttggaagccgccatggaagcttcttcatcgatggcaagcagcatggcaaggaatgctgaccctgaccaacagactctccgccccaatttagtggagcagttctattttccaagacctgntcaatctttngccagcattcctccatttttttggcctcccctcaaagttgggatcctccccaaaggcgacaggggagccttatatttttgtgggaaaaaaaaccttttttaaaaacaacacacccccccctctcccccccaaaaaaaaaaaaataatggtttgtgtgtgtggggcacccccccccacccccgcaaaaataattattaggtgtgacccccccccctcccccccct

SEQ ID NO: 23313 - protein, 83 aa, Zea mays
  misc_feature: Ceres CLONE 1393497-F
  misc_feature (47)..(47): Xaa is any aa, unknown, or other
  misc_feature (50)..(50): Xaa is any aa, unknown, or other
MEGGMSSLEAAMEASSSMASSMARNADPDQQTLRPNLVEQFYFPRPXQSXASIPPFFWPPLKVGILPKGDRGALYFCGKKNLF

SEQ ID NO: 23314 - DNA, 590 bp, Zea mays
  misc_feature: Ceres CLONE 1393498-F
  misc_feature: Encodes the peptide sequence at SEQ ID NO. 23315
  misc_feature (158)..(158): n is a, c, t, g, unknown, or other
  misc_feature (159)..(159): n is a, c, t, g, unknown, or other
  misc_feature (199)..(199): n is a, c, t, g, unknown, or other
aaactggagctcaccgcggtggcggccgctctagaatagtggacccccgggctgcaggattcgcacgagaccattactagaacatctaatcgaaaagaacgcggacagtctctacagcctcagcacggacccggcctgcctcctcttctctctcacgnngacaatgggggaacgaacaaacgtcgctgggctacgccantgccaagggcttcttggggcccttgccgggggaccacaaaacccgggaatttaaacttgggaaaaaaagggggctcctggcgctaaattgtggccccatttttttgggcacaaaaattgggccccctggtaaggggaaaaattttccccccccccaaaaaaagaggggccggtgggtttaccacaaaaaaaaagtttccccccccgcccaggggggggggggtttctccccccccagggggggaaaaaaaaaaagggcccaaacctggaaaaaacaaaaaccccggacaattttaaaaccccaggggttgggaaaaaccccccccccgggggggaaaaaaaaaaaaaaaccccctctccccccttggggttttttataaaaaaaaaaaaaa

SEQ ID NO: 23315 - protein, 29 aa, Zea mays
  misc_feature: Ceres CLONE 1393498-F
  misc_feature (12)..(12): Xaa is any aa, unknown, or other
MGERTNVAGLRXCQGLLGALAGGPQNPGI

SEQ ID NO: 23316 - DNA, 633 bp, Zea mays
  misc_feature: Ceres CLONE 1393502-F
  misc_feature (445)..(445): n is a, c, t, g, unknown, or other
  misc_feature (455)..(455): n is a, c, t, g, unknown, or other
  misc_feature (458)..(458): n is a, c, t, g, unknown, or other
  misc_feature (474)..(474): n is a, c, t, g, unknown, or other
  misc_feature (481)..(481): n is a, c, t, g, unknown, or other
  misc_feature (482)..(482): n is a, c, t, g, unknown, or other
  misc_feature (493)..(493): n is a, c, t, g, unknown, or other
  misc_feature (495)..(495): n is a, c, t, g, unknown, or other
aaactggagctccccgcggtggcggccgctctagaactagtggatcccccgggctgcaggaattcgcacgagaccattacctagaacatcctaatcgaaaaacacgagacaatcgcaagacaacaacagcagcagaggaaccaagaggaaagcaaacctcgccggccgcacccctccatctctgatcgcccgctcattctcattcattcattcattcattcccctcgcgtcgcgtgattcgattggattccgttcccccgccccgttccgttccttcagcgccgctgccgctgccgctgcggctgcgccgaggccccagcgagtccccgaggcccgaccccaaaggctgcggcctgcggccgtcgcagtcccatcgattcctcccgcttggctttcccacccctcgaagccgaatccgatggttccacccgttgaccgcctccgncatcggaggncgnggccgctccctcccgncttcttnnctcggccccgngnccggctcctcctatagaaataccgcccgcgcatcgctccatggcggtcgggggcgacgacgacagatggaacggaacttcccggcaggttgcgcttgcggattcgccctccccggcaggctggccgcggcgcctaatt

SEQ ID NO: 23317 - DNA, 649 bp, Zea mays
  misc_feature: Ceres CLONE 1393503-F
  misc_feature: Encodes the peptide sequence at SEQ ID NO. 23318
tccccgcggtggcggccgctctagaactagtggatcccccgggctgcaggaattcgcacgagaccattacctagaacatcctaatcaaaaaagttccatcacacccccggacatgtctggtcgcaccctcctccggtcctcccaggcgataagccctctgggaccttggagagctcgatcggatcggagcccctgccatgggcgacgaggcgaaagcgaaggctaatgcgcgggtctcatccgtacgctatcaaggaggcggggcgaaacttcacggatgccattgggctcggcccggcgaagcacggcctctactccaaccggcgggcggcgctcgcctcactccaccgctactccgacgctctcgccgacgcgcagaagaccgtcgagctcaagcctgactgggacaagggctactcccgcctcggcgcgtcgcacctcggatctcggtgacgccgtcagagacgacttcgaacaggagaaggcccttgcgctcgaccccaccaacgaagatctcaaggcgtacctccaggacgccaagaaggccgtcgacgccccgccgcggcgcgagccgtccgttcccgacggcatcgtgcagatgctccaggatcccgaactgtagatcaagatcgcgtccgaccccaccaca

SEQ ID NO: 23318 - protein, 75 aa, Zea mays
  misc_feature: Ceres CLONE 1393503-F
  misc_feature: SWISSPROT Homolog: EC 3.1.3.16 Phosphoprotein phosphatase
MRGSHPYAIKEAGRNFTDAIGLGPAKHGLYSNRRAALASLHRYSDALADAQKTVELKPDWDKGYSRLGASHLGSR

SEQ ID NO: 23319 - DNA, 629 bp, Zea mays
  misc_feature: Ceres CLONE 1393506-F
  misc_feature: Encodes the peptide sequence at SEQ ID NO. 23320
cgctcttaactagtggatcccccgggctgcaggaattcgcacgagaccattacctagaacatcctaatcgaaaaatattctcccaaaaaacccaacactccagtggcggcaaagacctaacatttcaaaatcaatggccaagaaccccaaggcgcccgacacccgcagtggccgttctcccaccagaaggccccgaccacgccgcgccaaggcggtgccagaagcctcctccgcagctgatatcgaagacctggctccctcagtgcctggggccgctgcccctggcgctgccgcacccacggccctgcgcgcacagctgctccggtggtatgacgcgcaccgtagggacctgccgtggcgatgcgtaagcggcagcgaggaagagagggcgtacgcggtgtgggtgtccgaggtgatgctgcagcagacgcgggtgcccgtggtcgtcgcttactacgagcggtggatggcgcggtggccgaccgtacgaagcctcgccgccgctacgcaggaggaggtgaacgagatgtgggcgggtcttggctactaccgtagggctcgatttctgctggagggagcaaagcagatcatcgaaaaggggttgtttccttgcacggcgttagcccttc

SEQ ID NO: 23320 - protein, 165 aa, Zea mays
  misc_feature: Ceres CLONE 1393506-F
MAKNPKAPDTRSGRSPTRRPRPRRAKAVPEASSAADIEDLAPSVPGAAAPGAAAPTALRAQLLRWYDAHRRDLPWRCVSGSEEERAYAVWVSEVMLQQTRVPVVVAYYERWMARWPTVRSLAAATQEEVNEMWAGLGYYRRARFLLEGAKQIIEKGLFPCTALAL

SEQ ID NO: 23321 - DNA, 657 bp, Zea mays
  misc_feature: Ceres CLONE 1393507-F
  misc_feature: Encodes the peptide sequence at SEQ ID NO. 23322
aagctggagctccccgcggtggcggccgctctataactagtggatcccccgggctgcaggaattcgcacgagaccattacctagaacatcctaatcaaaagaaaacacaccatctccacctcgccgccgccgctcggatttccctctacctcaccctgtccgccgtcaaggagcagcaaggccaaggccgccgcggcgtcggcggccgtggtcgtggacgacatagccgagctgcaggggatgctagagcgcctgcggctggagaaggagaaggcggaggagatggttagggagcgggatgaggtcatccggaagaaggaggaggagatcgagaccagagacaaggagcaggagcgtctccaggccgagctcaggaaggcgcaacgcgccaaggagttcaagcctaccgtgagcttccccctcgtcaagtcgttgctggagaaagagcaagaagcagacgacaagggaaagaagaagaaggggaagggcggccacgagaggaagaagccgtgcccggcgtacgtgctctggctcaaggaccagtggaccgaggtcaagaaggagaaccctgaggccgacttcaaggaggtgtccaacacgctgggcgccaagtggaaggctctgggcgccgaggagaagcagccctatgaggatcga

SEQ ID NO: 23322 - protein, 139 aa, Zea mays
  misc_feature: Ceres CLONE 1393507-F
  misc_feature (88)..(139): Pfam Name: HMG_box Pfam Description: HMG (high mobility group) box
MLERLRLEKEKAEEMVRERDEVIRKKEEEIETRDKEQERLQAELRKAQRAKEFKPTVSFPLVKSLLEKEQEADDKGKKKKGKGGHERKKPCPAYVLWLKDQWTEVKKENPEADFKEVSNTLGAKWKALGAEEKQPYEDR

SEQ ID NO: 23323 - DNA, 587 bp, Zea mays
  misc_feature: Ceres CLONE 1393508-R
caggtcacggtatcgataagcttttttttttttttttttcaataagcattaccttctacatattctaaaactcaggtcgagaaaatgcgcacattataatcaccaagtcttggaactaccatacaacaaccaagctgtttcaaactttcgatggcgtgaggatccggcgcctcatttaattgttacaacaaactgctttgcagctacaaggccaggggtaacaatggtacaattgtacagatgcagattccagaagcagctgcaggtcagacaaaagccttttggcacatcatccgtgtatgggatacatcatacatagaactggcgaaaatgcttccacttatttccgggggagggacgggggaaccccaaatttttgtttgaacgttccacgggcagggggccaactccccccgaggaaaattccttttgcaatgaggaaaacctttccgggggaacccccccttggataaaaacttcgttaaaaccccaaaaaaaaatattttccccgggtttttctccttctaaggggggtgaaacattttgttttggggggcccatttgtgacaacacaatgttggaaattg

SEQ ID NO: 23324 - DNA, 661 bp, Zea mays
  misc_feature: Ceres CLONE 1393508-F
  misc_feature: Encodes the peptide sequence at SEQ ID NO. 23325
aaactggagctccccgcggtggcggccgctctagaactagtggatcccccgggctgcaggaattcgcacgagaccattacctagaacatcctaatcgaaaactccttcgttctgtttgttgtttttcttctcccgtccgcagtccgcttggcgtgcgcgacggctagggcgaccgccgccgccctacgccctacgtccagctgcccatgtcttcttcgggccccttgccggcgggaactcaccagaccaggaatcgtgctggcaaccggcgcaagtctggagggttttattatgcatttcctcagatgcaaccaaatgaatttcgttatgattttaggcacatgctattttgctgtgtggtttgctgggtcgatgcataagcggccctactgttcaccagatagggctgataaagctaattactcctacaataatgatggagagaagagcaatgttccttcattaaagaaccttcctccaattgttcatcatgaaacattcttcagcaatgttcagaatgactacaatcaaacaggattagtgcctttggagggatgttctgccagtgaggcttcacagcttctcagtgatcgctggactgctgcaatcaacatgtacaatgaccaaacaattgacccctcagagaaaccggtaatgtatt

SEQ ID NO: 23325 - protein, 115 aa, Zea mays
  misc_feature: Ceres CLONE 1393508-F
MNFVMILGTCYFAVWFAGSMHKRPYCSPDRADKANYSYNNDGEKSNVPSLKNLPPIVHHETFFSNVQNDYNQTGLVPLEGCSASEASQLLSDRWTAAINMYNDQTIDPSEKPVMY

SEQ ID NO: 23326 - DNA, 650 bp, Zea mays
  misc_feature: Ceres CLONE 1393509-F
  misc_feature: Encodes the peptide sequence at SEQ ID NO. 23327
gaagctcaccgcggtggcggccgctctagaactagtggatcccccgggctgcaggaattcgcacgagaccattacctagaacatcctaatcgaaaaattaattaacaaagagaagacttcttccttcctcgacggctccagaccattccaattcttgattccatcgccccaccatccacaactcccctaatccttccaacctcctcgtcgtccagaccaccacctccacgcgcaatggtcagcggctaggcggcaccaaccagatcacaaggattcgtttcatccggcagcgcagctctagagcctccatgggcagctacgcgtacgagtactgtatgtgcttcacgcgcaagttccgatccccggacgcccagccgccgccggacggccgcgccgaccacctctccttcgcctctgacgcccatgccctccgccgcttcgtcgccggcgtccagagcgagtcccccgccgacgacgaccgcatcctcgccatgctctccggggggcacagccatggaatcgcccgcctcgtcacaaggacgccggagacatccacgcccacgctcgaagacttcttcgccttcctcttctcccccgacctcaacccacccatcgtgcaccagggtcaccaggagatgtcagcgacgctc

SEQ ID NO: 23327 - protein, 114 aa, Zea mays
  misc_feature: Ceres CLONE 1393509-F
MGSYAYEYCMCFTRKFRSPDAQPPPDGRADHLSFASDAHALRRFVAGVQSESPADDDRILAMLSGGHSHGIARLVTRTPETSTPTLEDFFAFLFSPDLNPPIVHQGHQEMSATL

SEQ ID NO: 23328 - DNA, 686 bp, Zea mays
  misc_feature: Ceres CLONE 1393516-R
ccaattgggtaccgggccccccctcgaggtcgacggtatcgatattttttttttttttttttggaaccaaaattgaattccatgttgaattattagctagctagcgaaatgcaacacaaaacaaaatgttttctcatatagtcttgggccacgggctctgttcctaacatgggtctaatgtttcctagggaagctgcatatctatggttctgtattagcttggtcatcggagtcggagtcggagtcggagtcggagtcgatagcttggtcatcggagtcggattcggtagcttggtcatcggtagcctgctcggctggctcctgatctatatctgggacagaaaaatcagatgtgtccatttcttcttgtttaatctcccgactcgagctctcaccgtctggcgcacgaccgttgacgaaaagcgttagtggcagctcccaggcagcaacgaagagggagttctggaacatgaggtccccgtgtgtggagtctaccgagtatcgcaggtggtgcaagacctgcctggcgtatccgtccactgcgaagagcgtcctgccctggaagaataaagggtgttggggttgttggggtcgatgaaggcgagcgaaggcacacgccccagggcagaccggcaccggcgtatatgtagtggctccaaatgtcgggaaaggacaccgtgtactcg

SEQ ID NO: 23329 - DNA, 647 bp, Zea mays
  misc_feature: Ceres CLONE 1393519-F
  misc_feature: Encodes the peptide sequence at SEQ ID NO. 23330
  misc_feature (387)..(387): n is a, c, t, g, unknown, or other
  misc_feature (418)..(418): n is a, c, t, g, unknown, or other
  misc_feature (561)..(561): n is a, c, t, g, unknown, or other
tccccgcggtggcggccgctctagaactagtggatcccccgggctgcaggaattcgcacgagaccattacctagaacatcctaatcgaaaaacccacccacccccgcgtcccccacctcatggcgccggcgatggggctgaagcggcctgcggcgggagcggtggcggcagcagcgcagaccgtcacactgttcgcgccggccgtgcgggacgcggtgcgcaccgccgtaagggaggtcgaggccacggcgaaggctaccgccccggccgccagggtcccggcgacggcggcagtgccggcgtagatcgctagggatggggtgctgtgcctggaggaggtcgacgggaggcggtggagctatgtgttcgacgccgctggcgccgcgntaaaggccaagggaagggcgtccgtcggcgncgccttcaaggccgtcccgctccagtccccgatgccgcccgtcgaggaaatcatgtcctttataagatcatatgttgtgcccgaaggctttccagatagtgtcacaccttcatatgttccatacatgacatggagagcattgnagcatttctttggtgaagcaaatgggtgtgtttacaacaaggaccttgctcacctctgttggagtctccaaagcagggctcatctg

SEQ ID NO: 23330 - protein, 61 aa, Zea mays
  misc_feature: Ceres CLONE 1393519-F
MAPAMGLKRPAAGAVAAAAQTVTLFAPAVRDAVRTAVREVEATAKATAPAARVPATAAVPA

SEQ ID NO: 23331 - DNA, 2196 bp, Zea mays
  misc_feature: Ceres CLONE 1393525
  misc_feature: Encodes the peptide sequence at SEQ ID NO. 23332
tgcttcctcctccctcgtctcgacccggctcgcccctgttatccctctcgtctcgtctcccaccgctgcgcgcgcgagatagactctgtcgcatctcgatcaccaaccgggccattccattcgtgtgggtttgctcattttggctgggatttcacgcgggaccgatcaccgcacgccggtgtgcgcgtgcgtctggcgcacggccggcgtcctccacccaacgcgccggaaataggcaggcggtgcatgcatgagcaggaagaggagagaaggaggcggcggcggaagaggcgctgggccggtggaccatcacggcggcggcaaggggtcggaggccggcgctgccgccaccgatgccgtgtccatggacggcggcctccgcgaggtgtctgtccccgtcgtcttctcggtttggtgcctcctcttcctcctgcgatcccagttcctccacagccaggccgacgacgacccttcgtcagagttctacgaggagcacggcatgcgcgacagctactgcaaggtgaggccgttggaggcctacgtgctcccctaccataacgactcgtgtcagtcctcctactcgcactcacagccgccccaagaagcgccctcgtcgtccgcgctcgcgtcgccgcagtacaatgccaccaccggcggcaacgcgtcgtcgcccgaggcggccttcgtgggcctcgacgagttccgcagccgcatgatgcagggcaaggcggagaacgacaccggcccgcccacggatggcggcgtcgcgcaccgcctcgagcccaacggcgccgagtacaactacgccgcggcggccaagggcgccaaggtgctcgcgcacaacaaggaggccaagggcgccgccaacatcctcggcggcgacaaggacaagtacctgcgcaacccgtgctccgccgccgacaagttcgtcgtggtcgagctctcggaggagacgctcgtcgacaccgtcgcgctggcgaacctggagcactactcctccaacttcagggagttcgaggtgtacggcagcacgagctacccgacggaggcgtgggagctgctggggcgtttcaccgccgagaacgccaagcacgcgcagcgcttcgtgctgccggagcccaggtggacgcggtacctccgcctgcgcctcgtcagccactacggctccggcttctactgcatcctcagttacctcgaggtctacggcgtcgacgccgtcgagcggatgctacaggacttcatcgctggcgctggcgctggcgccggcgccgaggccgacgcctccagggaccgcgcgcccatcgacttcgccaaccgggacgccgactgcaacgacaccaccgctcagcaggatgggaacggcggcgctgggaggaatgacagcaccgccggcgacggcaagagcaacagctccaggagcggcgacgcgaagctgccgccgcaggtagcggcgttggcatcgcccacggggcggatccacagcgacggcgtgctaaagatcctgatgcagaagatgcggtcgctggagctgagcctgtcgacgctggaggagtacacgagggagctcaaccagcggtacggcgccaagctgccggacctgcagaacgggctctcgcagacggccgtggcgctggagaagatgaaggccgacgtgcacgatctcgttgacgggaaggacagcgtggccaaggacctggacgacctcaaggcctggaagtcgaccgtctccggcaagctggacgatctgatcaaggagaaccaggagatgaggtggagcgtcgaggagatgcggggcgtgcaggagacgctgcagaacaaggagctggcggtgctgtccatcagcctcttcttcgcgtgcctggcgctcttcaagctggcgtgcgaccgcgtgttctgcctcttcgccggcaagggcagggaggaacccgacgcggaggagcacacaaggagcagtagggcgtggatgctcgtgctcgccagcagcagcttcaccaccctcatcgtcctgctctacaactgaagctttctagagtttcgcttgctagcacggagcaacgttcttttagccatgttcttgtccccgcatagctcattaactcccctctcaagtagatggggtaacgtatgtactcactatttcagaataaagatgaacacaggttccttgttcattgtaaaacaaaaaaaaaaaaaaaa

SEQ ID NO: 23332 - protein, 589 aa, Zea mays
  misc_feature: Ceres CLONE 1393525
  misc_feature (197)..(321): Pfam Name: Sad1_UNC Pfam Description: Sad1 / UNC-like C-terminal
MSRKRREGGGGGRGAGPVDHHGGGKGSEAGAAATDAVSMDGGLREVSVPVVFSVWCLLFLLRSQFLHSQADDDPSSEFYEEHGMRDSYCKVRPLEAYVLPYHNDSCQSSYSHSQPPQEAPSSSALASPQYNATTGGNASSPEAAFVGLDEFRSRMMQGKAENDTGPPTDGGVAHRLEPNGAEYNYAAAAKGAKVLAHNKEAKGAANILGGDKDKYLRNPCSAADKFVVVELSEETLVDTVALANLEHYSSNFREFEVYGSTSYPTEAWELLGRFTAENAKHAQRFVLPEPRWTRYLRLRLVSHYGSGFYCILSYLEVYGVDAVERMLQDFIAGAGAGAGAEADASRDRAPIDFANRDADCNDTTAQQDGNGGAGRNDSTAGDGKSNSSRSGDAKLPPQVAALASPTGRIHSDGVLKILMQKMRSLELSLSTLEEYTRELNQRYGAKLPDLQNGLSQTAVALEKMKADVHDLVDGKDSVAKDLDDLKAWKSTVSGKLDDLIKENQEMRWSVEEMRGVQETLQNKELAVLSISLFFACLALFKLACDRVFCLFAGKGREEPDAEEHTRSSRAWMLVLASSSFTTLIVLLYN

SEQ ID NO: 23333 - DNA, 709 bp, Zea mays
  misc_feature: Ceres CLONE 1393530-F
  misc_feature (386)..(386): n is a, c, t, g, unknown, or other
  misc_feature (508)..(508): n is a, c, t, g, unknown, or other
  misc_feature (509)..(509): n is a, c, t, g, unknown, or other
  misc_feature (515)..(515): n is a, c, t, g, unknown, or other
  misc_feature (636)..(636): n is a, c, t, g, unknown, or other
  misc_feature (637)..(637): n is a, c, t, g, unknown, or other
  misc_feature (645)..(645): n is a, c, t, g, unknown, or other
  misc_feature (646)..(646): n is a, c, t, g, unknown, or other
  misc_feature (648)..(648): n is a, c, t, g, unknown, or other
  misc_feature (658)..(658): n is a, c, t, g, unknown, or other
  misc_feature (705)..(705): n is a, c, t, g, unknown, or other
aaagctggagctccccgcgggtggcggccgctctagaactagtggatcccccgggctgcaggaattcgcacgagaccattacctagaacatcctaatcgaaaaacacacaaacacatcagcattcagcaatagctaatcgagcatcgtcgccttagctcctctcctctcctcttctctccgtcgtcgtggaacttctctccgccggctgccatataaaggaggaagaagagaacagcaacgctagctagccggccggcctccgtcgtcgccggcgtcgtcgactagctagctaactctcgatctccagttcctgcccccgccccacgcccggccggtcgtcgatcgtcagcaataataatggcaggaggcctcttctccatggctncacccggccgtcaccctctccgggcatcgcaggaaacatcatctccccttcgctggtgttccttgaccaagagtggcgacgtttccctgcaggtgtaaccggaagaagtcgaacggggcggnnttcagnctcggtgcccggtacggtggtggcgctccttcagcctcgggggcttggtggattcttctacgcggctgggtgaagacccaactcggagggcccgctgctggaccatcaaccgccttcgggnnttgcgggnngngggaaggcgnccctacatagtcctcctaacctggccgtacgccgccccgcgggcggnccgt

SEQ ID NO: 23334 - DNA, 639 bp, Zea mays
  misc_feature: Ceres CLONE 1393531-F
  misc_feature: Encodes the peptide sequence at SEQ ID NO. 23335
  misc_feature (588)..(588): n is a, c, t, g, unknown, or other
  misc_feature (617)..(617): n is a, c, t, g, unknown, or other
tggagctccccgcggtggcggccgctctagaactagtggatcccccgggctgcaggaattcgcacgagaccattacctagaacatcctaatcgaaaaagtaatacggcacgccgttcaatctaccgggacggcgagacggagaatagaagacgtcagcactcagcagttcagcactgacccgtcggccgtcgccctcccggctcgcaaccgcatctctctcggcttctggcctcttcctagttcctaactaccaccgccacctctaccactggcctcaatctgcaaaccctagccctcgtcgccggcggccatggccgagaccgtcgacgacaaggtcagctactttcaggccgtcaccggcatctccaacacggacctctgcacggagatcctcgccgcgcacaactgggacctgcagctcgcggtgtccaccatcaccgccaaccccttctcgccctccgcttcggcctccacctcctcgcgtgacccggccccttccgctccgttggcggtagatgcggagtacgtcgcgcccccgcccccgctgccgctgccgctgccgccccagcagcagcgggggatcgcgntggaagctggtgcgctcccctcacgtggncctccggggggtggggtcggcc

SEQ ID NO: 23335 - protein, 109 aa, Zea mays
  misc_feature: Ceres CLONE 1393531-F
  misc_feature (93)..(93): Xaa is any aa, unknown, or other
MAETVDDKVSYFQAVTGISNTDLCTEILAAHNWDLQLAVSTITANPFSPSASASTSSRDPAPSAPLAVDAEYVAPPPPLPLPLPPQQQRGIAXEAGALPSRGPPGGGVG

SEQ ID NO: 23336 - DNA, 670 bp, Zea mays
  misc_feature: Ceres CLONE 1393532-F
  misc_feature: Encodes the peptide sequence at SEQ ID NO. 23337
  misc_feature (468)..(468): n is a, c, t, g, unknown, or other
  misc_feature (556)..(556): n is a, c, t, g, unknown, or other
  misc_feature (603)..(603): n is a, c, t, g, unknown, or other
tggagctccccgcggtggcggccgctctagaactagtggatcccccgggctgcaggaattcgcacgagaccattacctagaacatcctaatcgaaaacccccacagaaccgtctccccagcccggggcctcacggtcgcaatttattgcttgcgcaccgcctcgccgctttggcgtggggcgtttgcctgtgtgtcgctggtcatgtgccgtgcccgtgccttgcttcgtcgcgctcactagtcacgagagagggaggaggttctgcttctgctgccgcttcttcttctcctgctgctcttccggagataagcaggcggccgcgacagctgactagctgagaggcatggggatggacgccggcgctgcaaagctgccgtacagctacgccgcccagcaggacggaggtaagatgtggaagagcgtcagccgcgagtaaccgcgcaggttctctctgcctcctggtgcnggctttcctcgctggcgcgtgcggctactcttcccaccgccaagttcgacgacatccagatcgtcatgaccaggcgacccgtgtccangaatgcggctgggcccaggaagacgcgttcgaattgggagtgggaangtcgtcgaccgtccaccttctccgagggcctcgaggggggggaattaacatcttgcgccgcgatgtt

SEQ ID NO: 23337 - protein, 30 aa, Zea mays
  misc_feature: Ceres CLONE 1393532-F
MGMDAGAAKLPYSYAAQQDGGKMWKSVSRE

SEQ ID NO: 23338 - DNA, 650 bp, Zea mays
  misc_feature: Ceres CLONE 1393534-F
  misc_feature: Encodes the peptide sequence at SEQ ID NO. 23339
  misc_feature (521)..(521): n is a, c, t, g, unknown, or other
  misc_feature (545)..(545): n is a, c, t, g, unknown, or other
  misc_feature (561)..(561): n is a, c, t, g, unknown, or other
  misc_feature (562)..(562): n is a, c, t, g, unknown, or other
  misc_feature (619)..(619): n is a, c, t, g, unknown, or other
  misc_feature (636)..(636): n is a, c, t, g, unknown, or other
  misc_feature (643)..(643): n is a, c, t, g, unknown, or other
tggagctccccgcggtggcggccgctctagaactagtggatcccccgggctgcaggaattcgcacgagaccattacctagaacatcctaatcgaaaaaactcgaaccgaagggacgaccgagcggagtctagactcgagagcaacctcgacctcccggatctctctcccacccacgcctcgtcggcgccgtcgtctgctgcagcgatggcctcccccgacctgctcttcaatctgcggaacctcttctacctgggcgcctaccaggcagccatcaacaacagcgacgtcccgggcctcgacgccgacgccgccgctgagcgcgacgccatcgtcttccgctcctacatcgccctcggctcctaccagctggtgatcagcgagatcgactcgtcagccgctacctcgctgcaggccgtgaagctgctcgcgctgtacctcactggagacaaggaaggtgctatctccagtctcaaggaatggttgagtgattcagcaattgaaagcaatcctggttctgcgnttgattgctgaatctctctccccnactacccctcgcaggnncccggcgatgtgcccaacgaagcccgatcgccctggcagggcgccgccggctccggngagaagagctggcgggnagggagnccgtgcc

SEQ ID NO: 23339 - protein, 108 aa, Zea mays
  misc_feature: Ceres CLONE 1393534-F
  misc_feature (3)..(109): Pfam Name: Coatomer_E Pfam Description: Coatomer epsilon subunit
  misc_feature (106)..(106): Xaa is any aa, unknown, or other
MASPDLLFNLRNLFYLGAYQAAINNSDVPGLDADAAAERDAIVFRSYIALGSYQLVISEIDSSAATSLQAVKLLALYLTGDKEGAISSLKEWLSDSAIESNPGSAXDC

SEQ ID NO: 23340 - DNA, 658 bp, Zea mays
  misc_feature: Ceres CLONE 1393536-F
  misc_feature: Encodes the peptide sequence at SEQ ID NO. 23341
tccccgcggtggcggccgctctagaactagtggatcccccgggctgcaggaattcgcacgagaccattacctagaacatcctaatcgaaaaacctcaggcctcgctcagatctctccgcccgggtccatcttcccaccccaaaccttctcccgcctctctcgacaacgccgcccgacgagagggatggcggccttgcgggctccgggcgcaacgctcctcgtcctcctcgccctagagacggccggcggcgtggcggacgacggctccgatcaccggtacaagattcgcgagaccgtcccgctctacgcctacaaggacggaccatttcacaatcgcagtgaaacatatcgatatttcgacctgtctttctgctctcctgacaaagtgaaggacaagagcgaggccctttgtggggagttctcaatggggggatcggttagttgatgcgccttacaagcttgattgccggggacggaagttgagtcccagggcagcttgctcagagaagcttactacagaggtggggaagggaccttcgggagtgcaggggctaaggactactacctccagatggactatgatgatctccccactgaggcgcttcctcggaaaagttgaggaaggcggcaagggagatccgaggggggggggaaaata

SEQ ID NO: 23341 - protein, 86 aa, Zea mays
  misc_feature: Ceres CLONE 1393536-F
MAALRAPGATLLVLLALETAGGVADDGSDHRYKIRETVPLYAYKDGPFHNRSETYRYFDLSFCSPDKVKDKSEALCGEFSMGGSVS

SEQ ID NO: 23342 - DNA, 639 bp, Zea mays
  misc_feature: Ceres CLONE 1393537-F
  misc_feature: Encodes the peptide sequence at SEQ ID NO. 23343
  misc_feature (396)..(396): n is a, c, t, g, unknown, or other
tggagctccccgcggtggcggccgctctagaactagtggatcccccgggctgcaggaattcgcacgagaccattacctagaacatcctaatcgaaaaaggattgttgaaaaaaaactaggtcttccactcttcctccactagtctactcggcagatttcactgactctcaccggcggtctttgtgcctccaccggccgccgccatgccgtacctcgtccgcgagcggctctacttcggcggcatcaaagacgccattgccgccctcacggagtcttcctccacgccggacttcacccacgtcctctccgtggtcagttccgcctccatctccttcatcaccgattgccgcccgggcctcgagatccccaccgaggaggtcctccgcgtagtcgccnggcgaggagggcgcggacgaacctggccgcggtttccccggggacgctgaatggcgggtggtggaagcgcgccgggcaacggggctgcgggtcacgccgcatggccagtgccgctgcgggaccacccgaggaggagggacctgctcgaccgccctcgagcccctgccttgagttcatcgatgaggggcaggaaaggtcgggaaatggcctcgtccattgcttttgcctgggatggtccagcag

SEQ ID NO: 23343 - protein, 80 aa, Zea mays
  misc_feature: Ceres CLONE 1393537-F
  misc_feature (65)..(65): Xaa is any aa, unknown, or other
MPYLVRERLYFGGIKDAIAALTESSSTPDFTHVLSVVSSASISFITDCRPGLEIPTEEVLRVVAXRGGRGRTWPRFPRGR

SEQ ID NO: 23344 - DNA, 659 bp, Zea mays
  misc_feature: Ceres CLONE 1393540-F
  misc_feature (438)..(438): n is a, c, t, g, unknown, or other
  misc_feature (445)..(445): n is a, c, t, g, unknown, or other
  misc_feature (527)..(527): n is a, c, t, g, unknown, or other
  misc_feature (659)..(659): n is a, c, t, g, unknown, or other
tggagctccccgcggtggcggccgctctagaactagtggatcccccgggctgcaggaattcgcacgagaccattacctagaacatcctaatcgaaaaactgtactactacaattattgatttcttcctcaacttgcttgctaaggatgtcaacttactacacgggcggccgaaaccctagcgccgccgccccctccctccactccatcccacctcgccgtcaccagagggcgccgccggatgtccgcgcggccccaaggaaggtggcggcgaggcgatttttctctggtttggtcgcgtctgcccggatctagtcgggttccaggaggtggcagcggcgtggtgtggggcggcgacccttcgccggcgcggctcagcctcggcggcatcctggcggcagggagcgcgacgttcgtatggcacatccgggcgttgcggntcctggnatgggtgttcgcgcagcaggggggcatgcggcccggcgtgggtcgcagccgcggagaagggtgctgtctggcgcccccaggncagggagcggcgccgcgcgtggaggtctggaatctagtgggggggggggtccgcggcctccgcgtgccagccttcggaggcggcgacaggttggtcccggcaatgtggccggggtggtgttcagcgtggtan

SEQ ID NO: 23345 - DNA, 652 bp, Zea mays
  misc_feature: Ceres CLONE 1393542-F
  misc_feature: Encodes the peptide sequence at SEQ ID NO. 23346
  misc_feature (477)..(477): n is a, c, t, g, unknown, or other
  misc_feature (525)..(525): n is a, c, t, g, unknown, or other
  misc_feature (528)..(528): n is a, c, t, g, unknown, or other
  misc_feature (531)..(531): n is a, c, t, g, unknown, or other
  misc_feature (598)..(598): n is a, c, t, g, unknown, or other
  misc_feature (628)..(628): n is a, c, t, g, unknown, or other
  misc_feature (646)..(646): n is a, c, t, g, unknown, or other
  misc_feature (649)..(649): n is a, c, t, g, unknown, or other
aagctggagctccccgcggtggcggccgctctagaactagtggatcccccgggctgcaggaattcgcacgagaccattacctagaacatcctaatcgaaaaataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcatcgtgggcggcggcacggccgggtgcccgctggccgccacgctgtcggagcgcttccgcgtgctgctgctggagcgcggcgcctcgccctacgacgagacccgcatcggggacatggcccgcttcgcggacacgctgtcggacacctccccgggctcgcccggcagcgcttccntgtcggaaggacggcgtcatcaactcgcggccggcggggtgcctgggncgncgncagctgcatcaaacgccggctttctacacggcgggccagcgacgactaacgtgcggggccggccggntgggaacctggggcgcccgcccggggcggncgaaccgggggggggggnggnacg

SEQ ID NO: 23346 - protein, 166 aa, Zea mays
  misc_feature: Ceres CLONE 1393542-F
  misc_feature: SWISSPROT Homolog: EC 4.1.2.10 Mandelonitrile lyase
  misc_feature (111)..(111): Xaa is any aa, unknown, or other
  misc_feature (127)..(127): Xaa is any aa, unknown, or other
  misc_feature (128)..(128): Xaa is any aa, unknown, or other
  misc_feature (129)..(129): Xaa is any aa, unknown, or other
  misc_feature (151)..(151): Xaa is any aa, unknown, or other
  misc_feature (161)..(161): Xaa is any aa, unknown, or other
MSGRSRHFTMSTLLATSFFFVLLCSSLQVRGVNYTFVKDAALAPSVSYYDYIIVGGGTAGCPLAATLSERFRVLLLERGASPYDETRIGDMARFADTLSDTSPGSPGSASXSEGRRHQLAAGGVPGXXXAASNAGFLHGGPATTNVRGRPXGNLGRPPGAXEPGGG

SEQ ID NO: 23347 - DNA, 666 bp, Zea mays
  misc_feature: Ceres CLONE 1393543-F
  misc_feature: Encodes the peptide sequence at SEQ ID NO. 23348
tggagctccccgcggtggcggccgctctagaactagtggatcccccgggctgcaggaattcgcacgagaccattacctagaacatcctaatcgaaaaagtgtgagagctcgattcgttgccgtccacttgtctcacggcctgtcgccatctccttcctggttttttcatccgaccatccccggctcctccgcgccgtcggcgacgactccatcgagtcactcggccgcagcaaccggcgaccatgtaccgagtcgcctccgggctcggcgccctcaagaggcatggggcaaatgctcaaatgatgaatgctgcaattaggtgtgccagcacaagtgttgcacagaggtcttccggtggattgtggacctgcttgactggtgcgcgttcaaatgaaataccctcttccagatttcacacttccgggagtgactattcctcctccgctgcctgaccatgtggagggtggcaaaaaagagtcacaacacttcccaatggtgtaaaatagcctctgagacatctgcgggatcatcttggttctgttggaatttatggttgatgggggctcctggatatgaaccacctggaaacaacaggggccagtcaaatggttgaagaaaatggcctttcacaacccctgcccaaaaggaggtgatttggtttggccc

SEQ ID NO: 23348 - protein, 69 aa, Zea mays
  misc_feature: Ceres CLONE 1393543-F
MYRVASGLGALKRHGANAQMMNAAIRCASTSVAQRSSGGLWTCLTGARSNEIPSSRFHTSGSDYSSSAA

SEQ ID NO: 23349 - DNA, 662 bp, Zea mays
  misc_feature: Ceres CLONE 1393546-F
  misc_feature: Encodes the peptide sequence at SEQ ID NO. 23350
  misc_feature (507)..(507): n is a, c, t, g, unknown, or other
  misc_feature (610)..(610): n is a, c, t, g, unknown, or other
tggagctccccgcggtggcggccgctctagaactagtggatcccccgggctgcaggaattcgcacgagaccattacctagaacatcctaatcgaaaagaggatatgtttccctcaccttcgaccaccactaacctctgcatccgcatctctctctctcgcgcgcgccgcccttcccagcgccgtcggctgccgctcctcccctccaccgccgcctctgctccgcccgtcctcgcgccgtcgcgaccgctgcggcttcgtctctccccattgtctgtcccctctcaacgcactctacgacggaccgatgacttgacggatctgggggtttgtctagggtgggtgaacggaaggggatggagttcacggagtcgttcaagaagacgggcccgtgctccttctcccccgactcgcgcttccttgctattgccgtagactaccgcctcgtcgtccgcgacgtaactctcactgaaggtggtacaattattttcatgcgtggacaagataangctctgtagaatgggcaccagattcagaatatattgttatgtggactttacaagcgacccatggtgcaagcttggtcattgagccaacctgattggaccgcangaaatgatgaaggtcccagcagggattgatatggctcgctggagtccctgac

SEQ ID NO: 23350 - protein, 53 aa, Zea mays
  misc_feature: Ceres CLONE 1393546-F
  misc_feature (51)..(51): Xaa is any aa, unknown, or other
MEFTESFKKTGPCSFSPDSRFLAIAVDYRLVVRDVTLTEGGTIIFMRGQDXAL

SEQ ID NO: 23351 - DNA, 679 bp, Zea mays
  misc_feature: Ceres CLONE 1393547-F
  misc_feature (360)..(360): n is a, c, t, g, unknown, or other
tggagctccccgcggtggcggccgctctagaactagtggatcccccgggctgcaggaattcgcacgagaccattacctagaacatcctaatcgaaaagaggatatgtttccctcaccttcgaccaccactaacctctgcatccgcatctctctctctcgcgcgcgccgcccttcccagcgccgtcggctgccgctcctcccctccaccgccgcctctgctccgcccgtcctcgcgccgtcgcgaccgctgcggcttcgtctctccccattgtctgtcccctctcaacgcactctacgacggaccgatgacttgacggatctgggggtttgtctagggtgggtgaacgaaggggatgaagntcacgaagtcgttcaggagacgggcccgtgttcctctccccgaaatcgggttcttggtattgcggaaataaccgctggccgccgggagaaaccccccggagggggaaaattattttcgggggggaaaaaaaaatcttctaaaaggggccccaaataaaaaaaattttttgggggctttaaaaaacccccccgggggaaaattttgtttttgacaccaccctattggccccccgaaaaaataaagacacccccccggggtttttctctctccgcccgtgggggccccaaagaaccccaaataaaaaaacacacggtgggg

SEQ ID NO: 23352 - DNA, 699 bp, Zea mays
  misc_feature: Ceres CLONE 1393550-F
  misc_feature: Encodes the peptide sequence at SEQ ID NO. 23353
  misc_feature (324)..(324): n is a, c, t, g, unknown, or other
  misc_feature (410)..(410): n is a, c, t, g, unknown, or other
  misc_feature (416)..(416): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (447)..(447): n is a, c, t, g, unknown, or other
  misc_feature (448)..(448): n is a, c, t, g, unknown, or other
  misc_feature (452)..(452): n is a, c, t, g, unknown, or other
  misc_feature (457)..(457): n is a, c, t, g, unknown, or other
  misc_feature (458)..(458): n is a, c, t, g, unknown, or other
  misc_feature (470)..(470): n is a, c, t, g, unknown, or other
aagctggagctccccgcggtggcggccgctctagaactagtggatcccccgggctgcaggaattcgcacgagaccattacctagaacatcctaatcgaaaagatcacacactcgactctcctctctcgcatccgcagcctctcgagctctactccatcccctcgatctcgaagcgcagcagcagcagtcaggcggccatggacgcgagcgcagccggagccggcgggaaggcgaagaagggcgcggccgggcgcaaggccggcgggccgaggaagaagtcggtgacgaggtccgtcaaggccgggctggcagtttcccgtcggncggcatcgggcggtacctggaagaagggccggtacgcgcagcgcgtcggcacggggcgcccccgtctaccctgggccggccgtccntcgagntactggnnnncgccggagggtggctggaagnntggnccggnnaaaggctgcccnaggacaaacaagaaggaccgggatcattcccggggcaagggggtccttggcatccgcaaaggacgagggagctcggaaaaagtggttggtccggggggccccatcggcccaagggggggggggccccccccaaatttaaaccggggggtccgggcccaaaaaaaaccgggggaaaaggggggcgccaaaagagggggcaatcccccccaaaggggggcgcccgcgcccc

SEQ ID NO: 23353 - protein, 167 aa, Zea mays
  misc_feature: Ceres CLONE 1393550-F
  misc_feature (43)..(43): Xaa is any aa, unknown, or other
  misc_feature (73)..(73): Xaa is any aa, unknown, or other
  misc_feature (76)..(76): Xaa is any aa, unknown, or other
  misc_feature (77)..(77): Xaa is any aa, unknown, or other
  misc_feature (84)..(84): Xaa is any aa, unknown, or other
  misc_feature (87)..(87): Xaa is any aa, unknown, or other
MDASAAGAGGKAKKGAAGRKAGGPRKKSVTRSVKAGLAVSRRXASGGTWKKGRYAQRVGTGRPRLPWAGRPSXYWXXPEGGWKXGPXKGCPRTNKKDRDHSRGKGVLGIRKGRGSSEKVVGPGGPIGPRGGGPPPNLNRGVRAQKKPGEKGGAKRGGNPPQRGAPAP

SEQ ID NO: 23354 - DNA, 609 bp, Zea mays
  misc_feature: Ceres CLONE 1393552-F
  misc_feature: Encodes the peptide sequence at SEQ ID NO. 23355
ccaccgcggtggcggccgctctagaactagtggatcccccgggctgcaggaattcgcacgagaccattacctagaacatcctaatcgaaaaaaactcacagcacaaacgttcctctcctcttccatcgtcgtcctcgctcccggccccgcctgtctagtctagtcccctcttctcgcgtgcaacccctgtactgtacgtgctaggcacacagctttagctgcagcctaccggcaagggcaagcaaaaaggggtttttctgggggggggggtcccttgggggggggaaacgcgggggggggggaaaaaaacaaggggaagaggcccccccagaattttttcccggggggaaacccccccccgggggaaaaaaaattttttaaaaaaccccccgcggtgttttttttttttttttccccccccccccccctttttttttttcccttctggggggaaaaaaaaaaaaatttttttgtggttaaacaccccccccggccggggggggggggccccctctatttctctctccgtgttctttcttctcctccacaaaaaacaacccaccggggggggggcgggaaaaaaaaacccccccacccccccgccggggg

SEQ ID NO: 23355 - protein, 53 aa, Zea mays
  misc_feature: Ceres CLONE 1393552-F
HRGGGRSRTSGSPGLQEFARDHYLEHPNRKKLTAQTFLSSSIVVLAPGPACLV

SEQ ID NO: 23356 - DNA, 658 bp, Zea mays
  misc_feature: Ceres CLONE 1393560-F
  misc_feature: Translation starting site: 462
  misc_feature: SWISSPROT Homolog: EC 2.7.11.1 Non-specific serine/threonine protein kinase
  misc_feature (384)..(384): n is a, c, t, g, unknown, or other
  misc_feature (391)..(391): n is a, c, t, g, unknown, or other
  misc_feature (392)..(392): n is a, c, t, g, unknown, or other
  misc_feature (406)..(406): n is a, c, t, g, unknown, or other
  misc_feature (407)..(407): n is a, c, t, g, unknown, or other
  misc_feature (419)..(419): n is a, c, t, g, unknown, or other
  misc_feature (436)..(436): n is a, c, t, g, unknown, or other
  misc_feature (458)..(458): n is a, c, t, g, unknown, or other
  misc_feature (461)..(461): n is a, c, t, g, unknown, or other
  misc_feature (524)..(524): n is a, c, t, g, unknown, or other
aagctggagctccccgcggtggcggccgctctagaactagtggatcccccgggctgcaggaattcgcacgagaccattacctagaacatcctaatcaaaaaaatcgatcagtcgcgtgtctaggtttcctctctcaccatagcgcccgctctgtcgcccttcgttcacctctccttcctctcgtccctgcctgccagggagaggggaagtcagaggcacggagtggcgcagagcagacgcccgtgaaccattgtagctgtccctgtcgtcgtcgtcgtcaacgaacccacacaaggaaaggatggagaagaagccgaccatcctcatgaacaggtacgagctcgggcgcacgctcgggcagggcaccttcgccaaggtgtaccnacggcgnnaacctcgcgtccgnncgagagcgtggncatcaaggtcatcgacnaggaagagggtgatgcgcgtcnggnatgatcgaccagatcaagcgggagatctccggtcagggggccttggctcgccacccccaaaanctttgggatttgcccggggggtgggccccaaaaggaaaaattaatttcccctggggaaactcccgggggggggaatttttttccccgggggcccggggggggggttaaggggggcccccccgagaaaaatatca

SEQ ID NO: 23357 - DNA, 680 bp, Zea mays
  misc_feature: Ceres CLONE 1393561-F
  misc_feature: Encodes the peptide sequence at SEQ ID NO. 23358
aaagctggagctcaccgcggtggcggccgctctatgactagtggatcccccgggctgcaggaattcgcacgagaccattacctagaacatcctaatcgaaaaaccaccaagtggacgcagcagctttaaccccccaaagcctcgacgccgcgagcacagctccgccgccaccgcccccttctcatccgcggtctccgccgcctgctgcatctctatcgatctagcgggactgcctccttcccgtgctgggtccttcgtcaatcgtcagcgcgcaagatcggcacttgtgcccatctgaccagttcccgccgccctactcccggcgggggggttggcggtcaataggtcgatttggggccctaagggcacctgcacggggcggcgtccccccgccactctcccatttcttccccccctccggtggcgcgcccccccgccgcgcatcccccgcgtaccgttccgccccccccccccccgcgccgccccatcccctcccccgcgtcggctcggcccccaccccacccgcgccggcacctggcgccccgtccccatcccccccccccccccaccccgggcgcttcccccctcccccgcggggggccggccgctgaaacagcccgcccacgcggcgaccaccaccctgcccactccccccctccctcccaccggagccccccccg

SEQ ID NO: 23358 - protein, 31 aa, Zea mays
  misc_feature: Ceres CLONE 1393561-F
MTSGSPGLQEFARDHYLEHPNRKTTKWTQQL

SEQ ID NO: 23359 - DNA, 677 bp, Zea mays
  misc_feature: Ceres CLONE 1393563-F
  misc_feature: Encodes the peptide sequence at SEQ ID NO. 23360
  misc_feature (196)..(196): n is a, c, t, g, unknown, or other
  misc_feature (246)..(246): n is a, c, t, g, unknown, or other
tagctggagctccccgcggtggcggccgctctagaactagtggatcccccgggctgcaggaattcgcacgagaccattacctagaacatcctaatcgaaaactcggcagagtccagtccctcgtgcatctcggcctctccactctcctttccacgcccgtccagtcctctaatctgacccctcttctccagccggncggagatggtctcgctgcgatgcacaaccgcgcaccactccctcctcggntcgccgacctgcctcgcgcgcccgcggcggcggacgtgccccgtcgtgcgcgctgccgtcgccgtgaaggccggcgcgcaggccaaggtctcactcatccgaattggtactcgcgccacccctcgggggggggcgggatcccacgaaaatccagaaaaactgaaagccacaccctctgagtaagctgaggagagggccatcgagacccgcattttaaagaccccacgagacatggattttggacaatctccctcgccccctctggacgaaggggttcattcaccagggcgagcaatcggtggcccccccgcaggaaaagggctcaaaaacccccgggagtccaaacgaaaacccctccccccacatctgccccctgaaggcgtgtggtggggggtgaaagggcagccgcgagccaatgctcccaccgggcg

SEQ ID NO: 23360 - protein, 75 aa, Zea mays
  misc_feature: Ceres CLONE 1393563-F
MVSLRCTTAHHSLLGSPTCLARPRRRTCPVVRAAVAVKAGAQAKVSLIRIGTRATPRGGAGSHENPEKLKATPSE

SEQ ID NO: 23361 - DNA, 679 bp, Zea mays
  misc_feature: Ceres CLONE 1393566-F
  misc_feature: Encodes the peptide sequence at SEQ ID NO. 23362
  misc_feature (365)..(365): n is a, c, t, g, unknown, or other
  misc_feature (378)..(378): n is a, c, t, g, unknown, or other
aaagctggagctccgcggcggcggccgctctactactagaggatcccccgccgctgcaggaattcttacgagaccattacctacaagatcctaatcgaaaaaaccgacttccagttccactctcgcttccttccctccctccctcccacgcaaatggtggccgctcgcctccgcctcgcgctgctactctccgtctgcctctgctccgcgtgggcgcgcccacgcctcgagacggccatccgcctgccgtcgcagcgcgcggcggcggccgacgaaacggacgacggcgccgtcgggacccgctgggctgtgctcatcgcaggctccagcggctactacaactaccgccacccagcggacatctngcatgcataccanatcatgaagaagggcggactcaaggatgagaacatcattgtcttcatgtacgatgacatcgcgcatagcccggagaatccgaaggctggtgtcatcatcacccatcccaggggtggcgacgtctaatgctggggggcaaaaggattacactggggggaaaaggcaacgttcaaaattttcttcccttgtcttgtttgacaaaaaaactgcttctaaggggggggaatccccaaagggttgtgaacggcggccccaaagaacaaaatcttttgttttcaacaggggaacatgggggggtccc

SEQ ID NO: 23362 - protein, 116 aa, Zea mays
  misc_feature: Ceres CLONE 1393566-F
  misc_feature (50)..(117): Pfam Name: Peptidase_C13 Pfam Description: Peptidase C13 family
  misc_feature: SWISSPROT Homolog: EC 3.4.22.34 Legumain
  misc_feature (71)..(71): Xaa is any aa, unknown, or other
  misc_feature (75)..(75): Xaa is any aa, unknown, or other
MVAARLRLALLLSVCLCSAWARPRLETAIRLPSQRAAAADETDDGAVGTRWAVLIAGSSGYYNYRHPADIXHAYXIMKKGGLKDENIIVFMYDDIAHSPENPKAGVIITHPRGGDV

SEQ ID NO: 23363 - DNA, 678 bp, Zea mays
  misc_feature: Ceres CLONE 1393568-F
  misc_feature: Encodes the peptide sequence at SEQ ID NO. 23364
  misc_feature (416)..(416): n is a, c, t, g, unknown, or other
  misc_feature (434)..(434): n is a, c, t, g, unknown, or other
  misc_feature (471)..(471): n is a, c, t, g, unknown, or other
  misc_feature (506)..(506): n is a, c, t, g, unknown, or other
  misc_feature (595)..(595): n is a, c, t, g, unknown, or other
  misc_feature (623)..(623): n is a, c, t, g, unknown, or other
  misc_feature (658)..(658): n is a, c, t, g, unknown, or other
aaagctggagctccccgcggtggcggccgctctagaactagtggatcccccgggctgcaggaattcgcacgagaccattacctagaacatcctaatcaaaaaacaagcaaacctgcagtcatctcctccatcaccaccaaactcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaaaaagatccaggacgacttctgctcgacgctgtgcgagggcaagaaggggacggacctggtcgtgtgcaaggagtcctgcgcgctctcccagagtccaacctggtggctgtacgncaggatccagtgcaaggncaaagtgcaccgagcagaagggatccacggcgccggncccatgaaggtctgcccaggaggagtgcgaccagncgtacgttggtgaaaggcggccgaaggtccacaaagggctgcagcgtcacctgcgcccaaggagaagaacccgcgcctcagcgaaaaantggaaagagggtctgccacccctctccnttcttgaggccctttgaaatgaatgaaccatgcangcgctgagcgaggtctatac

SEQ ID NO: 23364 - protein, 116 aa, Zea mays
  misc_feature: Ceres CLONE 1393568-F
  misc_feature (83)..(83): Xaa is any aa, unknown, or other
  misc_feature (89)..(89): Xaa is any aa, unknown, or other
  misc_feature (113)..(113): Xaa is any aa, unknown, or other
MKSRSMASSAALLVLALALVAATAPQVAEAKKKRAAESGEAAEAKKIQDDFCSTLCEGKKGTDLVVCKESCALSQSPTWWLYXRIQCKXKVHRAEGIHGAGPMKVCPGGVRPXVRW

SEQ ID NO: 23365 - DNA, 666 bp, Zea mays
  misc_feature: Ceres CLONE 1393569-F
  misc_feature: Encodes the peptide sequence at SEQ ID NO. 23366
  misc_feature (387)..(387): n is a, c, t, g, unknown, or other
  misc_feature (456)..(456): n is a, c, t, g, unknown, or other
  misc_feature (477)..(477): n is a, c, t, g, unknown, or other
  misc_feature (485)..(485): n is a, c, t, g, unknown, or other
  misc_feature (486)..(486): n is a, c, t, g, unknown, or other
  misc_feature (559)..(559): n is a, c, t, g, unknown, or other
  misc_feature (560)..(560): n is a, c, t, g, unknown, or other
  misc_feature (568)..(568): n is a, c, t, g, unknown, or other
  misc_feature (610)..(610): n is a, c, t, g, unknown, or other
  misc_feature (633)..(633): n is a, c, t, g, unknown, or other
  misc_feature (634)..(634): n is a, c, t, g, unknown, or other
  misc_feature (636)..(636): n is a, c, t, g, unknown, or other
  misc_feature (637)..(637): n is a, c, t, g, unknown, or other
  misc_feature (640)..(640): n is a, c, t, g, unknown, or other
tccccgcggtggcggccgctctagaactagtggatcccccgggctgcaggaattcgcacgagaccattacctagaacatcctaatcgaaaaataccactccacaatcacacatttgacaccgccaatccatggccttggcgacgccgctgcggctccgccgccacctcctcctccccgccgggccgtccccggcgacccaccgcgccctgtcgctgcggcggggccgcctcctccccgcaagcctgtcgtccgccgcggcgggcgggcggccgacggtgctggtgacggagacgctgggttccgcggggctggacctgctgcgcgccttcgccaacgtggactgctcctacgagctgacggcggaggagctccgcgccaaggtgtcnctcgtggacgcgctggtggtgcgcagcggaacgcagggtgacgcgggaggtgttcgaaggcgcgcgcgncaggctccgggtcggcgggcngcgccggnntttccttcggccatgtggatctccgcggcggcccccgaatctgtttgcctcctccgcttcgcgccccctgccnncccgggcncccccctctgaggtgccccggtcgccccgcccccggcggggnctcgccttttcgctcctggccgnngnngcnggggttggcccagtaaatgcgggggg

SEQ ID NO: 23366 - protein, 149 aa, Zea mays
  misc_feature: Ceres CLONE 1393569-F
  misc_feature: SWISSPROT Homolog: EC 1.1.1.95 Phosphoglycerate dehydrogenase
  misc_feature (119)..(119): Xaa is any aa, unknown, or other
  misc_feature (144)..(144): Xaa is any aa, unknown, or other
  misc_feature (147)..(147): Xaa is any aa, unknown, or other
MALATPLRLRRHLLLPAGPSPATHRALSLRRGRLLPASLSSAAAGGRPTVLVTETLGSAGLDLLRAFANVDCSYELTAEELRAKVSLVDALVVRSGTQGDAGGVRRRARQAPGRRAAPXFPSAMWISAAAPESVCLLRFAPPAXPGXPL

SEQ ID NO: 23367 - DNA, 690 bp, Zea mays
  misc_feature: Ceres CLONE 1393571-F
  misc_feature (328)..(328): n is a, c, t, g, unknown, or other
  misc_feature (399)..(399): n is a, c, t, g, unknown, or other
  misc_feature (505)..(505): n is a, c, t, g, unknown, or other
  misc_feature (550)..(550): n is a, c, t, g, unknown, or other
  misc_feature (571)..(571): n is a, c, t, g, unknown, or other
  misc_feature (598)..(598): n is a, c, t, g, unknown, or other
  misc_feature (599)..(599): n is a, c, t, g, unknown, or other
  misc_feature (638)..(638): n is a, c, t, g, unknown, or other
  misc_feature (657)..(657): n is a, c, t, g, unknown, or other
aaagctggagctccccgcggtggcggccgctctagaactagtggatcccccgggctgcaggaattcgcacgagaccattacctagaacatcctaatcgaaaacattaattaacctctctccttcctcgccccttcccctccacgactccactaccaccaccttcaccttgtctcccacaaccgccgcgcgcaagccctagcccgatctcgccggcgacagacaccagatctcgccgcccgttgcgcgccgatacgcgccccgccggattcaccgctcctcgcgctgcagcacgcccgggcctgggttactgcgtgacatgtagtattngtataattggaggttgtcaccatcaccacaaagcatatgttgtgatttgtcgatggcgaggagatgaaacnaggtgtaggggcggagcagcaaggacatgacagccatgccgcatccgcgccaccgaggcgctgctaagaagcccatgtggatcataagggctattggcctttgggntttgtgttgcgacttatggggggcctatgtctacccaccacggcngctactccgcatgctacttcnttggctttccgagtggctgtactcggnntttcagggattggctaacctggctgttggctcgtgagcngaactgatgaaagagaagntttttcatccgtgggggaatattaaagggaact

SEQ ID NO: 23368 - DNA, 695 bp, Zea mays
  misc_feature: Ceres CLONE 1393572-F
  misc_feature: Encodes the peptide sequence at SEQ ID NO. 23369
  misc_feature (390)..(390): n is a, c, t, g, unknown, or other
  misc_feature (399)..(399): n is a, c, t, g, unknown, or other
  misc_feature (402)..(402): n is a, c, t, g, unknown, or other
  misc_feature (466)..(466): n is a, c, t, g, unknown, or other
  misc_feature (472)..(472): n is a, c, t, g, unknown, or other
  misc_feature (525)..(525): n is a, c, t, g, unknown, or other
  misc_feature (536)..(536): n is a, c, t, g, unknown, or other
  misc_feature (564)..(564): n is a, c, t, g, unknown, or other
  misc_feature (581)..(581): n is a, c, t, g, unknown, or other
  misc_feature (679)..(679): n is a, c, t, g, unknown, or other
tggagctccccgcggtggcggccgctctagaactagtggatcccccgggctgcaggaattcgcacgagaccattacctagaactcctaatcgaaaaaaatccaagtaaggaaatccccgatgatctcctgcgcgtcgcagcgccagccactcgattagtggagtccaccaaccaagcacgcgtccctccccgtcccagatcccatcccgcggcagccggtcagtccgatccatctccagtacccagcccgtcacccgccttccccgttcgctctcgtcggcgcgcgatggagggtctcatcaaggggttggtccacgtggccatcgacgccgtggaggacgccgtgagggagagggaccacggccgcgccgacgacgacgaggtgccganggaggaggncgncccaaagctccgatccagatgacgacgggggaggaggaacgcgacgaacgatcgcgggtcgagntggggnccgaggtcgtctcccgagcagaaagggcatgcgatcccggacgagcgcccggnaccatcgaagncttcggtgcggtacaaatcgccatgagnaggagttatggacgagnttttggaaaaaggggccaatgggtcggaaacaatcagcaagcaccacgcagggccggtagaacaggtggttaggggggaggaaaagggtgggaatggncattggcaacccggag

SEQ ID NO: 23369 - protein, 45 aa, Zea mays
  misc_feature: Ceres CLONE 1393572-F
  misc_feature (35)..(35): Xaa is any aa, unknown, or other
  misc_feature (38)..(38): Xaa is any aa, unknown, or other
  misc_feature (39)..(39): Xaa is any aa, unknown, or other
MEGLIKGLVHVAIDAVEDAVRERDHGRADDDEVPXEEXXPKLRSR

SEQ ID NO: 23370 - DNA, 669 bp, Zea mays
  misc_feature: Ceres CLONE 1393574-F
  misc_feature: Encodes the peptide sequence at SEQ ID NO. 23371
  misc_feature (266)..(266): n is a, c, t, g, unknown, or other
  misc_feature (384)..(384): n is a, c, t, g, unknown, or other
  misc_feature (395)..(395): n is a, c, t, g, unknown, or other
  misc_feature (550)..(550): n is a, c, t, g, unknown, or other
  misc_feature (551)..(551): n is a, c, t, g, unknown, or other
aaagctggagctccccgcggtggcggccgctctagaactagtggatcccccgggctgcaggaattcgcacgagaccattacctagaacatcctaatcgaaaaacaacatctgtcaccgtgaaatctcggctacctccttctgacttctggtacctcgccgccggggacccaactccgatccccaccccaccataccaaagccaccgcggctgcggctgcggcttccgcatcatcaatggtgctgatcactctcgtccgcgactacntcgaccgcatgctccacgacatccctgggcatgaaggtcctcgtcctcgacccccaaacccgttgggatgggtgagcgtggtgtacagccagtcggatctgctggcggaaaggaggtncttcctcgtcngagaccatggacaacgcctccagcctccaggggagtccatggcgcaccctcaagggccgtctacttcctccgaccctccgctaacaacgtccagaaagctccgcaggcacctcgccatgccgcgccttcgccgagtaccacctattcttctccgnnaatattgaaggtcccgcagattcaaatacttgctgactcggatgaaacaggaggttgtgcagcaaggtcaggagttctattgctgatttttgggccattgacccataccatttcactc

SEQ ID NO: 23371 - protein, 107 aa, Zea mays
  misc_feature: Ceres CLONE 1393574-F
  misc_feature (11)..(11): Xaa is any aa, unknown, or other
  misc_feature (50)..(50): Xaa is any aa, unknown, or other
  misc_feature (54)..(54): Xaa is any aa, unknown, or other
  misc_feature (106)..(106): Xaa is any aa, unknown, or other
MVLITLVRDYXDRMLHDIPGHEGPRPRPPNPLGWVSVVYSQSDLLAERRXFLVXDHGQRLQPPGESMAHPQGPSTSSDPPLTTSRKLRRHLAMPRLRRVPPILLRXY

SEQ ID NO: 23372 - DNA, 741 bp, Zea mays
  misc_feature: Ceres CLONE 1393575-F
  misc_feature: Encodes the peptide sequence at SEQ ID NO. 23373
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
gggggggggttttttttnnnnnnccactccccctaaannnnnaccacnnnnncaagctggggctccccgcggtggcggccgctctataactagtggatcccccgggctgcaggaattcgcacgagaccattacctagaacatcctaatcgaaaacgccgcgctcgaggtgctgcctcccgggctcccgtttcagcattctcggatcgcatcgaacagcctggccccgaccgctccgacccttctcggcgacactcctcgtaggctcggactgccacgtccccgctctgtcttctgcccaccaggcaccagcgggtccacgcttccaagggtaccaaactctcgcgcggcgcaagcaatggaggcgcggggtcgggagctctggtagcttcgcatatcgcggaggctagttgccacctcgcccatcgaagattatggggatcaccggcgaggagtgggaggagacggtactgcgcgacggcgctgggaggcggaagggtggtgctgaggcttccgcgttaggcgcctcatcctcctttgctgaggggatggcggaaattcggggtgacggctatgggacgccggcttctccgggatgggcgccggcgcacggagttctatggcctccgttcgggcaagccaggaatttcggccatgacgaaggtcgaaagggtagctactttctgggaccgtattgaagggcggccaggcataaagccgttccttgcgccaagaccattagg

SEQ ID NO: 23373 - protein, 87 aa, Zea mays
  misc_feature: Ceres CLONE 1393575-F
MGITGEEWEETVLRDGAGRRKGGAEASALGASSSFAEGMAEIRGDGYGTPASPGWAPAHGVLWPPFGQARNFGHDEGRKGSYFLGPY

SEQ ID NO: 23374 - DNA, 627 bp, Zea mays
  misc_feature: Ceres CLONE 1393576-F
gctctagaactagtggatcccccgggctgcaggaattcgcacgagaccattacctagaacatcctaatcgaaaaatcgagctctctctactgataatactggctgcagttgcgctgtgcctgtgcttccagcctgcatcgctttcccctcctccccaatccccactcgcagatgcgagttccctctcgttccgccacatcgccgagcttagccaggtcagacggcggacatcgccaccgcaatgccgaccgcgtcgagaggatgacggagcgtcaagaggttggcacggcagatacacgccccggggggaaaactgcagcagaattgttgtggaaaggggggctccgggggggggtattgacggacggttgggaggggaggtgggggggggtggggatgggtagagggggggggtgggggggggaggggggggcgggggggagcggggggggggggcgggggcgccgccctccggacgcgcgggccgagcgcgggggggccgcgcgggggcgggaggggggtgggcgcggcctcggcagcaggagcgccgaccggctgggggggggggggggtgtgcgcccgccccgcgccgggggcggaggggggagggggggcggccctgcgggg

SEQ ID NO: 23375 - DNA, 648 bp, Zea mays
  misc_feature: Ceres CLONE 1393577-F
  misc_feature (352)..(352): n is a, c, t, g, unknown, or other
  misc_feature (353)..(353): n is a, c, t, g, unknown, or other
  misc_feature (496)..(496): n is a, c, t, g, unknown, or other
  misc_feature (546)..(546): n is a, c, t, g, unknown, or other
  misc_feature (553)..(553): n is a, c, t, g, unknown, or other
  misc_feature (563)..(563): n is a, c, t, g, unknown, or other
tggagctccccgcggtggcggccgctctagaactagtggatcccccgggctgcaggaattcgcacgagaccattacctagaacatcctaatcgaaaaagaaaatcctggctcgtgcgatgcgacctcttggctctcgctaggttgtatgtgtgtgtgtgtttaaaagcctaatctaccgcaccagcggcctctagtgtctcctcctcctctatccctcgcaaagcaaacacacacgcgctttctcggtgccaccaccagcagcaccccgtctccgtcccggcccccgacgcccggcgggacatgaagaaagacgaggagggcgccaatgccaccgtcgccggcgacgggacnncacgacgacgttccgcgctccccgtccgcctggctgccgctcgggtgacggtgacccctacctagctctctccttcgcctcgccttcgtgagtcgccgtccttcttgcctctatggagcgagctcggcgtcgcccgttaccgntccgtcgtggtgcaaaccagcggctcagcgggattgaggggagccctggnggcgaanaaaggcgtcntacgtgtccttggggatgggtgccgattttggcatgcgggaaaaccaggcatcggtttttttttaatttcccccctcgggggggg

SEQ ID NO: 23376 - DNA, 759 bp, Zea mays
  misc_feature: Ceres CLONE 1393578-F
  misc_feature: Encodes the peptide sequence at SEQ ID NO. 23377
  misc_feature (20)..(20): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
gtgtggggggttttccctcnccccccccccccctcctccannnggggggnnnnnnaaaagctggagctccaccgcggtggcggccgctctataactagtggatcccccgggctgcaggaattcgcacgagaccattacctagaacatcctaatcaaaaagagagacaagggagaggcgagggagctcaccaggagagaggggcctgtgtgagcattgaagtaaagcaaacgaggcagtacatacatctctcgctcgcagaggcccggccggccggctccatgcaacacgggacgacgagcggtggcggagggcgatgatgatgatgatggcgcgggagcacgtgctggccgctctgaccaccctggttctggcctcgctcctgaccatggtgctgaaccacttcctgcccttgcttctgaaccccaaggcccccagggggaggggtgggggtggcccgctccctcggaagaagacgctcaggattcctcacggccgcacgcctcccaaacggctgggggggctccctcgaggatcaccggctccagggtatggggggggggttcaagccccacctggttctggcccccggacggggggggccctgccgaccaggaaccccaacccatttcctccctgcaaaaacgggggagggggctggttccaggggaagctacccggagggcggatcacgggccatccctgggggaaagcccctccatggcctggcggtcccctggggggagggaacccccaggggg

SEQ ID NO: 23377 - protein, 148 aa, Zea mays
  misc_feature: Ceres CLONE 1393578-F
MMMMMAREHVLAALTTLVLASLLTMVLNHFLPLLLNPKAPRGRGGGGPLPRKKTLRIPHGRTPPKRLGGLPRGSPAPGYGGGVQAPPGSGPRTGGALPTRNPNPFPPCKNGGGGWFQGKLPGGRITGHPWGKAPPWPGGPLGGGNPQG

SEQ ID NO: 23378 - DNA, 667 bp, Zea mays
  misc_feature: Ceres CLONE 1393579-F
  misc_feature: Translation starting site: 211
  misc_feature (322)..(322): n is a, c, t, g, unknown, or other
  misc_feature (323)..(323): n is a, c, t, g, unknown, or other
  misc_feature (353)..(353): n is a, c, t, g, unknown, or other
  misc_feature (398)..(398): n is a, c, t, g, unknown, or other
  misc_feature (490)..(490): n is a, c, t, g, unknown, or other
  misc_feature (491)..(491): n is a, c, t, g, unknown, or other
  misc_feature (667)..(667): n is a, c, t, g, unknown, or other
tggagctccccgcggtggcggccgctctagaactagtggatcccccgggctgcaggaattcgcacgagaccattacctagaacatccaatcgaaaaaccagaggaaacgagagagagaaaaacagcccgatctcctcctcccactccgatcgccctaccgatcgccgcctcgtgaagcttccctgttccctccccgccgcccgcgacgccatggagccgccgcacaccgaggaggccgccgctgctgcagcaggaggagcagagggcggcagcgcaagcccgggcaccggcctcgaagggccgatgctgaggctgggtgggnnacggcggcgggaaggggggaggacgggaancttgggggctgggggaggaggcggacacgtgtcttccagagcggnctggcgaggccgactgtggctactacctccgcacgggcgcctgccggcttcggggagcgctgccgctacacccacccccgcgatcgtggcgnnactgagttttgggtggaggtgccaagaaatggagcagcacaatactttccagaacgacaagggcaacctgtatgcgagtatttatttgaagactgggacttggtaaatttggtttccaattgcaaatatcaccatcctaagcaaagatgggatcttgggcagttctgttatattan

SEQ ID NO: 23379 - DNA, 633 bp, Zea mays
  misc_feature: Ceres CLONE 1393580-F
  misc_feature: Encodes the peptide sequence at SEQ ID NO. 23380
  misc_feature (387)..(387): n is a, c, t, g, unknown, or other
  misc_feature (416)..(416): n is a, c, t, g, unknown, or other
tccccgcggtggcggccgctctagaactagtggatcccccgggctgcaggaattcgcacgagaccattacctagaacatcctaatcgaaaaatagcgaacaaacatcgagtacagccggctaggtaatctggtacgacgacccacgacgacgtggcggcggccaccaccaccagcagcagcaagaagtcgtcgtcgccgtcgtcctcgagctcggcgcagcgggcagcagctgccgcccggctcgtggcggtgtccgtcctggtggtgggcgcggcggcggtgtgcgacatgagcaacgagcagttcatgtcgtgccagcccgcggcggccaagacgacggacccgccggccgcgccgtcgcaggggtggtgggacgcgctggcggnggcggacctcaagtgcctgtgcggctacnagaactcgccgtggatgggcgtctacaacatcgaccccaagcgcgccgtggagctgccgtgcaagtgcggcctcgccacgccgcccgactgctagccaagccaggcaggaaggcccccggcattgctagctggacgtggggtggggtggaccttgacaggactcctcatgatagctccgcctgacgccccttccacccttttccgcgcccccccccc

SEQ ID NO: 23380 - protein, 73 aa, Zea mays
  misc_feature: Ceres CLONE 1393580-F
  misc_feature (33)..(33): Xaa is any aa, unknown, or other
  misc_feature (43)..(43): Xaa is any aa, unknown, or other
MSNEQFMSCQPAAAKTTDPPAAPSQGWWDALAXADLKCLCGYXNSPWMGVYNIDPKRAVELPCKCGLATPPDC

SEQ ID NO: 23381 - DNA, 690 bp, Zea mays
  misc_feature: Ceres CLONE 1393583-F
  misc_feature: Encodes the peptide sequence at SEQ ID NO. 23382
  misc_feature (279)..(279): n is a, c, t, g, unknown, or other
  misc_feature (386)..(386): n is a, c, t, g, unknown, or other
  misc_feature (399)..(399): n is a, c, t, g, unknown, or other
  misc_feature (507)..(507): n is a, c, t, g, unknown, or other
tggagctccccgcggtggcggccgctctagaactagtggatcccccgggctgcaggaattcgcacgagaccattacctagaacatcctaatcgaaaaacccatccgccgcttcgtcccaaatcccttttggcgggagacgagcagcaggctgcctccacttcccgcgcaaagcagtaaatcggagtaaccatggacggcggatcctccacaccggcgagccccccaccgacggtatccgcgtcggcggagaatatggaggagtaccggaactggaaagnaaacgcggcggtgctttacgacctcgtcatctcccacccgctcgagtggccatcgctcacccgtgcagtgcttccccatcgggagtcctcggcccgcaccaccgggntttcggtcgtggntacgcaccaccttccgacgaggccccccaacaacctcatggtccttggggacggcggtgctaccggctcccacctcgcctcggctgcaagccgtcgcttgcccggggnccgggggcccgtccggttccaattccgtatcccggtctcgcgcgtggcgccacaccgcgggggggaggtcaaccgcggcgcgctgcaatgccgcagcgtccccctatacggtggccaccaaaacgtgcggtcgaccgaggtgcacgtgtaccatctcgggggatgacgacggcagcgggagag

SEQ ID NO: 23382 - protein, 160 aa, Zea mays
  misc_feature: Ceres CLONE 1393583-F
  misc_feature: SWISSPROT Homolog: EC 2.3.1.48 Histone acetyltransferase
  misc_feature (30)..(30): Xaa is any aa, unknown, or other
  misc_feature (66)..(66): Xaa is any aa, unknown, or other
  misc_feature (70)..(70): Xaa is any aa, unknown, or other
  misc_feature (106)..(106): Xaa is any aa, unknown, or other
MDGGSSTPASPPPTVSASAENMEEYRNWKXNAAVLYDLVISHPLEWPSLTRAVLPHRESSARTTGXSVVXTHHLPTRPPNNLMVLGDGGATGSHLASAASRRLPGXRGPVRFQFRIPVSRVAPHRGGEVNRGALQCRSVPLYGGHQNVRSTEVHVYHLGG

SEQ ID NO: 23383 - DNA, 656 bp, Zea mays
  misc_feature: Ceres CLONE 1393583-R
  misc_feature: Translation starting site: 343
  misc_feature (656)..(656): n is a, c, t, g, unknown, or other
caattgggtaccgggccccccctcgaggtcgacggtatcgatattttttttttttttttttgcgatgatgatagcaaatatcgcagattgcccaagtaaatcaaatgtcattgaataaattttaaatcctaaatctaagattgaaaaaaacaaaggataaaactccatggtctacagccattggcttcaggcaagtgccatgtaccacctatagtatagattcccacatgtatgttgatgatgggaaaggtgtaacatactttgctagtcatgggagggtgtggttagatggcaaccacttgccctgccgctaccggctttttcctaaggaaaaaggcagccatgtttttaggtgtccagtgctgttttcttgcagattgggcacaggttttttataaccagccattgtttgatacatgcggtgtggaagtcatgaccacaatccagcctgcccaggtcctcgccttccacatagtcttcctggcaaatacagcatggttcaacacttgttggaggatcatccaatgattttaagacacatttccattgtttcaagttactcaaaatcttttcttcagtaagtcctgtgtttacgtacccaatgcgttcacctagtgccagcaattcctcataggacatattatccacatcaagcn

SEQ ID NO: 23384 - DNA, 645 bp, Zea mays
  misc_feature: Ceres CLONE 1393585-F
  misc_feature (138)..(138): n is a, c, t, g, unknown, or other
  misc_feature (222)..(222): n is a, c, t, g, unknown, or other
  misc_feature (223)..(223): n is a, c, t, g, unknown, or other
  misc_feature (249)..(249): n is a, c, t, g, unknown, or other
  misc_feature (301)..(301): n is a, c, t, g, unknown, or other
  misc_feature (366)..(366): n is a, c, t, g, unknown, or other
  misc_feature (386)..(386): n is a, c, t, g, unknown, or other
  misc_feature (390)..(390): n is a, c, t, g, unknown, or other
  misc_feature (392)..(392): n is a, c, t, g, unknown, or other
  misc_feature (393)..(393): n is a, c, t, g, unknown, or other
  misc_feature (601)..(601): n is a, c, t, g, unknown, or other
tggagctccccgcggtggcggccgctctagaactagtggatcccccgggctgcaggaattcgcacgagaccattacctagaacatcctaatcgaaaaagctagccaagctataccactagaaccagagcacaactcanagcaatgccgccgcctcctcctcctccgccccactcccacgcttcccatcccgcgccgcatggacgcgagcagcactagcgcgnnggcacacagcacggcgagcgggcggnggcgcgacgatggacctgggcgggtcggtggtgatgggacgcggcgcctcgnagctgggctgctcggcgcgggatctagcaggctgctcagcaccggccgggggccaatgggggcgnggagaccgaggactgggggnccgncnncaaggccaaacagcccaggaagggacgggcccgtcgttcccggggaaaggggcggctgccaccaagggggggggggggcccccttcttgtggggttcgggggaacccggacacggggggggaaaaaattttaatttttcttcccccgcgcccccccccccggggcctgggggcccccctccccgggggggggggggaggggggggggncccgtccgctttattaacaaaacccccccccctttttccagaag

SEQ ID NO: 23385 - DNA, 695 bp, Zea mays
  misc_feature: Ceres CLONE 1393589-F
  misc_feature: Encodes the peptide sequence at SEQ ID NO. 23386
  misc_feature (292)..(292): n is a, c, t, g, unknown, or other
  misc_feature (376)..(376): n is a, c, t, g, unknown, or other
  misc_feature (400)..(400): n is a, c, t, g, unknown, or other
  misc_feature (508)..(508): n is a, c, t, g, unknown, or other
  misc_feature (556)..(556): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (603)..(603): n is a, c, t, g, unknown, or other
  misc_feature (605)..(605): n is a, c, t, g, unknown, or other
tggagctccccgcggtggcggccgctctagaactagtggatcccccgggctgcaggaattcgcacgagaccattacctagaacatcctaatcgaaaaagggaagccgcaggcagcatctgcatctctcgcccacctccgctccgcctactgctgctggtggtagggaggcggagaaggaggcccttgcgcccgcccgccggccggatcagagccgtagcaaccaccacccatggcggacgtgcacgaacctttggtgcgccgtaagaggaagaaaggttttggtggactaancttggtgaagttccgatggatcctcgtggaatcttcgtggtccttcctatttcaactctgatctacttcaacatcttcctgggntgacatgtggccccgccatgaaantcggagaagaagcgccagaagcagcacgacgagaaccgtgcaggaagggtcgtgaagcggctcaagcagagaaaccgaaaagaagggacgggtctttgtttgcacggncaggaagcccttggggatcgctgttggcatggcgcaacgtggactacnagcgtgcgagnnnnattttcgaggtcgaccctttcttccttcaggancnatcccttgagacgaaaaaaagagaggggaggggtttgccaaggtccaagcccctttggtcaaacatgggggtcaaaataaaccagagcta

SEQ ID NO: 23386 - protein, 40 aa, Zea mays
  misc_feature: Ceres CLONE 1393589-F
  misc_feature (21)..(21): Xaa is any aa, unknown, or other
MADVHEPLVRRKRKKGFGGLXLVKFRWILVESSWSFLFQL

SEQ ID NO: 23387 - DNA, 516 bp, Zea mays
  misc_feature: Ceres CLONE 1393593-F
  misc_feature (307)..(307): n is a, c, t, g, unknown, or other
  misc_feature (349)..(349): n is a, c, t, g, unknown, or other
  misc_feature (362)..(362): n is a, c, t, g, unknown, or other
  misc_feature (372)..(372): n is a, c, t, g, unknown, or other
  misc_feature (387)..(387): n is a, c, t, g, unknown, or other
  misc_feature (388)..(388): n is a, c, t, g, unknown, or other
ggagctccccgcggtggcggccgctctagaactagtggatcccccgggctgcaggaattcgcacgagaccattacctagaacatcctaatcgaaaagtgagtcgtgagtagtgactcgtctggtctcccctctctcgtccgtctggtcctcccgtccagaggcgttctctctccctccccctttcctctggtcatcgcacccgtctccccgctctgactccgcccgcgccgccgactcccggcacggccccaggcttcatctccgccgccgcgccgcctcgctccgatcgacccccgaaaacgcggnaccgtgggcttcgcgaggtgcatttcttgggccgcgtctgancttgattcagttnctggagcggnctgagcttgggattnngatccggggttgccctctcttcgtccaagcggagataacataacaggtgcgacaggtgattgcaagagagaaggggggaattttgtcgcttgatgaatgcggaaggcccccattttccttggaatggt

SEQ ID NO: 23388 - DNA, 672 bp, Zea mays
  misc_feature: Ceres CLONE 1393594-F
  misc_feature: Encodes the peptide sequence at SEQ ID NO. 23389
  misc_feature (369)..(369): n is a, c, t, g, unknown, or other
  misc_feature (395)..(395): n is a, c, t, g, unknown, or other
  misc_feature (398)..(398): n is a, c, t, g, unknown, or other
  misc_feature (399)..(399): n is a, c, t, g, unknown, or other
  misc_feature (466)..(466): n is a, c, t, g, unknown, or other
  misc_feature (510)..(510): n is a, c, t, g, unknown, or other
  misc_feature (535)..(535): n is a, c, t, g, unknown, or other
  misc_feature (536)..(536): n is a, c, t, g, unknown, or other
  misc_feature (545)..(545): n is a, c, t, g, unknown, or other
tggagctccccgcggtggcggccgctctagaactagtggatcccccgggctgcaggaattcgcacgagaccattacctagaacatcctaaaaaaaaaaaccctagcccgacccctcctcctccacctgcgccaccgcccaccatgagctccgccgccgcgccagctgccgtcggcagcggcaaggagcttgccaacccgcccgccgacggaatcaccaacctccgcttctccaaccacagcaacaacctcctcgtctcctcatgggacaagacggtgcggctctacgacgccgacgccacgtgctcaaagggggagttcatgcacccccggggccgtcctcgactgctgcttctacgacgactcctcgnggctttagcgccggtgccgaccacancgnnggccggagggttggtatttagctcgcccaaggaaagatgttttgggcgggcaggatatgggcccggnttcgttgcgtggaatactctttatgctggcaggtcaagtcatcnaccggcagctgggataaaactgtannaatgctggnatccaagaaggagttagtggaccagagcgccacccttgttgggacatatgctcaacctgaacgtgtatattctctttcgtagtagaaaaaaaaggttggttgttgcaacagctggaagacatgtaaa

SEQ ID NO: 23389 - protein, 139 aa, Zea mays
  misc_feature: Ceres CLONE 1393594-F
  misc_feature (76)..(76): Xaa is any aa, unknown, or other
  misc_feature (85)..(85): Xaa is any aa, unknown, or other
  misc_feature (86)..(86): Xaa is any aa, unknown, or other
  misc_feature (123)..(123): Xaa is any aa, unknown, or other
  misc_feature (131)..(131): Xaa is any aa, unknown, or other
  misc_feature (132)..(132): Xaa is any aa, unknown, or other
  misc_feature (135)..(135): Xaa is any aa, unknown, or other
MSSAAAPAAVGSGKELANPPADGITNLRFSNHSNNLLVSSWDKTVRLYDADATCSKGEFMHPRGRPRLLLLRRLLXALAPVPTTXXAGGLVFSSPKERCFGRAGYGPGFVAWNTLYAGRSSHXPAAGIKLXXCWXPRRS

SEQ ID NO: 23390 - DNA, 663 bp, Zea mays
  misc_feature: Ceres CLONE 1393599-F
  misc_feature: Encodes the peptide sequence at SEQ ID NO. 23391
  misc_feature (208)..(208): n is a, c, t, g, unknown, or other
  misc_feature (219)..(219): n is a, c, t, g, unknown, or other
  misc_feature (220)..(220): n is a, c, t, g, unknown, or other
  misc_feature (301)..(301): n is a, c, t, g, unknown, or other
  misc_feature (348)..(348): n is a, c, t, g, unknown, or other
  misc_feature (416)..(416): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
aagctggagctccccgcggtggcggccgctctagaactagtggatcccccgggctgcaggaattcgcacgagaccattacctagaacatcctaatcgataaatccaatacccccacgaacccactctctctccccacgatggcaaaaatggcgatggcgtcctcccgcctcccggctctcctctgcctcgccgccgtcgccgtcgccngttcgcggggnnggaaggccgccgccgccgccggagaaggcggcctccgcctgccccgcgacgccacgttcccggcggcgcaggcggagcggntcatccgcgcgctcaacctcttgcctaaggagaaaaggagcgggcgnccggcccgcgggggggtgacgacggccccagcgtgccgccggggagctcataaagggccccgcccggntgcccgggggggcccgcggggagtgggggaacgtgggggaaaaagggcggggtaattccggcgtgggggaaaaggagggagggccgaaaaggttttaatttcttttttccaaacccagggggaaaaaaaaaaaggaggaaaccccccctggggggaattgggtttaaacgggaaggtcccggggtgaaaaaaannntttttggggggctcttccaaaaaggaaagggggcccttccccagatggaaa

SEQ ID NO: 23391 - protein, 110 aa, Zea mays
  misc_feature: Ceres CLONE 1393599-F
  misc_feature: SWISSPROT Homolog: EC 3.4.16.5 Carboxypeptidase C
  misc_feature (24)..(24): Xaa is any aa, unknown, or other
  misc_feature (28)..(28): Xaa is any aa, unknown, or other
  misc_feature (55)..(55): Xaa is any aa, unknown, or other
  misc_feature (93)..(93): Xaa is any aa, unknown, or other
MAKMAMASSRLPALLCLAAVAVAXSRGXKAAAAAGEGGLRLPRDATFPAAQAERXIRALNLLPKEKRSGRPARGGVTTAPACRRGAHKGPRPXARGGPRGVGERGGKRAG

SEQ ID NO: 23392 - DNA, 852 bp, Zea mays
  misc_feature: Ceres CLONE 1393602-R
  misc_feature: SWISSPROT Homolog: EC 4.1.3.4 Hydroxymethylglutaryl-CoA lyase
cgattgggtaccgggccccccctcgaggtcgacggtatcgataagcttttttttttttttttttgcgggaaccccaagatttttcaaaatcttccaacggggggtacaaagtgtgtgaataaaatgctcaaagtaggcaatgtctgagcggaaaaaaacttaaagtaaaactccgggactttcttttgactgagagatgggacctcaaaccgatacatttcttttgggagggcttgaaaaggttttttcaggcggtcagtttgcggaaagcagtggcggttttggaacccagcggcctgcccaaatgcttggaaatgtagtccccaccctccatgagcttgttgaggtcaactttggtctcaatccccgggccatggagcatgtacacaacatcctccggggcgactttgccaggggcccccttggcatacgggcagcctccaaggcccgacaccgacaagcccactatgttgatccccatttaaagggagacaaggattttggcaagggcctccccgtacgtatcgggaaaatgaacggcaattttgtccaccgggacaaacaacttgacagcttgaagcatagcacccacgctacctggtgtcccaacaccagtcgtgtcgccaagcgagatctccgagcaccccatggtatacggctccttagctacgtacgccaccttcgccggatcggttgcccctccaacggggcaagcaatcacccatgacacgtccccccggaggcttacccccggttttttggcagcccctttgaccccccggaaccgagcagggttctcctcaatggggcatttaatgttgggacctggaaaaagaatcctaaccccgaacc

SEQ ID NO: 23393 - DNA, 661 bp, Zea mays
  misc_feature: Ceres CLONE 1393602-F
  misc_feature: Encodes the peptide sequence at SEQ ID NO. 23394
  misc_feature (324)..(324): n is a, c, t, g, unknown, or other
  misc_feature (351)..(351): n is a, c, t, g, unknown, or other
  misc_feature (352)..(352): n is a, c, t, g, unknown, or other
  misc_feature (412)..(412): n is a, c, t, g, unknown, or other
  misc_feature (476)..(476): n is a, c, t, g, unknown, or other
  misc_feature (477)..(477): n is a, c, t, g, unknown, or other
tggagctccccgcggtggcggccgctctagaactagtggatcccccgggctgcaggaattcgcacgagaccattacctagaacatcctaatcgaaaaaagcctctcaattccaactccatcgcaacagcctatcgagtccccgaacagtcctgcgcgcgtccgcaatggcggagacggccggcgcggctccagcacagcagcccgctagagtagctacgacgacgacgaacagcgatgtctccacgtgggcgtggttgcagcaggtcctcgcgctgctgttcccgtccagcctcgccgcgaaagccgcgctgggttgcgctcgntggtggcgctgctgccgctgctgccgnntcgggcaggcgcccagggatctgggagctgccgcacctcctcctgctcggcatcatctcntcctacggcgtcttcggccagaagacgccgaacgccggaggtggccaccgctgcctacgcccgnnccgtcgaacgtggaaggcgtcggtggaggcctaccgtctcgcagatgatgcagggctcgcttgtcttcgacgaaaacggacggcaacgatggcgccaacaagggatggcagcgtccaacagcagggggggaagctctcggtaccttcagacgaccccggtcggggttcgcccggaaaccttcag

SEQ ID NO: 23394 - protein, 119 aa, Zea mays
  misc_feature: Ceres CLONE 1393602-F
  misc_feature (63)..(63): Xaa is any aa, unknown, or other
  misc_feature (83)..(83): Xaa is any aa, unknown, or other
  misc_feature (104)..(104): Xaa is any aa, unknown, or other
MAETAGAAPAQQPARVATTTTNSDVSTWAWLQQVLALLFPSSLAAKAALGCARWWRCCRCCRXGQAPRDLGAAAPPPARHHLXLRRLRPEDAERRRWPPLPTPXPSNVEGVGGGLPSRR

SEQ ID NO: 23395 - DNA, 663 bp, Zea mays
  misc_feature: Ceres CLONE 1393603-F
  misc_feature (361)..(361): n is a, c, t, g, unknown, or other
  misc_feature (409)..(409): n is a, c, t, g, unknown, or other
  misc_feature (410)..(410): n is a, c, t, g, unknown, or other
  misc_feature (452)..(452): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (634)..(634): n is a, c, t, g, unknown, or other
  misc_feature (645)..(645): n is a, c, t, g, unknown, or other
tggagctccccgcggtggcggccgctctagaactagtggatcccccgggctgcaggaattcgcacgagaccattacctagaacatcctaatcgaaaactaggctttcagccgctctcctagtctcctactctcctctcagccgtcgccgtcgctctccacaccgctctcctctctcctccgagccgcagctcttctctctccctctcccctgcgtgccgccactgcgggcaccctgcacgccgccgctgcgtggccctacacgccaccgctacgggtgccctacgcgccgccgtcactgctccagctctcctctgtttcccagccaatgccgccgctctaactccccaaggatcgcccggnacgacggctcaacgaaagccccgtcaaacgcctcgcggacgccctgcnngccgcagcgggcgctttacgctccatggcaaggcgcgttagnatgcctcaggtttccacagggcgccttagcgcctaagcgacgctaagggcggcgcttcagataagcatgctttttgaataagatgtgaaggattaaagctcatgtgaaagattctaagactacattggnnnatcaggcggttgctttcttatttctcatacgctcaccatgctctggatggntaagatccagntaggaggatgcattcagt

SEQ ID NO: 23396 - DNA, 648 bp, Zea mays
  misc_feature: Ceres CLONE 1393610-F
  misc_feature: Translation starting site: 116
  misc_feature: SWISSPROT Homolog: EC 2.3.1.92 Sinapoylglucose--malate O-sinapoyltransferase
  misc_feature (253)..(253): n is a, c, t, g, unknown, or other
tggagctccccgcggtggcggccgctctagaactagtggatcccccgggctgcaggaattcgcacgagaccattacctagaacatcctaatcgaaaactctcgctttctctagccatgacgctggtgaggatgccttgccgcctctgctgcttcctgctcgtcgtcgccgcctccgccgtctccgggcgggggcgggtggtcaccaccctcccgggctacgagggccgcctccccttccacctcgaaacaggntatgtggaggtggacgaggacgccggcgcgaagctcttctactacttcgtccgggccgagtccggcgccgacgacagcgacaccccgttcgtcctccggatccccggacggcaacgctgctccgccttcagcggcctcgcctacgagataggtcccatcatggttcgtcgtgcagtcctacaacggaagattgccgcgcctgcgctacaaccaaactcgtgggacaaaggtggcgcatatttctttatgtgcattcgccagttgggggccgggtttttccttctccagagatggcaaaggctacagggctgtagcggtatcaaccacgctggcacttggggaagttcttcaacaagggggtcaacgaccatcctgagtaacatgaaattctacct

SEQ ID NO: 23397 - DNA, 647 bp, Zea mays
  misc_feature: Ceres CLONE 1393618-F
  misc_feature: Encodes the peptide sequence at SEQ ID NO. 23398
  misc_feature (325)..(325): n is a, c, t, g, unknown, or other
  misc_feature (326)..(326): n is a, c, t, g, unknown, or other
  misc_feature (367)..(367): n is a, c, t, g, unknown, or other
  misc_feature (398)..(398): n is a, c, t, g, unknown, or other
tggagctccccgcggtggcggccgctctagaatagtggatcccccgggctgcaggaattcgcacgagaccattacctagaacatcctaatcgaaaactgccaaagcgtatttctgcgacatctaaaggagtgtggaaggcggctgccttgtccgcccggcctcttacgtctcggagcgagaatcagccgcatcgccgcgcgcatccgaagcgcacacgacaatgcagggcggatccagcggcattgtctatggtggcctcaagtaccaggcacggtgtatcgccgacgtgcgcgcggacgccagctcgaccaccttccctcgcgnngacctcagcctcaaggagagaaacgagtgcacctgatccgnctttcgccggcggagagttgagctgtgtgcnatggagtcttctaccacccccacgagatctgggatctcaaatcatgtcccttcgatcacagggtcttctccacagtctacacgtctggtgagggctttggtgcgtcaggttggaagatcccagagcttaatgggcatcaaactcaccgcagctggagcagctctttgagcttagtgggcatacgggcaggattagacgggtgatctggtggccacttggaagcatgataactaattagcattgatgacg

SEQ ID NO: 23398 - protein, 46 aa, Zea mays
  misc_feature: Ceres CLONE 1393618-F
  misc_feature (35)..(35): Xaa is any aa, unknown, or other
MQGGSSGIVYGGLKYQARCIADVRADASSTTFPRXDLSLKERNECT

SEQ ID NO: 23399 - DNA, 677 bp, Zea mays
  misc_feature: Ceres CLONE 1393622-F
  misc_feature: Translation starting site: 151
  misc_feature (271)..(271): n is a, c, t, g, unknown, or other
  misc_feature (321)..(321): n is a, c, t, g, unknown, or other
  misc_feature (536)..(536): n is a, c, t, g, unknown, or other
aaagctggagctccccgcggtggcggccgctctagaactagtggatcccccgggctgcaggaattcgcacgagaccattacctagaacatcctaatcgaaaacacataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcgncgctggccgccagcgtgtcgtactacgactacatcatcgtggggcggcgncacgggcgggtggccgctggccgccacgctgtcggaccgcttccgcgtgctgctgctggagcgcggccccctccccctacgacgacgaccgcatcggggacatggcccgcttcccggacacgctggtcgacaccctcccgggctcgcccgcgcaaggctttcgtggcggaggagggtcgtcatcaactcccggcccgcggttgctgggccgccgncaacttaatcaaccccggttttctaaacgggggcccaggaaccattaacatgcgggggcggtttggtggggaacctggcccccccccggggcgggcctaacccggggggggggaaaaaaagtggggggggcttcccacccc

SEQ ID NO: 23400 - DNA, 650 bp, Zea mays
  misc_feature: Ceres CLONE 1393625-F
  misc_feature (375)..(375): n is a, c, t, g, unknown, or other
  misc_feature (376)..(376): n is a, c, t, g, unknown, or other
  misc_feature (501)..(501): n is a, c, t, g, unknown, or other
  misc_feature (632)..(632): n is a, c, t, g, unknown, or other
aaagctggagctccccgcggtggcggccgctctagaactagtggatcccccgggctgcaggaattcgcacgagaccattacctagaacatcctaatcgaaaaattcctttcttctcagcgacaccgctcgataccttgcgatcccaagatggcatcgccgccgatacccacacagtaatcctctcctcgctcccctgtcccctctctccccgccgccgacgccgagcctactctgtccatttccggactcgccgtccctcgcgggccggttcggtccgagcctgcgccccagccgcgccgggatccgcgagagaaccgcttgccctccgtgctttgcgggcggtccggtgactggctttgagattcctgtgccgnngggctcgtgagcgcaatggggctgttttggtgaactaggcttgcttctgtgaagtctgtgagggtgagctgagctgtgggaaggaggatgcaggggaaggcacagctctctgattccaaccgcgnatcatggagctcgacgcgccgccacggccggtgtaccaggcgtgggagggcagcaacttatttttccctgggggaagactatctttggcccagatgtgaggtcactcgtgctcacagtatgtttgatggantcccagggatcttctttg

SEQ ID NO: 23401 - DNA, 654 bp, Zea mays
  misc_feature: Ceres CLONE 1393627-F
  misc_feature: Encodes the peptide sequence at SEQ ID NO. 23402
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
  misc_feature (320)..(320): n is a, c, t, g, unknown, or other
  misc_feature (321)..(321): n is a, c, t, g, unknown, or other
  misc_feature (328)..(328): n is a, c, t, g, unknown, or other
  misc_feature (329)..(329): n is a, c, t, g, unknown, or other
  misc_feature (537)..(537): n is a, c, t, g, unknown, or other
aaagctggagctccccgcggtggcggccgctctagaactagtggatcccccgggctgcaggaattcgcacgagaccattacctagaacatcctaatcgaaaaatttccacaagacccttgcgtgctctctctctctcctcttggcgacgactgggtggcaggtgcccaggtcttcttgggacccttccggcgacaagcaccaccagcttgcaggtttcaagatggaagtggtaaaaactacacatgctgggcatgcaaaatctcttgtatcaactattgattttagtacctgtcctgatggtattgtatggtggnnntgnntgatggnnattgtaaatgaggtcctcaatggtcttctatgcagagatgatcaaaatatgtctgcctctgtaccaataggtataatacctggctggtctgataactcacttatttggacagtcttgggtgtcaaggatccaatttctgcagcattgtcaattggtcaggggaggtctacacctattgatgttttttctggtgatggattcaaagggnactatgcattatgtacacccgatcatattttggttttggtagcgatggtcttgagctctcagagaagatcagaagcattttgccctttacgatacttggagctggtttctcaaattc

SEQ ID NO: 23402 - protein, 144 aa, Zea mays
  misc_feature: Ceres CLONE 1393627-F
  misc_feature: SWISSPROT Homolog: EC 2.7.1.91 Sphinganine kinase
  misc_feature (32)..(32): Xaa is any aa, unknown, or other
  misc_feature (33)..(33): Xaa is any aa, unknown, or other
  misc_feature (34)..(34): Xaa is any aa, unknown, or other
  misc_feature (36)..(36): Xaa is any aa, unknown, or other
  misc_feature (106)..(106): Xaa is any aa, unknown, or other
MEVVKTTHAGHAKSLVSTIDFSTCPDGIVWWXXXMXIVNEVLNGLLCRDDQNMSASVPIGIIPGWSDNSLIWTVLGVKDPISAALSIGQGRSTPIDVFSGDGFKGXYALCTPDHILVLVAMVLSSQRRSEAFCPLRYLELVSQI

SEQ ID NO: 23403 - DNA, 603 bp, Zea mays
  misc_feature: Ceres CLONE 1393631-F
  misc_feature: Encodes the peptide sequence at SEQ ID NO. 23404
  misc_feature (416)..(416): n is a, c, t, g, unknown, or other
  misc_feature (417)..(417): n is a, c, t, g, unknown, or other
  misc_feature (443)..(443): n is a, c, t, g, unknown, or other
ggagctccccgcggtggcggccgctctagaatagtggatcccccgggctgcaggaattcgcacgagaccattacctagaacatcctaatcgaaaactttcccttccgcgcctccctcgtcttcttctcgtctccactccccctctcccaagtcccacccgccgctcccgccccccgtgcgctcgccgacacggtcagtagttccactcggagaaaggaacgcttccccctgcctgtctcgccggatccgttgccccgcttcagtttcgcccgccgctttcactttcgctttcactcgatttagattccatttccgttcgttcgttcctgtttcccttgctcgttcgttcgattggagctagcctccgcctggatctgggctagccgaagccccgccggctctgaaatcccgattcnnggtcgggctccccttggtctgggggncggctttccaaggggggtctcgatttcgtccgaagaaaagggcttcccggttccctccgggggcgaaaatggtacttggggtcccggggcaagttcaaactctgaaaaaaaaatcgggagggggacccttccgggaaacccttcccccccgggaaagggg

SEQ ID NO: 23404 - protein, 30 aa, Zea mays
  misc_feature: Ceres CLONE 1393631-F
MVLGVPGQVQTLKKKSGGGPFRETLPPRER

SEQ ID NO: 23405 - DNA, 667 bp, Zea mays
  misc_feature: Ceres CLONE 1393632-F
  misc_feature: Encodes the peptide sequence at SEQ ID NO. 23406
  misc_feature (605)..(605): n is a, c, t, g, unknown, or other
  misc_feature (606)..(606): n is a, c, t, g, unknown, or other
aaagctggagctccccgcggtggcggccgctctagaactagtggatcccccgggctgcaggaattcgcacgagaccattacctagaacatcctaatcgaaaaaccagctttccccttctctacggtccgggaatcggaagctcacggcagaagccatggggcagacgcatcttttgttgctcgcttgtttctgggtcctgtcaacatgctccttgctacttgatgcttcctccgatggactgttaagaatcaacctgaacaagaagagactggacaaggaagctttgactgctgcgaaattggcgaagaaggagagcaaccttcgaaggtctgtgggtgctgaccagtatctcagtgcctcaactgatgacatagtccctttggacaactacctggacacccagtactttggacagatcagcatcggcacgccaccacagaacttcacagtgatattcgacactggaagctcccaacttgtgggttccctcatccaagtctacttttcgatagcatgctacttacaccacagatacaagtcaaccaagtcgaagacttacacaaagaaatggagaatcttgacgataacatttatgggttctggnncaaatcgctggcttcttcagtgggaacaaaagggtgttggttgccaaacctttgttgtgca

SEQ ID NO: 23406 - protein, 170 aa, Zea mays
  misc_feature: Ceres CLONE 1393632-F
  misc_feature: SWISSPROT Homolog: EC 3.4.23.40 Phytepsin
  misc_feature (151)..(151): Xaa is any aa, unknown, or other
MGQTHLLLLACFWVLSTCSLLLDASSDGLLRINLNKKRLDKEALTAAKLAKKESNLRRSVGADQYLSASTDDIVPLDNYLDTQYFGQISIGTPPQNFTVIFDTGSSQLVGSLIQVYFSIACYLHHRYKSTKSKTYTKKWRILTITFMGSGXNRWLLQWEQKGVGCQTFVV

SEQ ID NO: 23407 - DNA, 670 bp, Zea mays
  misc_feature: Ceres CLONE 1393635-F
aaagctggagctccccgcggtggcggccgctctagaactagtggatcccccgggctgcaggaattcgcacgagaccattacctagaacatccgaatcgaaaaatcgcagaaattctccgcaacttcacagcgtatcatcgttttccatcgctcctactcctatcatccagaaaatctgagcgttattgatggcgcccaaggcgcagaagaagccggcgtcgaacaaggtgcccggaggaggagccctcggagaaggcgtctgcggcggagagggtccccgcgtcagaagaaggccaaggcgaagaagggaatacctgcgccttagaccgccggcaaggagcgcgtggactagagggataggaagatgctgaagagagtgtggatacctacaatatctacatgctcaaggtcactggtctctcacaattcgtcttcgcctcgccgcttcctccttgaccgccacagttgaggtcttcttgccggtgaggaaaatatattaattacctaggaaggaggtctccttgggaggagtccatctggttcttttgacatagagaccggctttggttaattcaaaaccggaaaatcacgcaaactgcgaggtggtttcttggaacggggcatgccaccgctgttcgctacacagcaaaggggccattggctggccccg

SEQ ID NO: 23408 - DNA, 688 bp, Zea mays
  misc_feature: Ceres CLONE 1393637-F
  misc_feature (688)..(688): n is a, c, t, g, unknown, or other
ccgggctggagctcaccgcggtggcggccgctctagaactagtggatcccccgggctgcaggaattcgcacgagaccattacctagaacatcctaatcgaaaagagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgtgtcgacaactaccgcagcaccaaggagctgatggcggacaccgtatcttcctgcctgagcctcgtccccaccgtgcaccaccgagccgccggttcctccagtgtgtcgttatgactaaatcccccagagcccgctgattttgacctgcttactgtggcccctttggcttaatatttttcccacccgttcctcccccctaatttgtacggtgcccccggcccctatgattcggtaacaccccctatttgctatgggtaatggccccctccttctttacgccaaaaaccatcccccccacctttcttcctcaccccctctttttaacaaacaacatctctttctggccccccaccattgcccgggacaatttttttttccctcactcgccttaccctcggcccgccccccattgctcctcgcccccctccactcacgccgcccaccn

SEQ ID NO: 23409 - DNA, 656 bp, Zea mays
  misc_feature: Ceres CLONE 1393640-F
  misc_feature: Encodes the peptide sequence at SEQ ID NO. 23410
  misc_feature (509)..(509): n is a, c, t, g, unknown, or other
  misc_feature (614)..(614): n is a, c, t, g, unknown, or other
aaagctggagctccccgcggtggcggccgctctagaactagtggatcccccgggctgcaggaattcgcacgagaccattacctagaacatcctaatcgaaaaagtcacccacacaaatccagtaactcgcatcttcctgcgtcatccaagttctagcagcgcagcgctcggtttcggcaatgtcggggcgcggcaagggcggcaagggtctgggcaagggcggcgccaagcgccaccgcaaggtcctgcgcgacaacatccagggcatcaccaagccggcgatccggaggttggctaggaggggcggcgtcaagcgcatctccgggctcatctacgaggagacccgcggtgtgctcaagatctttctggagaacgtcattcgtgacgccgtcacctacaccgagcacgcccgccgcaagaccgtcacggccatggatgtcgtctacgcgctcaaacgacagggccgcaccctctacggcttcggcggctaggtcgcttcctcatctggntgcgaactgcatggtgtgtcgccggggtggtttgtgttgtgtgcctaattttagtctagtcccgttctctctatcgtcgctgtggttctgggggggtctttggantccatttcctggcaataccaccttgccattatccatgaaaaa

SEQ ID NO: 23410 - protein, 103 aa, Zea mays; identical to SEQ ID NO: 6459
  misc_feature: Ceres CLONE 1393640-F
  misc_feature (25)..(94): Pfam Name: Histone Pfam Description: Core histone H2A/H2B/H3/H4

SEQ ID NO: 23411 - DNA, 636 bp, Zea mays
  misc_feature: Ceres CLONE 1393641-F
  misc_feature (387)..(387): n is a, c, t, g, unknown, or other
  misc_feature (469)..(469): n is a, c, t, g, unknown, or other
  misc_feature (506)..(506): n is a, c, t, g, unknown, or other
  misc_feature (557)..(557): n is a, c, t, g, unknown, or other
  misc_feature (561)..(561): n is a, c, t, g, unknown, or other
  misc_feature (633)..(633): n is a, c, t, g, unknown, or other
aagctggagctccccgcggtggcggccgctctagaactagtggatcccccgggctgcaggaattcgcacgagaccattacctagaacatcctaatcgaaaaatccctcctcctaactccaaactacccactggttcgactcgcgttcgcatcgcaagcagcagcgttccatcgaggcaatggcggtgatggccgaagtagtgtcgaccaccggcgcggcgctccggagcccggcctcgcagcagccggcggcggcgggcgcggcgaagggcaccgacgctgagaagctccagttcatcgaggacatgacctccaacgtggacgccgtgcaggagcgcgtggctgggggagatcctcgcccgcaacgcggacaccgagtacctcgccnggcagggcgggcctcgccggcgctacggaccgcgccaccttccgcgccagggtgccgatggcgacgtacgaggacctgcagncgtacatccggcgcatcgccgacggcgacgctcgccnatcctgtcggggcacccggtctccgagttcctcacagctcggcacgtcggncggngagcgaagctcatgccacatcgaggagagctcaaccgcgccagctgctgtaagcctcagatgccgtctgganctg

SEQ ID NO: 23412 - DNA, 656 bp, Zea mays
  misc_feature: Ceres CLONE 1393643-F
  misc_feature: Encodes the peptide sequence at SEQ ID NO. 23413
  misc_feature (233)..(233): n is a, c, t, g, unknown, or other
  misc_feature (269)..(269): n is a, c, t, g, unknown, or other
  misc_feature (561)..(561): n is a, c, t, g, unknown, or other
  misc_feature (567)..(567): n is a, c, t, g, unknown, or other
  misc_feature (572)..(572): n is a, c, t, g, unknown, or other
  misc_feature (573)..(573): n is a, c, t, g, unknown, or other
  misc_feature (590)..(590): n is a, c, t, g, unknown, or other
  misc_feature (625)..(625): n is a, c, t, g, unknown, or other
  misc_feature (627)..(627): n is a, c, t, g, unknown, or other
aagctggagctccccgcggtggcggccgctctagaactagtggatcccccgggctgcaggaattcgcacgagaccattacctagaacatcctaatcgaaaaaactcgaaccgaagggacgaccgagcggagtctagactcgagagcaacctcgacctcccggatctctctcccacccacgcctcgtcggcgccgtcgtctgctgcagcgatggcctcccccgacctgctcttncatctgcggaacctcttctacctgggcgcctaccangcagccatcaacaacagcgacgtcccgggcctcgacgccgacgccgccgctgagcgcgacgccctcgtcttccgctcctacatcgccctcggctcctaccagctggtgatcagcgagatcgactcgtcagccgctacctcgctgcaggccgtgaagctgctcgcgctgtacctcactggagacaaggaaggtgctatctccagtctcaaggaatggttgagtgattcagcaatgggaagcaatcctggtctgcgggtgattgctgaatctctctccccaaaactaccctcgncagcgnccggnngatgtgccccaacgaancccgatcgccctggccagggccgccgccggctccngngagaaagagctggcgggaaggaggccgtg

SEQ ID NO: 23413 - protein, 149 aa, Zea mays
  misc_feature: Ceres CLONE 1393643-F
  misc_feature (3)..(143): Pfam Name: Coatomer_E Pfam Description: Coatomer epsilon subunit
  misc_feature (8)..(8): Xaa is any aa, unknown, or other
  misc_feature (20)..(20): Xaa is any aa, unknown, or other
  misc_feature (118)..(118): Xaa is any aa, unknown, or other
  misc_feature (120)..(120): Xaa is any aa, unknown, or other
  misc_feature (122)..(122): Xaa is any aa, unknown, or other
  misc_feature (127)..(127): Xaa is any aa, unknown, or other
  misc_feature (139)..(139): Xaa is any aa, unknown, or other
  misc_feature (140)..(140): Xaa is any aa, unknown, or other
MASPDLLXHLRNLFYLGAYXAAINNSDVPGLDADAAAERDALVFRSYIALGSYQLVISEIDSSAATSLQAVKLLALYLTGDKEGAISSLKEWLSDSAMGSNPGLRVIAESLSPKLPSXAXGXCAPTXPDRPGQGRRRLXXERAGGKEAV

SEQ ID NO: 23414 - DNA, 631 bp, Zea mays
  misc_feature: Ceres CLONE 1393644-F
  misc_feature: Encodes the peptide sequence at SEQ ID NO. 23415
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (378)..(378): n is a, c, t, g, unknown, or other
  misc_feature (379)..(379): n is a, c, t, g, unknown, or other
  misc_feature (384)..(384): n is a, c, t, g, unknown, or other
  misc_feature (406)..(406): n is a, c, t, g, unknown, or other
  misc_feature (407)..(407): n is a, c, t, g, unknown, or other
  misc_feature (412)..(412): n is a, c, t, g, unknown, or other
  misc_feature (424)..(424): n is a, c, t, g, unknown, or other
  misc_feature (425)..(425): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (450)..(450): n is a, c, t, g, unknown, or other
  misc_feature (451)..(451): n is a, c, t, g, unknown, or other
  misc_feature (453)..(453): n is a, c, t, g, unknown, or other
  misc_feature (459)..(459): n is a, c, t, g, unknown, or other
aaagctggagctccccgcggtggcggccgctctagaactagtggatcccccgggctgcaggaattcgcacgagaccattacctagaacatcctaatcgaaaactccttcccctccctctttccacgacaccaaaagaaaccgaaaaccatcgacgcgctccgtccaccctcccctaccccgcgtcctcctcccctacgcctcccagcccagcggcaaaacctaaccctagatgggcgccgtcacctctacggtcgcggcgcgctttgcctttttcccgccgagcccgccgtcgtacgggttcgagcagccggcgccgcttccgggccctgggcacaccgagcctccggcccgggcacatccaagccgnnncgctcggnnccggncacaccaaaagcggcgctcggnnccggncacaccaagcgnncgcaggggnnnnagaaaaaaggcgnngnccccgnggggaacttcagggcgtcccgggaggggtaaacggggagggcgggggctggggacgaacggggcacgggaagggggcccgaatgacgggggccagggggggggccaaagtcaaggttggtcctatcccagggaaaagccgcgacttcggggaaaaggaacgagttctttcgc

SEQ ID NO: 23415 - protein, 133 aa, Zea mays
  misc_feature: Ceres CLONE 1393644-F
  misc_feature (47)..(47): Xaa is any aa, unknown, or other
  misc_feature (50)..(50): Xaa is any aa, unknown, or other
  misc_feature (52)..(52): Xaa is any aa, unknown, or other
  misc_feature (59)..(59): Xaa is any aa, unknown, or other
  misc_feature (61)..(61): Xaa is any aa, unknown, or other
  misc_feature (65)..(65): Xaa is any aa, unknown, or other
  misc_feature (69)..(69): Xaa is any aa, unknown, or other
  misc_feature (74)..(74): Xaa is any aa, unknown, or other
  misc_feature (75)..(75): Xaa is any aa, unknown, or other
  misc_feature (77)..(77): Xaa is any aa, unknown, or other
MGAVTSTVAARFAFFPPSPPSYGFEQPAPLPGPGHTEPPARAHPSRXARXRXHQKRRSXPXTPSXRRGXRKKAXXPXGTSGRPGRGKRGGRGLGTNGAREGGPNDGGQGGGQSQGWSYPREKPRLRGKGTSSF

SEQ ID NO: 23416 - DNA, 886 bp, Zea mays
  misc_feature: Ceres CLONE 1393645-F
  misc_feature: Encodes the peptide sequence at SEQ ID NO. 23417
  misc_feature (16)..(16): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (52)..(52): n is a, c, t, g, unknown, or other
  misc_feature (53)..(53): n is a, c, t, g, unknown, or other
tggtgggccccccccncccccccccannnnaccgagggaaacccccacaccnnacaaagctggagctccaccgcggtggcggccgctctattactagtggatcccccgggctgcaggaattcgcacgagaccattacctagaacatcctaatcgaaaaactcgccctgcaaagcacagacacaaaccacgagcgcgaggcacgacctacatcgaatcggccacgaaccaccatggcggcctcacgcgcgctcctccccagcccgcaggtgagccctgcgagcgcgcgggtccgcctggccgcggccgtgccgtcgtcgctcacgctcgcggtgcgcggcggggccggggccggcgcgcgtctccgcgtgcggtggggcgatctagtcggccgcccggggcccgtgggcgcccacccgagcctaagggccgggggggccggtatctccgccgggcccgcggccgggaaggggggccgcttggcgcccccaaaggccggggggggtggcttggcccccccccgaagaaaacctggaaaccgaaaggccccgggtgcctgggcgaccgggggtcctgcccggacaaagttctcccccgggaacggcggggaaaggcggggcgccaccaacacggggaatggggccccccccaccggggagaccgtctcccctccgcccaaagggggcggcccgccacagttccggaaaagggcggcttcacactcgggggcggacaagacgggccccccccaaagggcgccccccccggtagaaagcgtgcccttggagaggcccggggtccaaagggcccccgcattggcaggggcggggcgggaccccgggccaggccggttcgcatcaatcccaacaaacggtcgcagcccctcca

SEQ ID NO: 23417 - protein, 218 aa, Zea mays
  misc_feature: Ceres CLONE 1393645-F
MAASRALLPSPQVSPASARVRLAAAVPSSLTLAVRGGAGAGARLRVRWGDLVGRPGPVGAHPSLRAGGAGISAGPAAGKGGRLAPPKAGGGGLAPPRRKPGNRKAPGAWATGGPARTKFSPGNGGERRGATNTGNGAPPTGETVSPPPKGGGPPQFRKRAASHSGADKTGPPQRAPPPVESVPLERPGVQRAPALAGAGRDPGPGRFASIPTNGRSPS

SEQ ID NO: 23418 - DNA, 669 bp, Zea mays
  misc_feature: Ceres CLONE 1393646-F
  misc_feature: Encodes the peptide sequence at SEQ ID NO. 23419
  misc_feature (452)..(452): n is a, c, t, g, unknown, or other
  misc_feature (484)..(484): n is a, c, t, g, unknown, or other
  misc_feature (485)..(485): n is a, c, t, g, unknown, or other
  misc_feature (514)..(514): n is a, c, t, g, unknown, or other
  misc_feature (544)..(544): n is a, c, t, g, unknown, or other
  misc_feature (589)..(589): n is a, c, t, g, unknown, or other
aaagctggagctccccgcggtggcggccgctctagaactagtggatcccccgggctgcaggaattcgcacgagaccattacctagaacatcctaatcgaaaaaagcaactcgcacgcagcagtacgacgtctctcctctgggtctggggccgagacaccgagcacgtactaccagcaagatggtggcgtctcccagattcaagcccatcgaggagtgctgctcggaggggcggtcggagcagacggtggccgccgacctggacggcacgctgctcatctccaggagcgcgttcccctactacctcctcgtggctctcgaggccggcagcgtcctccgcgccgcgctgctgctcctggtcgtgccgttcgtctacgtcacctaccccttcttctccgagtcgctggcatcagcacgctgtgtacatctccgtgggcggggctcaaggtcgcancatcgagatggtggcgcgctcgtgctcccagnntctacgccgggcgagtgcacccgagaganttgggagggtgttcagctccttcgggaggngctacgtcgtcaggccagcccccaggggtcatggtcgaggccttncgccagggccttcctcggggcccaaaaagggtcgtcgggacccaaagttggaaggccccccaagggaacggcaagggccc

SEQ ID NO: 23419 - protein, 163 aa, Zea mays
  misc_feature: Ceres CLONE 1393646-F
  misc_feature: SWISSPROT Homolog: EC 2.3.1.15 Glycerol-3-phosphate O-acyltransferase
  misc_feature (91)..(91): Xaa is any aa, unknown, or other
  misc_feature (102)..(102): Xaa is any aa, unknown, or other
  misc_feature (112)..(112): Xaa is any aa, unknown, or other
  misc_feature (122)..(122): Xaa is any aa, unknown, or other
  misc_feature (137)..(137): Xaa is any aa, unknown, or other
MVASPRFKPIEECCSEGRSEQTVAADLDGTLLISRSAFPYYLLVALEAGSVLRAALLLLVVPFVYVTYPFFSESLASARCVHLRGRGSRSXHRDGGALVLPXSTPGECTREXWEGVQLLREXLRRQASPQGSWSRPXARAFLGAQKGSSGPKVGRPPKGTARA

SEQ ID NO: 23420 - DNA, 661 bp, Zea mays
  misc_feature: Ceres CLONE 1393647-F
  misc_feature: Encodes the peptide sequence at SEQ ID NO. 23421
aagctggagctccccgcggtggcggccgctctagaactagtggatcccccgggctgcaggaattcgcacgagaccattacctagaacatcctaatcgaaaaatatacccccgtcccatcggagaccaatcacagacaaagcacgagcggtggtagctgggcagtcaccatggctccaccacctctgttcctggtcccgtctctcctcatcctcctcgtcatcgtgcgtctgttccccaccgccgcggcgacgatcacgatgctgccgctgtatcgtaacctaccgcacgtagccgaggccgtggaatctcaccaccacccggtgtcccgtctggacgccgcgtcgctgcgccgcgcgttgtacctcaagcgccgagaccccgaccaccacaggcagaaaggatcaggtgaccacgcgtcagtaccagcgcacgccgcgctgtaaccgcactcctacggcggctacaccttcacggcgtcgctcgggacgccgccgaagccgctccccgtgctgatcgacaccaggagccatctcaggtgagtgtcatgcacctcgagctacgagatgcgttactgctcctgcccatccggctgcgacatctcggtcatctaccgaaagaactcatcctctcccggactcgtgggtgcagtatctcgtccaa

SEQ ID NO: 23421 - protein, 91 aa, Zea mays
  misc_feature: Ceres CLONE 1393647-F
MAPPPLFLVPSLLILLVIVRLFPTAAATITMLPLYRNLPHVAEAVESHHHPVSRLDAASLRRALYLKRRDPDHHRQKGSGDHASVPAHAAL

SEQ ID NO: 23422 - DNA, 638 bp, Zea mays
  misc_feature: Ceres CLONE 1393648-F
  misc_feature: Translation starting site: 200
  misc_feature: Pfam Name: LRRNT_2 Pfam Description: Leucine rich repeat N-terminal domain
  misc_feature (306)..(306): n is a, c, t, g, unknown, or other
  misc_feature (420)..(420): n is a, c, t, g, unknown, or other
  misc_feature (453)..(453): n is a, c, t, g, unknown, or other
  misc_feature (481)..(481): n is a, c, t, g, unknown, or other
  misc_feature (482)..(482): n is a, c, t, g, unknown, or other
  misc_feature (637)..(637): n is a, c, t, g, unknown, or other
aaagctggagctccccgcggtggcggccgctctagaactagtggatcccccgggctgcaggaattcgcacgagaccattacctagaacatcctaatcgaaaagtccttcttccttctctcacacactccactccacgtccccctccttcaaatcctttcaacacccaagcacaaggagagagaagccgccgccgccgccatggacaatattgaggtgaggaggaggaagaagaaagggagaagcagcggacgccgccaggggggacgggtacaggcggtcctgcgcgccggcctcgtcgccatggncttcgccctcctctggctctgctcctccacgccctccgccattgccctcaccccaaacggcgaggcgttgctggagctcaagctggcctttcacgccaccgtgcagcggctcancagctggcgtcccagcgacccaacccctgcggntgggagggcatctcctgctcccgtcctnngactcagggtcaatccataaaccctccattcatgcagctcgggggcatcatttcgcccagcatcgggaggctcgacaagctgcagagactagctctgcaccagacagcttgcacggcccatccctgcagagatcaagactgcaccgagctcaggna

SEQ ID NO: 23423 - DNA, 685 bp, Zea mays
  misc_feature: Ceres CLONE 1393649-F
  misc_feature: Translation starting site: 201
  misc_feature: SWISSPROT Homolog: EC 3.6.3.14 H(+)-transporting two-sector ATPase
  misc_feature (191)..(191): n is a, c, t, g, unknown, or other
  misc_feature (196)..(196): n is a, c, t, g, unknown, or other
  misc_feature (289)..(289): n is a, c, t, g, unknown, or other
  misc_feature (290)..(290): n is a, c, t, g, unknown, or other
  misc_feature (307)..(307): n is a, c, t, g, unknown, or other
  misc_feature (310)..(310): n is a, c, t, g, unknown, or other
  misc_feature (387)..(387): n is a, c, t, g, unknown, or other
aaagctggagctccccgcggtggcggccgctctagaactagtggatcccccgggctgcaggaattcgcacgagaccattacctagaacatcctaatcgaaaatcgcgtctgtccgctacccctccccgaccagatcgctacgagacgccgcgcgatccgacccaggccgacgccgacgacccctctcgccngcggnggccatggcgtacggcgaccgcgtcaccaccttcgaggactccgagaaggagagcgagtacggctatgtccgcaaggtctctggacctggtgnntgtgctgatggaatggntgntgctgccatggatgaacttggtcgtggcggacatgataacctcattgggggaaatcatcggtcttgagggcgatccngctaccatccaagttaatgaggaaacaagctggactgatggttatggaccctggattgaaaacaaaaaaacctccttcaggtgaatttgggacggggaattcttggaaaaatttttgaggggaatccgggggcccttaaaaaccttccgttttaaggcagggaatggggtttttccccgggggggggttcaccccccccccttaaaaaagagggtgtggggggaattcccccccaaagggggggggggggggagagtgccccccggggggaaaaataacccccccagggtgtttgaaa

SEQ ID NO: 23424 - DNA, 628 bp, Zea mays
  misc_feature: Ceres CLONE 1393652-F
  misc_feature: Encodes the peptide sequence at SEQ ID NO. 23425
  misc_feature (225)..(225): n is a, c, t, g, unknown, or other
  misc_feature (273)..(273): n is a, c, t, g, unknown, or other
  misc_feature (276)..(276): n is a, c, t, g, unknown, or other
  misc_feature (279)..(279): n is a, c, t, g, unknown, or other
  misc_feature (314)..(314): n is a, c, t, g, unknown, or other
  misc_feature (351)..(351): n is a, c, t, g, unknown, or other
  misc_feature (369)..(369): n is a, c, t, g, unknown, or other
  misc_feature (391)..(391): n is a, c, t, g, unknown, or other
  misc_feature (392)..(392): n is a, c, t, g, unknown, or other
tggagctccccgcggtggcggccgctctagaatagtggatcccccgggctgcaggaattcgcacgagaccattacctagaacatcctaatcgaaaaaccagaaacccgcgaatcaatcccgaatcccgatcgaccggcggcgcgggaggcgatgccggacaaggcggtggacgacgtcatggaggccgcggtgggggcccacttcagcggcctccgcctcgaggngctgcgcctctccacctctgcgccctcttccccttcctcctcccccgncgncgnggggcacacgcactccaacggagccgtctacgccnacggcaccaccgagcttccctctcctgccgctgcccnggagccattcgtcatcgntgtttctggaggggacgcgtcnnggaagacgacggtgtgcgacatgatcatccagcagctgcacgaccaccgtgtcgggctcgttaaccaggattcgtttaacggtggcctactgctggagaggctggccccgcacaaactatatttttgatcccctggatgatttggtaccgagcaacttctaaaatgcatggggcacctgaaatgggctcaacccggaaatttcctaaatattgatttcaaaagcatcgacgggggc

SEQ ID NO: 23425 - protein, 122 aa, Zea mays
  misc_feature: Ceres CLONE 1393652-F
  misc_feature: SWISSPROT Homolog: EC 2.7.1.48 Uridine kinase
  misc_feature (25)..(25): Xaa is any aa, unknown, or other
  misc_feature (41)..(41): Xaa is any aa, unknown, or other
  misc_feature (42)..(42): Xaa is any aa, unknown, or other
  misc_feature (43)..(43): Xaa is any aa, unknown, or other
  misc_feature (55)..(55): Xaa is any aa, unknown, or other
  misc_feature (67)..(67): Xaa is any aa, unknown, or other
  misc_feature (73)..(73): Xaa is any aa, unknown, or other
  misc_feature (81)..(81): Xaa is any aa, unknown, or other
MPDKAVDDVMEAAVGAHFSGLRLEXLRLSTSAPSSPSSSPXXXGHTHSNGAVYAXGTTELPSPAAAXEPFVIXVSGGDASXKTTVCDMIIQQLHDHRVGLVNQDSFNGGLLLERLAPHKLYF

SEQ ID NO: 23426 - DNA, 665 bp, Zea mays
  misc_feature: Ceres CLONE 1393659-F
  misc_feature: Encodes the peptide sequence at SEQ ID NO. 23427
aaagctggagctccccgcggtggcggccgctctattactagtggatcccccgggctgcaggaattcgcacgagaccattacctagaacatccttatcgaaaaattgttcgcgtcgtccgccttctctctctctctaacccactgccagccacctctgcgaccgtcgcgaccactcgccaagtaaattttcttccgcccacctgactacgcctcgacctcggcctcggcgccgcctccgtccgccggacgcggcagccatggcgccagcggtggggctcaagcgctccgccacgcagaccatcactctgccgccgcccgacacgcggctggctgtgcgcgatgtcatgcgctccacgatcccgtcgcagcccgccgtggcgccggcgtccacggagaggcaggcgcccgccgcggcgttgcaggggttcctgtgcctgaaggaggtggacgggaagcggtgcagctacgtggtggacggtggggccccgaaagggcaagaacaaggggcggggccggccccgcttggggccgcccgcaaggccggggccgctgcaatccgccgcttcccccctgcccgaggaaataatggccattcataaaaatcatatggggccgccccgaaagggttttccacaaaggggggtacccccctccataaggcaccc

SEQ ID NO: 23427 - protein, 113 aa, Zea mays
  misc_feature: Ceres CLONE 1393659-F
MAPAVGLKRSATQTITLPPPDTRLAVRDVMRSTIPSQPAVAPASTERQAPAAALQGFLCLKEVDGKRCSYVVDGGAPKGQEQGAGPAPLGAARKAGAAAIRRFPPARGNNGHS

SEQ ID NO: 23428 - DNA, 624 bp, Zea mays
  misc_feature: Ceres CLONE 1393665-F
  misc_feature: Encodes the peptide sequence at SEQ ID NO. 23429
aagctggagctccccgcggtggcggccgctctagaactagtggatcccccgggctgcaggaattcgcacgagaccattacctagaacatcctaatcaaaacatttttttctcttctccgtcgctctcatctcgcggcgggatcggacccccagcgccgccgaccgccgtcctcactccctgccccccgagactgccccccacgccgccacacgaaccacctcagctccctgcgccactaccctcggcctgccgccgcacgcctcccgcgctgtcgttgtcagccctccgctcctcgagacgccgcacgcctcccgcgctgtcgttgtcagccctccgctccccgcgacgccgcccttggctttctgcccaccgccgtatcgacagcgccgcctccgccccacttttccgttcgatttggtgggccgaggtctctcgctcgtggagtcgtagttcagcgcttcccgcacggcgatgtcggcgacgccgctgcccccgccgggccccgatggcgcggtggcgctcctgcctccgccgggtacggacatgactgggatctgcttccgcgaccagctgtggctcgacacttacccgctcgatcgcaacctcgtcttcgactacttcgc

SEQ ID NO: 23429 - protein, 50 aa, Zea mays
  misc_feature: Ceres CLONE 1393665-F
MSATPLPPPGPDGAVALLPPPGTDMTGICFRDQLWLDTYPLDRNLVFDYF

SEQ ID NO: 23430 - DNA, 651 bp, Zea mays
  misc_feature: Ceres CLONE 1393666-F
  misc_feature: Encodes the peptide sequence at SEQ ID NO. 23431
aagctggagctccccgcggtggcggccgctctattactagtggatcccccgggctgcaggaattcgcacgagaccattacctagaacatcctaatcgaaaacttccgtccttggcaaccaggcccaggcatcgtttcaccgctattcctcctgccccatctcctcccgatccatccgagcccaaaccctagtccagccagatctccgccgccgccggcgagagcacggcatcagatccgccgcgatggcgttccgccgcatcttatccacagcggtgcgccgccgctcggtcatcgccgcgggagcggccgggaacgcgcgcgaggcctccacggccgtcgccgcggcgcccggagtgctatcccccgacgcgaccccggtgtgcgctcccgtgatgtcgtatgatcgcatcgccgaagccgttaacgccaggctccgcggtcttgagcacccagaccggtgctgcctccgctatgcaagccccgtgccggcccactgccgaccacacgggcaatccttgccgcgccgggagacccgcgaaaaccacgctgcgccacgggtctgcgcgtaggacacgggaatcatcccctcccccgggcgcacgggcttagagtggcatgtgagccatagaaggcgcgccatcacgcccca

SEQ ID NO: 23431 - protein, 108 aa, Zea mays
  misc_feature: Ceres CLONE 1393666-F
MAFRRILSTAVRRRSVIAAGAAGNAREASTAVAAAPGVLSPDATPVCAPVMSYDRIAEAVNARLRGLEHPDRCCLRYASPVPAHCRPHGQSLPRRETRENHAAPRVCA

SEQ ID NO: 23432 - DNA, 641 bp, Zea mays
  misc_feature: Ceres CLONE 1393667-F
  misc_feature: Pfam Name: 3Beta_HSD Pfam Description: 3-beta hydroxysteroid dehydrogenase/isomerase family
  misc_feature: SWISSPROT Homolog: EC 5.1.3.2 UDP-glucose 4-epimerase
  misc_feature (598)..(598): n is a, c, t, g, unknown, or other
aaagctggagctccccgcggtggcggccgctctagaactagtggatcccccgggctgcaggaattcgcacgagaccattacctagaacatcctaatcgaaaaagactccatcgagttggtctttggtcgtgcttcgtgctgacgcttcgcgcgggtccgaggtcaggcggcagcagcacggagtagcaccagggcgaccgcccaggttatcgtcggccgccggcggcgacctgtaccccggcgagaagatgcatctgagcgaacgaggggatcgagggtctgcgattcgcggtgacgggcgggcagggcttcgtcggagctgccctcagcctcgagctgctccgccgcggtgcccgcgaggtccggtccctcgatctccgcgcctcctcctcctggtcccagcagctcctcgacgccggcgtccgaattatccaaggggacataagaaagaaggatgatgtgcgaagggctttccgtggagtggactgtgttttccaccttgcttcttatggcatgtcagggaaggagatggtgcagactgggagatctgacgaggtttatataatgggaccctgcatgtactggacgtttgcatgancagggggcaaaaggcttgggatgtaaccactacaatggggatt

SEQ ID NO: 23433 - DNA, 658 bp, Zea mays
  misc_feature: Ceres CLONE 1393677-F
  misc_feature: Encodes the peptide sequence at SEQ ID NO. 23434
aaagctggagctccccgcggtggcggccgctctagaactagtggatcccccgggctgcaggaattcgcacgagaccattacctagaacatcctaatcgaaaactctattagaatagccaggggcctcgctcctctccaccacgtactccactccatccatccatcatcgtctatccatgaagagcttgcaggaggagagggcggcgttggtgccgtcgccgtggccccagcaacagagaaaggacggcggcgagcatgatccggagcagctgatggatgaggatgacggtgacgatgaggaggatctgcaggatgagcagcacacaagaacaattaggacgtcgaccaagacggcggaagcatcgtcatcagcggagcggcgggtgccggcgtggtggaggcggcggcgggcgcagaagctggtgcccaccaagaggtgttggcctggtcatcgccggtctcctcggtgctggtcttggctccgtcgtcgtcggcggcggcggcaacaccagtcggtcggtcgctggatccacctcgataaatggcatcgtcgtttctgctaggcagcggcgggcgggcggcggcttgaagcagcatcaatggcctcctcaccacgtcccttaacccgcaggcggacctcgtgcccataccctttcag

SEQ ID NO: 23434 - protein, 128 aa, Zea mays
  misc_feature: Ceres CLONE 1393677-F
MKSLQEERAALVPSPWPQQQRKDGGEHDPEQLMDEDDGDDEEDLQDEQHTRTIRTSTKTAEASSSAERRVPAWWRRRRAQKLVPTKRCWPGHRRSPRCWSWLRRRRRRRQHQSVGRWIHLDKWHRRFC

SEQ ID NO: 23435 - DNA, 643 bp, Zea mays
  misc_feature: Ceres CLONE 1393682-F
  misc_feature: Encodes the peptide sequence at SEQ ID NO. 23436
  misc_feature (590)..(590): n is a, c, t, g, unknown, or other
aagctggagctccccgcggtggcggccgctctagaactagtggatcccccgggctgcaggaattcgcacgagaccattacctagaacatcctaatcgaaaaactccaccagtccggtccatctgctggacctcgattggtttcttcttacctaggaacatccggggatgtcgactcctgcgaggaagaggctgatgagggatttcaagcggttgatgcaggaccctccggccggcataagtggcgccccgcaggataacaacataatgctgtggaatgctgtcatatttggacctgatgataccccgtgggatggaggtacgtttaagctgactctccagtttaatgaagaatatccaaacaaaccaccaactgtgcgatttgtttctaggatgttccatcctaacatttatgctgatggaagcatatgcttagatatcctgcagaatcagtggagtccgatatatgatgtagctgcgatactcacgtcaatccagtcattgttgtgcgatccaaacccgaattcgcccgctaactctgaagccgcccgcatgttcagcgagaacaagcgagagtacaaccgcaaagttncgggaggtcgtggagcagagctggacgggactggataccccccccgtgtgttg

SEQ ID NO: 23436 - protein, 159 aa, Zea mays
  misc_feature: Ceres CLONE 1393682-F
  misc_feature (8)..(143): Pfam Name: UQ_con Pfam Description: Ubiquitin-conjugating enzyme
  misc_feature: SWISSPROT Homolog: EC 6.3.2.19 Ubiquitin--protein ligase
  misc_feature (142)..(142): Xaa is any aa, unknown, or other
MSTPARKRLMRDFKRLMQDPPAGISGAPQDNNIMLWNAVIFGPDDTPWDGGTFKLTLQFNEEYPNKPPTVRFVSRMFHPNIYADGSICLDILQNQWSPIYDVAAILTSIQSLLCDPNPNSPANSEAARMFSENKREYNRKVXGGRGAELDGTGYPPRVL

SEQ ID NO: 23437 - DNA, 635 bp, Zea mays
  misc_feature: Ceres CLONE 1393692-F
  misc_feature: Encodes the peptide sequence at SEQ ID NO. 23438
aagctggagctccccgcggtggcggccgctctagaactagtggatcccccgggctgcaggaattcgcacgagaccattacctagaacatcctaatcaaaaaggctcgccaaggaagcatccactgaccagcatccaagcgaggcagcctgaccgcccaccgtactacacgcgagcgcgcgcttctgcccccgccctgtaaaactctgaacataaaagtgcatcgccctggctccctctcttcatctctctcttccaaggagaacacccacctctctctctctctcttgttgggacctggagaagaggaaggaacagggagcaggggggaagaagaggttgctgcgacggctcaagcctcaagcagacaagcagagaaacaccagttggtcaagatgtcagccggtttccagcttggtgtgatcgggtcacttgcactctctgtcgcatcctcagttgccattgtcatctgcaacaaagctctaatcagcacgcttggttttccgttcgccacaacattaacaagctggcatctgatggtgaccttctgcaccctccatgtggcacatcgcttgcatttcttcgagcccaaggcgattgatggacagacggtgatactctttgggttgctgaatgg

SEQ ID NO: 23438 - protein, 80 aa, Zea mays
  misc_feature: Ceres CLONE 1393692-F
MSAGFQLGVIGSLALSVASSVAIVICNKALISTLGFPFATTLTSWHLMVTFCTLHVAHRLHFFEPKAIDGQTVILFGLLN

SEQ ID NO: 23439 - DNA, 785 bp, Zea mays
  misc_feature: Ceres CLONE 1393699-F
  misc_feature: Encodes the peptide sequence at SEQ ID NO. 23440
  misc_feature (21)..(21): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (752)..(752): n is a, c, t, g, unknown, or other
  misc_feature (785)..(785): n is a, c, t, g, unknown, or other
ccgcgccccccaccagcaacncgcgcccgcggggctaggaaaagagcnnnnccaaagctggagctccccgcggtggcggccgctcttcccatagtggatcccccgggctgcaggtattcgcacgagaccattacctagaacatcctaatcgaaaaacacttattagcttcctaatttcaattattgtatttcagtcgagttgctaaacaacacgaactcagtcgtttgagttttgaggaggcaagcaagaggacccatcgatggcctccttgaagaaccactgtgccgcggcgccagcagttgtagtggctatctgcttcgtcgtcctcgccgccgccctcccttcagatgcttcgacggcggcggacgagccggcgaagtataaggccagcagggcgccagcgccgtcccctgcatctgcatcatcatcctacggcccgacgccggaccagcccgtgctcgtcgtccagggcgtcatctactgcaagccctgcaagctcaggggctaccacagaggcatggacgcgtcccctctccacaatgcgacgtcgagccctggtgtgaccaccgctacgcccaagagcaagcaaccgggctgctgaaaccagaggtggcacggtccaccggacacagaacgggctcacttccatcgcggatggatgaaccaacggggggcccatgtttccgcaccggcccgaaaacatgccccgcccttgaaaacctaccggattcccctccagtccggaacgggnaggattccttgacggcacgtggggggacactan

SEQ ID NO: 23440 - protein, 113 aa, Zea mays
  misc_feature: Ceres CLONE 1393699-F
MASLKNHCAAAPAVVVAICFVVLAAALPSDASTAADEPAKYKASRAPAPSPASASSSYGPTPDQPVLVVQGVIYCKPCKLRGYHRGMDASPLHNATSSPGVTTATPKSKQPGC

SEQ ID NO: 23441 - DNA, 684 bp, Zea mays
  misc_feature: Ceres CLONE 1393703-F
  misc_feature: Encodes the peptide sequence at SEQ ID NO. 23442
  misc_feature (643)..(643): n is a, c, t, g, unknown, or other
  misc_feature (665)..(665): n is a, c, t, g, unknown, or other
aaagctggagctccccgcggtggcggccgctctagaactagtggatcccccgggctgcaggaattcgcacgagaccattacctagaacatcctaatcgaaaaacaatgcttacaaaacccatccatcattttagctgttgatacaaagagaagggaatggccgagataaccctagagccgagtgatcttatggcgcaaacaaacaaaagaatagtgccaaagttcactgaaatcttccccgtggaggacgcgaactacccttacagcgccttcatcgcgtcggtccggaaagacgtgatcaaacactgcaccgaccataaagggatcttccagcccgtgctgccaccggagaagaaggtcccggagctatggttctacacagagctcaaaactaggaccagctccatcacgctcgccatacgcatagacaacctgtacctcgtgggcttcaggaccccgggcggggtggtggtgggagttcggcaaggacggcgacacccacctcctcggcgacaaccccaggtggctcggcttcggcggcaggtaccaggacctcatcggcaacaagggtctggagaccgtcaccatgggccgcgccgaaatgaccagggccgtcaacgacctggcgaagagagagatgggncccaaccctgggaggaagaggnagtgcaaatgcagatgcaa

SEQ ID NO: 23442 - protein, 176 aa, Zea mays
  misc_feature: Ceres CLONE 1393703-F
  misc_feature (18)..(176): Pfam Name: RIP Pfam Description: Ribosome inactivating protein
  misc_feature: SWISSPROT Homolog: EC 3.2.2.22 rRNA N-glycosylase
  misc_feature (163)..(163): Xaa is any aa, unknown, or other
  misc_feature (170)..(170): Xaa is any aa, unknown, or other
MAEITLEPSDLMAQTNKRIVPKFTEIFPVEDANYPYSAFIASVRKDVIKHCTDHKGIFQPVLPPEKKVPELWFYTELKTRTSSITLAIRIDNLYLVGFRTPGGVVVGVRQGRRHPPPRRQPQVARLRRQVPGPHRQQGSGDRHHGPRRNDQGRQRPGEERDGXQPWEEEXVQMQMQ

SEQ ID NO: 23443 - DNA, 710 bp, Zea mays
  misc_feature: Ceres CLONE 1393712-F
  misc_feature: Translation starting site: 129
  misc_feature: SWISSPROT Homolog: EC 2.7.1.48 Uridine kinase
gctctatactagtggatcccccgggctgcaggaattcgcacgagaccattacctagaacatcctaatcgaaaaaccagaaacccgcgaatcaatcccgaatcccgatcgaccggcggcgcgggaggcgatgccggacaaggcggtggacgacgtcatggaggccgcggtgggggcccacttcagcggcctccgcctcgaggcgctgcgcctctccacctctgcgccctcttccccttcctcctcccccgccgccgcggcgcacacgcactccaacggagccgtctacgccaacggcaccaccgagcttccctctcctgccgctgcccggcagccattcggtcatcggggtttctggagggacggcgtcggggaagacgacggtgtgcgacatgatcatccagcagctgcacgaccaccgtgtcgtgctcgttaaccaggatttcgttttaccgtggccttactggctgaagagcctgcacacgcacaagactatcatctttgatccccctcgccgcttttgatacggagcaactttctacaatgcacgggccactgctgaaatgtgctccaacctggtaattgctcctaccctatccctatcagccactcctccgcccgctgtccctacacagctccttctaaacgcgcccctgctcccttaattgcccagctcttgtcccaccatccgtctcagcatttattcgcctcg

SEQ ID NO: 23444 - DNA, 653 bp, Zea mays
  misc_feature: Ceres CLONE 1393716-F
aaagctggagctccccgcggtggcggccgctctacaactagtggatcccccgggctgcaggaattcgcacgagaccattacctagaacatcctaatcgaaaaataggaaaaacgactccacacggtccacggcgtcgtctccggcgaaccttcgcgagccctcggctcccctctaccaccgctgccgcgaccccgcctacggagcatcctcgggtagcgctctggcttcccgtgccggcggacgtcctgcaggaggcggcggcctccgtggcatgttgatgagggccgtcgctggcctccctcgccgatcgtcgcgctactcggagccgcaggcaacctgcagcagaatcttagctttagcagccttgttcctccgacatccggcagacctattacaggagttacctttgctgcgtttgctggcacaaatctcagggtacaactgctaccacaacttgtggtaggaaaccctgctgcctactcttcagcacaggaggttctttcccttcacccagtgggtgcattgaactctggctgcttatttggcacaccactaccattcaggcaggtagttgctggccaccccccgcaatttcttcccattcaacccagtgggagaattgaaactccgctggctatttaacaaagggaac

SEQ ID NO: 23445 - DNA, 733 bp, Zea mays
  misc_feature: Ceres CLONE 1393719-F
  misc_feature: Encodes the peptide sequence at SEQ ID NO. 23446
  misc_feature (684)..(684): n is a, c, t, g, unknown, or other
  misc_feature (685)..(685): n is a, c, t, g, unknown, or other
ccccgcggtggcggccgctctagtactagtggatcccccgggctgcaggaattcgcacgagaccattacctagaacatcctaatagaaaaactgccaactcgcacgcagcagtacgacgtctctcctctgggtctggggccgagacaccgagcacgtactaccagcaagatggtggcgtctcccagattcaagcccatcgaggagtgctgctcggaggggcggtcggagcagacggtggccgccgacctggacggcacgctgctcatctccaggagcgcgttcccctactacctcctcgtggctctcgaggccggcagcgtcctccgcgccgcgctgcggctcctgtccgtgccgttcgtctacgtcacctacgccttcttctccgagtcgctggccatcagcacgctggtgtacatctccgtggcggggctcaaggtgcgcagcatctagatggtggcgcgctccgtgctccccaggttctacgcgggcgacgtgcacccggagagctggagggtgttcagctccttcggccggcgctacgtcgtctcggccagcccccaggtcatggtcgagcccttcgccagggccttcctaggggccgacaagttcctcgggaacgagctggaggccgtacccaccccctggtccaccttgttccggacagtcccgctgtggctccttgnntatttcaacagaattgttttttctcgcgctctcgttacacggtcgtct

SEQ ID NO: 23446 - protein, 93 aa, Zea mays
  misc_feature: Ceres CLONE 1393719-F
  misc_feature: SWISSPROT Homolog: EC 2.3.1.15 Glycerol-3-phosphate O-acyltransferase
MVASPRFKPIEECCSEGRSEQTVAADLDGTLLISRSAFPYYLLVALEAGSVLRAALRLLSVPFVYVTYAFFSESLAISTLVYISVAGLKVRSI

SEQ ID NO: 23447 - DNA, 696 bp, Zea mays
  misc_feature: Ceres CLONE 1393726-F
  misc_feature: Encodes the peptide sequence at SEQ ID NO. 23448
acccgcggtggcggccgctctattaactagtggatcccccgggctgcaggaattcgcacgagaccattacctagaacatcctaatcgaaaagtcgccagatctcccccagggacgcgctcatccttttgcctcccaactgtgctgtgcaggaacctgcggggaaggcggtcgctcgctcgctgagaggatgcctctggggctgacgctgggctcgctggggcggtcgatgcgccggaagcggctgtcctcgctcgacatcctctcctccaagcgggcgccgcgggattactacaagggcaagaactgcaagcccaccgggttccacacccgcaaaggtggatatgtgattgttgatgaaaagttgccaagatttgtggtccctgacttgactgatttcacgctgaaggcatacgtgtcacaatgcgccagggacctcacagcgtcgacagcatcctctacttcagcagaaagtactgaaagcaagagctgatctgatctttgcttgcggggaggcagcccaactctgaagttatgtttccctagactgcccatgttccgaggattagcatcagcattctagctacaaacatttcagatatctttcttgtaagggcaaacattatggcataactagattcccttttcctgcttgtagaggatgcacccgacgctgtccctcgccgaatatcaaccct

SEQ ID NO: 23448 - protein, 100 aa, Zea mays
  misc_feature: Ceres CLONE 1393726-F
MPLGLTLGSLGRSMRRKRLSSLDILSSKRAPRDYYKGKNCKPTGFHTRKGGYVIVDEKLPRFVVPDLTDFTLKAYVSQCARDLTASTASSTSAESTESKS

SEQ ID NO: 23449 - DNA, 698 bp, Zea mays
  misc_feature: Ceres CLONE 1393728-F
  misc_feature: Encodes the peptide sequence at SEQ ID NO. 23450
cgcggtggcggccgctctataactagtggatcccccgggctgcaggaattcgcacgagaccattacctagaacatcctaatcgaaaagatttcctcgtcatttctctcatccgctgcgctccctctcccactcggcgaagaagggggaaaaaagctcgaaagcgggagccggcgagcgagatgggcgcagggagcagccgcgcggacgcgccgtcgcggcgccgggcgcgcctcagcctcggcgggtgcttcggggccggatcctcctcgtccgcgcacgacggcgggagcttcgccgcggccgggccctcctcctcgcgcgccatcgaggtacaatcacgacagtcagggcgacaagtgagtgccctgaattttcaggcttctctagctgctaaggatctccaggtttccagtgagtcaaatccaaggctgcattcgtcttcaagcaccataagccatcatctcagattcaatcacctcaattaccatgaaaacaaggaagatggcctggcggctgaaaacgctgaaaaaattggtccttcaagcccatctaggaaacctgtcatgggaaagcgcacccaccctcaatgtacctcgctgacgctgcaccaccctccacacgcctctccgtctcttccactccttgacgcccgcccaagcctatctatgtaccggataatccaccccccccacctccg

SEQ ID NO: 23450 - protein, 172 aa, Zea mays
  misc_feature: Ceres CLONE 1393728-F
MGAGSSRADAPSRRRARLSLGGCFGAGSSSSAHDGGSFAAAGPSSSRAIEVQSRQSGRQVSALNFQASLAAKDLQVSSESNPRLHSSSSTISHHLRFNHLNYHENKEDGLAAENAEKIGPSSPSRKPVMGKRTHPQCTSLTLHHPPHASPSLPLLDARPSLSMYRIIHPPHL

SEQ ID NO: 23451 - DNA, 720 bp, Zea mays
  misc_feature: Ceres CLONE 1393729-F
  misc_feature: Encodes the peptide sequence at SEQ ID NO. 23452
gctccagaactagtggatcccccgggctgcaggaattcgcacgagaccattacctagaacatcctaatcgaaaaaaccccaccagaccttcaaccgctacatttccgtcactaccggagccgccactccgacgaacgcgggcggcggagcggaagcgaaccagagcaccggtaaaaagaaaaggatgaggcttgggagtataaacggcttgcggttcacgcagcttaaacttgtcatccttgcgttcttcatgttgtttgttctctggaaatgggagaagggctcgtcatactacgattccgaaatcctccagccagatccggttggttctgactcatccagctaactcgaagtttgtagaccagcatacatccccagaagaagactttccaagtgcagatcgatcaccccggccaggaggtaaagtagaaaagccggttactaggggcgctgccaccattgtctacgataggctatttctgttgatgttgcagaggggcaatgaacgcgccccctccctgacacagaaaccccgcgagcacaggaatggcatacgtgggcttcccgccaatccgagacccccacacccccgccgccccggcccccacccccaccgcccggccccgagccgcggcgcccacgcgcccgcccgcccgcgccggtctctcccccccccccccgccttcgcccccccgcccctccctcattccccgccccgcc

SEQ ID NO: 23452 - protein, 53 aa, Zea mays
  misc_feature: Ceres CLONE 1393729-F
MRLGSINGLRFTQLKLVILAFFMLFVLWKWEKGSSYYDSEILQPDPVGSDSSS

SEQ ID NO: 23453 - DNA, 767 bp, Zea mays
  misc_feature: Ceres CLONE 1393730-F
  misc_feature: Encodes the peptide sequence at SEQ ID NO. 23454
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (25)..(25): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (74)..(74): n is a, c, t, g, unknown, or other
  misc_feature (77)..(77): n is a, c, t, g, unknown, or other
  misc_feature (767)..(767): n is a, c, t, g, unknown, or other
tgcccccccccnnnnccccccccancacggnnnngggtgccccccccaacacagctggagctccccgcgggggnggncgatcatacaaaaaagagcccccgggctgcaggatttcgcacaagaccattacctagaacatcctaatcgaaaactccatcctaaacccttttacccctctccatccccatcccctccaatggcggcgactgccacgtccttcgccactctcgccgtcgcgcgctcggcggggcagcggtccctccttgcctccaaggccgccccctcgccgctcctctccctccgcggcgcccgcctcccctcgcagggcgtctccttatctgggggcctcgcggcgacgccctctcatagtctagcgagcttcgccacatcagccagcgccgagcccaaggaagtagaacttcagccgaaaatcacaaacaaggtgtactttgacataaccctcgggaaccctgtgagaaagaatgctggcaggatcgacatcggcttgtacgggaatgatgctccacagacaacagagaacttccgggctcttcgcaccggggaaacagggcattgaaaaacaagggatccaagtttcctcgcggccatcagacgacttttatgattcacgggcgacaaatatttgaacaaggggaaagggtcaccgggcgggaaaaaacctgattaaggaacccccacccttccaagagagaaaaaaccttcagacgttgggtctaaacacctggaaaaatggaaaaagggcctcn

SEQ ID NO: 23454 - protein, 126 aa, Zea mays
  misc_feature: Ceres CLONE 1393730-F
  misc_feature: SWISSPROT Homolog: EC 5.2.1.8 Peptidylprolyl isomerase
MAATATSFATLAVARSAGQRSLLASKAAPSPLLSLRGARLPSQGVSLSGGLAATPSHSLASFATSASAEPKEVELQPKITNKVYFDITLGNPVRKNAGRIDIGLYGNDAPQTTENFRALRTGETGH

SEQ ID NO: 23455 - DNA, 609 bp, Zea mays
  misc_feature: Ceres CLONE 1393731-F
  misc_feature: Encodes the peptide sequence at SEQ ID NO. 23456
  misc_feature (284)..(284): n is a, c, t, g, unknown, or other
tccccgcggtggcggccgctctataactagtggatcccccgggctgcaggaattcgcacgagaccattacctagaacatcctaatcgaaaaatcgatccgccaccacgccacaaaatcctctcctactccggcagttctgctcgccgccgcctccacgatgacggaagacgtgcagatgaacgactcggagccccagcctgcggcctcagctcccgccgtcggggcgccggcgctctccactctacaccatctgaaggagatcgcgtccgtgatcgagcccggntctctgtccaaggaggtccgccggatctcccgggcttccggctcacgtggggttcggtcgcggctcgccggggggaaagtttccgcttcctccgcttggggtaaccgggcccccaaaacaaagggcccctctggccgggggcccaggaaaaaaaaccgaaaggggtgggtggggggcccccccccctcttttttcaaaaaggggcccccccaggaaaaaaaatttttccccgccgccgaagtttttttttattggaaaaaaaaaaaatttctttaaatacgcggcccggggggggtattttcccccccaaaaaaaaaaacaaaag

SEQ ID NO: 23456 - protein, 133 aa, Zea mays
  misc_feature: Ceres CLONE 1393731-F
MTEDVQMNDSEPQPAASAPAVGAPALSTLHHLKEIASVIEPGSLSKEVRRISRASGSRGVRSRLAGGKVSASSAWGNRAPKTKGPSGRGPRKKNRKGWVGGPPPSFFKKGPPQEKKFFPAAEVFFYWKKKKFL

SEQ ID NO: 23457 - DNA, 864 bp, Zea mays
  misc_feature: Ceres CLONE 1393732-F
  misc_feature: Encodes the peptide sequence at SEQ ID NO. 23458
  misc_feature (65)..(65): n is a, c, t, g, unknown, or other
  misc_feature (95)..(95): n is a, c, t, g, unknown, or other
ccccccccccccccttccgtccggttctaaacccccccccccaagctggggctccccgcggaggngggcggtctatactaaagaatcccccgggntggaggaattcccacgagaccattacctagaacatcctaatcgaaaaatcgatccgccaccacgccacaaaatgcctctcctactccgggagttctgctcgccgccgcctccacgatgacggaagacgtgcacatgaacgacccggagcccctgcctgcggcctcagctcccggcgtcggcgcgccggcgctctcgactctacaccatctgaaggagatcgcggccgtgatcgaggccggctctctgcccaaggaggtccgccggatcttcccgcgcctcccgcctcaacgacgcgctccgccgccggctcgccgagcggcacgacgtcgctttcttcgcgctcgctggtcacgcggcctcccagtcctacggacgccgtcgcgcccggcggcccagggaaaccaaatgttgaccagcgcccacctctgcgccgccttcagccgcactcgattcttccatccccggcggttcgtagttcctaacgagttgttccgccccccccgcacccggtacttgtttcgcacttgtctacataatcttcctcatactcgccacgcgcgccgtcaggcgtgttcccgcgctgcgcctgccttttccccccgtcggctagcaaggcgcgggctgacgtgacaggccctgcgctgagtacggccacgcgctgcgtgcctagagcctgcgcatagtaaaagacgccctaattcccgcctttcttatctacccaccttgctctcccaaccgtcccgaatcgctctccggctaaatagttaa

SEQ ID NO: 23458 - protein, 74 aa, Zea mays
  misc_feature: Ceres CLONE 1393732-F
MLTSAHLCAAFSRTRFFHPRRFVVPNELFRPPRTRYLFRTCLHNLPHTRHARRQACSRAAPAFSPRRLARRGLT

SEQ ID NO: 23459 - DNA, 705 bp, Zea mays
  misc_feature: Ceres CLONE 1393733-F
  misc_feature (501)..(501): n is a, c, t, g, unknown, or other
  misc_feature (558)..(558): n is a, c, t, g, unknown, or other
  misc_feature (621)..(621): n is a, c, t, g, unknown, or other
  misc_feature (625)..(625): n is a, c, t, g, unknown, or other
gctctagaactagtggatcccccgggctgcaggaattcgcacgagaccattacctagaacatcctaatcgaaaaagaaaatacgcacctgctcctcactcttctttatatttttttctccatttggcaacttttgcttgtcgttcatgtatatgcatgaccctttcacacatatgatcagaagataagcacatgcaagacgatctcgcgtggatatgatgcatggatcagacctaacctctatatcatcaccaaacgctcgtagatgatgctatacaattccatgattaaattatatataagtaaaaaaaaaagaaccgtacgtgcatacataaaattaagaattaatggctgccaatggacgacatatgcatggacaggtaagctggtgatcccactgaaccgggaggcgcccaacttccggtccatgatcgggatgatcgacgggaggacggagctgaagccgctgccagccagcggcggcccagaggaccggcggctngcaggtggtggccgtctccgccggccgccggatccgggcggcgatgactaatacttnggacgtggagagcggccagcgcggcggtgccgctggtgcagcagcagtacgggaacgggcggntcgncccgctccgcaccttctccgtggtcgaggggaagcatggatgccgccaaaactccctaacaaaacgccgcctacatccaa

SEQ ID NO: 23460 - DNA, 734 bp, Zea mays
  misc_feature: Ceres CLONE 1393736-F
  misc_feature: Encodes the peptide sequence at SEQ ID NO. 23461
  misc_feature (399)..(399): n is a, c, t, g, unknown, or other
  misc_feature (400)..(400): n is a, c, t, g, unknown, or other
  misc_feature (454)..(454): n is a, c, t, g, unknown, or other
  misc_feature (581)..(581): n is a, c, t, g, unknown, or other
ggagctccccgcggtggcggccgctctagaactagtggatcccccgggctgcaggaattcgcacgagaccattacctagaacatcctaatcgaaaaactagtcccaactcccaaccaccgccagccgtccgctctccgcaagcgcgaccttccggccagatccgccgcgtcgcgccgacgagcggtccttctgcctagtttctccgcccagcgagcggcgggttcctcggagattcccgctggccgcggggatccatttgtgactgctcgcgttgcgcctggatctggtttgggacggaggagtgaaacgcgacggtgatcgtgcgaggtgggacgccatcagtgctctgtctggggttcggtctcttcttcggctgcagatctggaagggtttcgtgnnatccgtcgctacgatctgtcccagtcagagcacctgcatcatctcgggtcgggncatggagactctgctcatctcggaggaacgcaaccaccagctccaccacttctcgggtcggcgaaagaaggcgtcaccacctttccctcaatctactcgcacctactatgcggggaaacttgcgatnatatcctctccggcaaaaacgtggtatctcttgccggcccccccccgtgcagaaccgttctcctgtgccgcttccccccttggtccccggcacctcttattcttatgcttccgctgctcgaaatggcgccacgccgacattcgctacattctt

SEQ ID NO: 23461 - protein, 93 aa, Zea mays
  misc_feature: Ceres CLONE 1393736-F
  misc_feature (42)..(42): Xaa is any aa, unknown, or other
METLLISEERNHQLHHFSGRRKKASPPFPQSTRTYYAGKLAXISSPAKTWYLLPAPPRAEPFSCAASPLGPRHLLFLCFRCSKWRHADIRYIL

SEQ ID NO: 23462 - DNA, 691 bp, Zea mays
  misc_feature: Ceres CLONE 1393738-F
  misc_feature: Encodes the peptide sequence at SEQ ID NO. 23463
  misc_feature (498)..(498): n is a, c, t, g, unknown, or other
  misc_feature (514)..(514): n is a, c, t, g, unknown, or other
  misc_feature (520)..(520): n is a, c, t, g, unknown, or other
  misc_feature (533)..(533): n is a, c, t, g, unknown, or other
  misc_feature (536)..(536): n is a, c, t, g, unknown, or other
  misc_feature (555)..(555): n is a, c, t, g, unknown, or other
cgctcttcactagtggatcccccgggctgcaggaattcgcacgagaccattacctagaacatcctaatcgaaaaaaagagattggctggatctatggttcagtaacggaggatattctgactgggtttaaaatgcatgcaaggggctggcaatcaatctactgcatgccaccacgaccttgtttcaagggttctgcaccaatcaatctttccgatcgtcttaatcaggtgctccgttgggctcttgggtcagtggaaattctgcttagtagacattgtcctatctggtatggttacaatggacgattgaagcttttggagaggctggcttacatcaacactattgtatatccaatcacatccattccgcttattgcctattgtgtgcttcccgctatctgcctccttaccaataaatttatcattcctgagattagcaattatgctgggatgttcttcattcttcttttcgcctccatttttgccactggtatattgnagctcagatggagtgntgttgncattgaagattgntgnagaaatgagcagttttggnttattggtggcacctctgcccatctcttccagtgttcccaggtcttgttgaaagggtgtgctgggaatgataaccaactcacaattacctcacaggatccgatggaggagcccactttgctgaaccaaaaggcgtc

SEQ ID NO: 23463 - protein, 229 aa, Zea mays
  misc_feature: Ceres CLONE 1393738-F
  misc_feature: SWISSPROT Homolog: EC 2.4.1.12 Cellulose synthase (UDP-forming)
  misc_feature: The sequence is a functional homolog of SEQ ID NO 6 in US patent 7285702
  misc_feature: The sequence is a functional homolog of SEQ ID NO 2 in US patent 7049481
  misc_feature: The sequence is a functional homolog of SEQ ID NO 26 in US patent 7312377
  misc_feature (166)..(166): Xaa is any aa, unknown, or other
  misc_feature (171)..(171): Xaa is any aa, unknown, or other
  misc_feature (173)..(173): Xaa is any aa, unknown, or other
  misc_feature (177)..(177): Xaa is any aa, unknown, or other
  misc_feature (178)..(178): Xaa is any aa, unknown, or other
  misc_feature (185)..(185): Xaa is any aa, unknown, or other
LFTSGSPGLQEFARDHYLEHPNRKKEIGWIYGSVTEDILTGFKMHARGWQSIYCMPPRPCFKGSAPINLSDRLNQVLRWALGSVEILLSRHCPIWYGYNGRLKLLERLAYINTIVYPITSIPLIAYCVLPAICLLTNKFIIPEISNYAGMFFILLFASIFATGILXLRWSXVXIEDXXRNEQFWXIGGTSAHLFQCSQVLLKGCAGNDNQLTITSQDPMEEPTLLNQKA

SEQ ID NO: 23464 - DNA, 685 bp, Zea mays
  misc_feature: Ceres CLONE 1393739-F
  misc_feature: Encodes the peptide sequence at SEQ ID NO. 23465
  misc_feature (502)..(502): n is a, c, t, g, unknown, or other
gctctagaactagtggatcccccgggctgcaggaattcgcacgagaccattacctagaacatcctaatcgaaaaactggattcttctctcttctctttctctgagtcgcagcttcggcagctggcggtctggtctacggtctaccactaccactctaccagagaggggatcgatcacacaaacacacccatggcgggctgcgcggcggcgcgcatgttcgcgtacaacgccagcctctgcgcctgcgatccggggtactactactacctcagcagcaacggcaccgcgagctgcatcccgatgccgggcggcgggtggggcgactggcaggtgggctccgtgggcgcgccgaggaaccagagcctctacttcctggagccggtgctctcggtctacgccatccgccgcctcacccagtcccaggccgtgctcctcgaggcgaccctcgcgtcgctcctctgctggatcgccttctgcgccgcagccaggttcggcggccggnaccccccgcgggagaagaggctgttccggccccggactggaccggcacgcaacagtgcctcctccaccccacgcccgggctgccggtaccggcagctgtcgacccgccgcgccgcgcctgtgcacgcccatgtctccgctgctgcccggcgcagctgctcggcttgcgaaccggcgcggcggc

SEQ ID NO: 23465 - protein, 165 aa, Zea mays
  misc_feature: Ceres CLONE 1393739-F
  misc_feature (105)..(105): Xaa is any aa, unknown, or other
MAGCAAARMFAYNASLCACDPGYYYYLSSNGTASCIPMPGGGWGDWQVGSVGAPRNQSLYFLEPVLSVYAIRRLTQSQAVLLEATLASLLCWIAFCAAARFGGRXPPREKRLFRPRTGPARNSASSTPRPGCRYRQLSTRRAAPVHAHVSAAARRSCSACEPARR

SEQ ID NO: 23466 - DNA, 614 bp, Zea mays
  misc_feature: Ceres CLONE 1393740-F
  misc_feature: Encodes the peptide sequence at SEQ ID NO. 23467
gctttacaactagtggatcccccgggctgcatgagttcgcacgagaccaagacctagaacatcctaatcgaaaacaccgtagggcacataggctctgggctctggcgctaatgttcgagcaaggcgctgctcctgttgctgtagaagggattttttgaccaaccctccaaccggtgcggcttcgatctttcctctcctatcacctgaatccctcgagtattcatcgccggcgcagcgcggtctcttcccttcgctggagaagggggaaggggacacgaacggagcagaaggccatggacacgatgcggggcgcgctggagcgggccaagatgctggtgagcatggaggtcgacgaggagtccgcgttgccaccgcccgaggagcagtccttcttcgacgacatcaatcgggaattggaccctcaaacccacttaaaaggtttcttaggtttccccaaaatatatttggttttcccccgaatttaaacagggccaatatttttttgggaaaaaaaggggtgggtattttccttttttctctacacccggagaaaaaaaaaagtgggggggggggggaaaaaaaaccccccccccccctgttattaagggggcccc

SEQ ID NO: 23467 - protein, 63 aa, Zea mays
  misc_feature: Ceres CLONE 1393740-F
MDTMRGALERAKMLVSMEVDEESALPPPEEQSFFDDINRELDPQTHLKGFLGFPKIYLVFPRI

SEQ ID NO: 23468 - DNA, 715 bp, Zea mays
  misc_feature: Ceres CLONE 1393743-F
  misc_feature: Encodes the peptide sequence at SEQ ID NO. 23469
tccccgcggtggcggccgctctataactagtggatcccccgggctgcaggaattcgcacgagaccattacctagaacatcctaatcgaaaaattcccttccttccttgctcctcccctgcctcgcctctctctctcccctctcctcgcctccagctcctgctcggcccgctcgcgtcgagctgcgcgcgcgcctgcggtggtcgtgaaggacagcccgagggacgcgccgggtgcactgatctgggggccgcgtgtccccggtggtggggcgaggcggcgccggcttccaggaatgggcaacttgtagcgtcggtttcttttgcatatgcactttctattgttgttgtcatttcaaaggaggccatagtctcctggattttgtatgccttgttatctggaattggtgaccatagatgtcattccgtagcatagtccgtgatgttagggatggctttggcagcttgtcgaggagaagctttgaggtgaccctcgcaagcatttatggccttactgggcatcacaaagggaagacccagagctcatcacatggtctcgacgactcaccttccataattcgggaaaggcgaatggcgaatctacctcctgaactcatccgtgatatcatacggagactggagggtgatgaaagcacctggccagcggggaagcacggcctttgccttcccagtggttgaaggacatggagagaaatgg

SEQ ID NO: 23469 - protein, 93 aa, Zea mays
  misc_feature: Ceres CLONE 1393743-F
MSFRSIVRDVRDGFGSLSRRSFEVTLASIYGLTGHHKGKTQSSSHGLDDSPSIIRERRMANLPPELIRDIIRRLEGDESTWPAGKHGLCLPSG

SEQ ID NO: 23470 - DNA, 757 bp, Zea mays
  misc_feature: Ceres CLONE 1393744-F
  misc_feature: Encodes the peptide sequence at SEQ ID NO. 23471
  misc_feature (12)..(12): n is a, c, t, g, unknown, or other
  misc_feature (19)..(19): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (73)..(73): n is a, c, t, g, unknown, or other
  misc_feature (700)..(700): n is a, c, t, g, unknown, or other
gtcctccccctnttttctntttcccgcctcccccggttaaacnnnnnccaaaactgcagctccccgcggtggnggacgctcttgcatagagggacccccgggctgcaggttttcccacgagaccattacctagaacatcctaatcgaaaaaatattattgagacctactaccaacatagaaagcacaatagtgtaccaacaatggcagccaaaatatttcgcttcctaatgctccttgctctttctgcacgtgctgctaccgcaaccattttcccacaatgctcacaagctcctatagcttcctttcttcccccatacctctcaccagcggtgtcttcagtatgtgaaaacccaattcttcaaccctacaggatccaacaggcaatcgcagcaggcatcttacctttatcacacttgtgcctccaacaaccggcagccttattacagaagccacctctccccgcatttgttgccacagaacatcgaggcacatcaactacaaccaacttgcgctaagaaaccttgctgcctactctcaacaacagcagattcttccctcaaacccaatagctgcattgaacctccgctgcttattagcatcaacaactacccattcagtccgcaaaacctgcttgcctacccccaagcaatattcttccattcaaacccacccggcccgccataccacccccgggctgcntctatctaaccaaagggcaaaaaagcttaccgcaacattccatgcgccatccccagg

SEQ ID NO: 23471 - protein, 104 aa, Zea mays
  misc_feature: Ceres CLONE 1393744-F
MAAKIFRFLMLLALSARAATATIFPQCSQAPIASFLPPYLSPAVSSVCENPILQPYRIQQAIAAGILPLSHLCLQQPAALLQKPPLPAFVATEHRGTSTTTNLR

SEQ ID NO: 23472 - DNA, 747 bp, Zea mays
  misc_feature: Ceres CLONE 1393745-F
  misc_feature: Encodes the peptide sequence at SEQ ID NO. 23473
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (75)..(75): n is a, c, t, g, unknown, or other
  misc_feature (82)..(82): n is a, c, t, g, unknown, or other
tgggccccccccccccccaccccctcgcccggtaatcaggccccnnnnncccaggctggagctccccgcggtggnggccgtnctcaaataggggatcccccgggctgcattaccccgcacgagaccattacctagaacatcctaatcgaaaaaatcgacggagttatccccgcaacctcgttcagcacgacaggccgccactcctttaggaggttgagatgtgcacgccgacgagatcactggccgggtggtggacgacgacacatgggcaaggggagcgtggggggatcatggtgggcgttcctcctgctcgccggcgtgctgctggtcgtagcagccacggccgagggggaggacggagtggtccaacgggaccgcatggaggacctgcgctggtgcaagaaggtgtgggagtggcagcacggaaaggacaccccgcggaagagggaatgccacagcgagtgccgcgagcgccaccagcaagccgacgcggacgaggacggcgacagcggcgaggacgcctacgtctcccgctccgggaggggagagcgccggcgacggtgcccgcgccggcgagaggggggagtcgtggtgaaacaccagtagagcatgcaggcgggacccacgccgtggattggcccgtcccacccgggcggaacgagtcagtggcggcggatcgcgaggaggcggggcgtagagagggcggcccaggggggggggaaccggtctacctactcggcgggtgga

SEQ ID NO: 23473 - protein, 113 aa, Zea mays
  misc_feature: Ceres CLONE 1393745-F
MGKGSVGGSWWAFLLLAGVLLVVAATAEGEDGVVQRDRMEDLRWCKKVWEWQHGKDTPRKRECHSECRERHQQADADEDGDSGEDAYVSRSGRGERRRRCPRRREGGVVVKHQ

SEQ ID NO: 23474 - DNA, 701 bp, Zea mays
  misc_feature: Ceres CLONE 1393747-F
  misc_feature: Encodes the peptide sequence at SEQ ID NO. 23475
  misc_feature (523)..(523): n is a, c, t, g, unknown, or other
tcaccgcggtggcggccgctctagaactagtggatcccccgggctgcaggaattcgcacgagaccattacctagaacatcctaatcgaaaacccgttagttgcccagccccagacccagagaggagggcgacgaacacacggtgacggagagccgagtggacaggacaggagcgcggagggaggaggaaacaaagcagaaaaagcaacccccgtcttccatcttcgcggaacgacgcccatctggcctgcccatctctttcgtgctcctaccccccgccttcttccgccctcaaggcttttccttccttctcatcttctgctcggaccggggacgggccgacggggacagggacaaaaggtggtgcgatcttgttcggcacagagagagagagagagcgacggagggtggcagggccgccgcgccggtgagccgacccccagccatggcattgccggctccccccgtccgcctggcgctgctgctgctcgtcgcgctgccattctgcgcggcgcatcccgggncgggaaccttctatgctcctccgcactttcagatgcccgcgctccactctgatggatttgggattggggcaagaagaccgattgctgaacttcctgctcacttcacctctctacgaactcctctcttgtgatgcctaataatggactcatcaaatgtactcttttgatggcttcacaa

SEQ ID NO: 23475 - protein, 69 aa, Zea mays
  misc_feature: Ceres CLONE 1393747-F
  misc_feature (27)..(27): Xaa is any aa, unknown, or other
MALPAPPVRLALLLLVALPFCAAHPGXGTFYAPPHFQMPALHSDGFGIGARRPIAELPAHFTSLRTPLL

SEQ ID NO: 23476 - DNA, 694 bp, Zea mays
  misc_feature: Ceres CLONE 1393749-F
  misc_feature: Encodes the peptide sequence at SEQ ID NO. 23477
  misc_feature (694)..(694): n is a, c, t, g, unknown, or other
gctcatacctagtggatcccccgggctgcaggatattcgcacgagaccattacctagaacatcctaatcgaaaaaatctgaagcaaaatgtaccgggaatgttgaagagcgggactcttaagcagtagtgagatgcggcggtggtggtcgccggcgttggcggctgtggagccgcggtccgtgcagctcctgctcctgggcgtcgctctcgtcgcagcttctttctacgccggcaccctcttcggctcctccgcgtcccctgcgctcgtactgcccccttcgcgcccccgatcgcccgattccttcagggccaaagttacagatgttccagtgtttaccaacagagtttctcggacgtaccggccaaaatcagcgacagctcccccccccgcagctgatgtgtgtcctttggaatacgctgagtatgccccctgccatgatgtcgcctatataactgcctcgcccagcctggatacatcttagcctgaggatcttggccgcttttgccctcctttgctatacgtcgttgctcttgtctgccgcgcccctcgacctgtctagctagtacccccttttttcgccaccctgtcggaccagtcttctgcccccccttctgctcttccattccccccttttttcgtgctccccctccctgcgtggtctgcgtgcttcgtctcgccgcccaccgctcccn

SEQ ID NO: 23477 - protein, 116 aa, Zea mays
  misc_feature: Ceres CLONE 1393749-F
MRRWWSPALAAVEPRSVQLLLLGVALVAASFYAGTLFGSSASPALVLPPSRPRSPDSFRAKVTDVPVFTNRVSRTYRPKSATAPPPAADVCPLEYAEYAPCHDVAYITASPSLDTS

SEQ ID NO: 23478 - DNA, 760 bp, Zea mays
  misc_feature: Ceres CLONE 1393755-F
  misc_feature: Encodes the peptide sequence at SEQ ID NO. 23479
ccgcccgccccccccccccccccccagggttgaaggagaacccgggaggcccaagctggagctccccgcggtggcggccgctcttacaatagtggatcccccgggctgcaggtaattcgcacgagaccattacctagaacatcctaatcgaaaaagcgccagctgcctcacggcttcatcatcactccactagccagccagctactggcctacaggtaggcgcctcctctcctctcatcccatcccagctcatctccgacaagcgaaggagagcactggtatgagcatggaccgcatggcgcggagttccgtgcccttgctcctcgctctggatctccgggccgacgcggaagccgcggactcgtggctgtaggagaaggtcacgacggatggctacctgcgcacgcactagagcgcgcagggggaagacgtgacgcctctgatcgtggggcagcagtcgggcggcggctgcggctcgcggcctaatgaccggcacggggagcctccgcatcccggatgaggctggatcgcgggcaactcccgaggttgaccgggcacctcccgtctaactggaaggccgccggacggaggccgagcccccggcgagcatgcccgtgcgagggtcgtgcggcggcggacagccggcgcagccccggtgggggctggaacccccggggcgggcgggcccggacggttgcatcggcgaacgaaagccagcccccaagagctctagcatggaggacacccaacccgaatccgc

SEQ ID NO: 23479 - protein, 30 aa, Zea mays
  misc_feature: Ceres CLONE 1393755-F
MSMDRMARSSVPLLLALDLRADAEAADSWL

SEQ ID NO: 23480 - DNA, 803 bp, Zea mays
  misc_feature: Ceres CLONE 1393756-F
  misc_feature: Encodes the peptide sequence at SEQ ID NO. 23481
  misc_feature (7)..(7): n is a, c, t, g, unknown, or other
  misc_feature (8)..(8): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (39)..(39): n is a, c, t, g, unknown, or other
  misc_feature (45)..(45): n is a, c, t, g, unknown, or other
  misc_feature (47)..(47): n is a, c, t, g, unknown, or other
  misc_feature (48)..(48): n is a, c, t, g, unknown, or other
  misc_feature (53)..(53): n is a, c, t, g, unknown, or other
  misc_feature (59)..(59): n is a, c, t, g, unknown, or other
  misc_feature (60)..(60): n is a, c, t, g, unknown, or other
  misc_feature (63)..(63): n is a, c, t, g, unknown, or other
  misc_feature (65)..(65): n is a, c, t, g, unknown, or other
ttccccnncccccccnnnnnnnnnncnnnnnnnnnnccncccccncnnccccncccccnnccntncccctcccccccgacaaagctggagctccccgcggtggcggccgcttacgaacagtggatcccccgggctgcattccttcgcacgagaccattacctagaacatcctaatcgaaaattcgcgaaaagaaaaacacaaggcgaccgcagagggcaggacaggacagagacgccgaggctaggcagtccatctgttggggtggccagtggggatctcgccggccgggaggtctggggggcgggggctgccaaacttcgccatattggtgaatcactgaatccgcccctgccagcaaccgttctgacgtggcggggtggggcaggatccaaatggcggcggcaatagaggaactgcggctcctgggatccatccctgtactggaaggtccgggagaggtcgacggcgtgttgggtgaggaagggcgaccgcgaggcggcggcgacgacgaggagatcctgcgattcatggactcggtggacagctacctgctcctcatggactccctatccctcggctcttcctcagggctggctttgacctggcaaggggtcgccatttctatgggcaccatcacgcggtttccagtaaactggtttgatcacaaggaagaaagtctgcttggcaactaaagcttccaaagttgtgtgaacattgggggggcccgggaaaatccctccaaaagtccaataaccacccactctttggctttcaaattcaagaagggggtaccctttggcag

SEQ ID NO: 23481 - protein, 99 aa, Zea mays
  misc_feature: Ceres CLONE 1393756-F
MAAAIEELRLLGSIPVLEGPGEVDGVLGEEGRPRGGGDDEEILRFMDSVDSYLLLMDSLSLGSSSGLALTWQGVAISMGTITRFPVNWFDHKEESLLGN

SEQ ID NO: 23482 - DNA, 684 bp, Zea mays
  misc_feature: Ceres CLONE 1393767-F
  misc_feature: Encodes the peptide sequence at SEQ ID NO. 23483
aaagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggcgacgctgttcccgctgggcgggctgctgctggtgctgtcggggctggcgctggacgcctccgtgtggggggctggccgggggccacgccgggtgttcctgaatctccagccccgtggtgggccccggcgggctggttattggggacggccgtaatgggggtcccccacgtccggcggcctgggggttcggggggccgggccctccgtccacggggccccccaaacgggggggggaagggggttccacggcacccccgggaaaatgggggagggggggccccccccaagaatggggggaagccccccggtcccccgggggccaaa

SEQ ID NO: 23483 - protein, 102 aa, Zea mays
  misc_feature: Ceres CLONE 1393767-F
MADRDRSGIYGGAHATYGQQQQQGGGGRPMGEQVKGMLHDKGPTASQALTVATLFPLGGLLLVLSGLALDASVWGAGRGPRRVFLNLQPRGGPRRAGYWGRP

SEQ ID NO: 23484 - DNA, 702 bp, Zea mays
  misc_feature: Ceres CLONE 1393770-F
  misc_feature: Encodes the peptide sequence at SEQ ID NO. 23485
  misc_feature (386)..(386): n is a, c, t, g, unknown, or other
gctctataactagtggatcccccgggctgcaggaattcgcacgagaccattacctagaacatcctaatcgaaaaatatgactctctccctagtccctacactttctcccccgtgtcccgttgctaaaagcttagagaaaaacctaatcggacagcactgtggccaagcagggcgcgggagatcgtacgccggcggcgaggtcctgcggtggcgggcctcggcagagtggtggtgctagcggagtgcagctgttgggttggtgggtaagagtgagaaggacatgaaggcgctgcggcgatccagcacctcgtcctcgccgacggccgcgtcctcccctccgtcctcatcgtggatccacatccggtcgctcctcgccgccgccgcgncctcgtcctcgtcctcctccttcgcagtgagtgcgtctgtaacgcgcgtgggttgggggcgcgcactccatgagccccaccgcgcttcaccccgtgacgagcgcgagctcgccggggcccccccgctggcgtcttggatcgcgatctgcgtttttatctggtggacggccggcggttcttgttgactccgctatccacccttccctctcactcgcctcgccctctatatatatgtgccctgccgctaccccccctccggtccgcctcctcccgcgtcccagccctcgtcgctcccctcccccccggtcgcccccgc

SEQ ID NO: 23485 - protein, 96 aa, Zea mays
  misc_feature: Ceres CLONE 1393770-F
  misc_feature (36)..(36): Xaa is any aa, unknown, or other
MKALRRSSTSSSPTAASSPPSSSWIHIRSLLAAAAXSSSSSSFAVSASVTRVGWGRALHEPHRASPRDERELAGAPPLASWIAICVFIWWTAGGSC

SEQ ID NO: 23486 - DNA, 662 bp, Zea mays
  misc_feature: Ceres CLONE 1393773-F
  misc_feature: Encodes the peptide sequence at SEQ ID NO. 23487
tccccgcggtggcggccgctctacaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcgtcatctacggcggcgcccacgccacctacgggcagcagcagcagcagggaggaggcggacgcccgatgggtgagcaggtgaagggcatgctccacgacaaggggccgacggcgtctcaggcgctgacggtggcgacgctgttcccgctgggaggactgctgctggtgctgtcggggctggcgctgacggcctccgtggtggggctgcccgtgcccacgccggtgttcctgaacttcagccccgtgctggtccccgcccgcgctgctcatcgagacggccgtcatgaagttcctcacgtcgggcgcgttggggctcgggggcctgtcctcgctcaagggcctcgacaacacggcgcgggaaggcgttccagcgcaacccggactacggggaggaggcgcaaccgcaggtatgcggaatgccgtgacgcaacgcgggccaacaggacc

SEQ ID NO: 23487 - protein, 156 aa, Zea mays
  misc_feature: Ceres CLONE 1393773-F
  misc_feature (44)..(140): Pfam Name: Oleosin Pfam Description: Oleosin
MADRDRSVIYGGAHATYGQQQQQGGGGRPMGEQVKGMLHDKGPTASQALTVATLFPLGGLLLVLSGLALTASVVGLPVPTPVFLNFSPVLVPARAAHRDGRHEVPHVGRVGARGPVLAQGPRQHGAGRRSSATRTTGRRRNRRYAECRDATRANRT

SEQ ID NO: 23488 - DNA, 642 bp, Zea mays
  misc_feature: Ceres CLONE 1393783-F
  misc_feature (216)..(216): n is a, c, t, g, unknown, or other
  misc_feature (320)..(320): n is a, c, t, g, unknown, or other
  misc_feature (340)..(340): n is a, c, t, g, unknown, or other
  misc_feature (341)..(341): n is a, c, t, g, unknown, or other
  misc_feature (369)..(369): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (464)..(464): n is a, c, t, g, unknown, or other
  misc_feature (465)..(465): n is a, c, t, g, unknown, or other
  misc_feature (474)..(474): n is a, c, t, g, unknown, or other
  misc_feature (477)..(477): n is a, c, t, g, unknown, or other
  misc_feature (488)..(488): n is a, c, t, g, unknown, or other
  misc_feature (489)..(489): n is a, c, t, g, unknown, or other
  misc_feature (500)..(500): n is a, c, t, g, unknown, or other
  misc_feature (501)..(501): n is a, c, t, g, unknown, or other
  misc_feature (510)..(510): n is a, c, t, g, unknown, or other
  misc_feature (520)..(520): n is a, c, t, g, unknown, or other
  misc_feature (530)..(530): n is a, c, t, g, unknown, or other
  misc_feature (531)..(531): n is a, c, t, g, unknown, or other
  misc_feature (534)..(534): n is a, c, t, g, unknown, or other
  misc_feature (537)..(537): n is a, c, t, g, unknown, or other
  misc_feature (560)..(560): n is a, c, t, g, unknown, or other
  misc_feature (570)..(570): n is a, c, t, g, unknown, or other
tccccgcggtggcggccgctctagaactagtggatcccccgggctgcaggaattcgcacgagaccattacctagaacatcctaatcgaaaagcgtttctttaccctaagcttttagctggtccaacgaaaggcacacagcccgacagccgccgctgtttcttcatcttcctcgcagcgccggcgctccttcttccgctccctctccgattcgcgcntcggcacgcaggcgacggcggcggcgctcgtgctcgggctctcagcgacggcgggcagtcccagactcggtgtcggcgtcagcggtcccccttccgactgtcancaaatcgctcgggccctcgnnctcgatcatcgaaacacgaacggggccntgggggaagcctcccgttcccctcctgcttcgggggaacggtcaaggggggtcgaacccggaagttggctggggccccccggagnnngggggggnnggggggggnggnggccccccgcnnggggggggggnnggccccccngggggcccgnccgggccggnnggnccnccccgggcccgcccggccgcccngcgccccccncggggccccgggggccggccgcgcgcccccgccgccccgcgggcgggcggggcccccgcgcggggcccgccc

SEQ ID NO: 23489 - DNA, 720 bp, Zea mays
  misc_feature: Ceres CLONE 1393793-F
  misc_feature: Encodes the peptide sequence at SEQ ID NO. 23490
tccccgcggtggcggccgctctagaactagtggatcccccgggctgcaggaattcgcacgagaccattacctagaacatcctaatcgaaaaacttccaccgccaccgccgagcgcggtggcaccgacacgacacacgtagctgcagacctgcagtgccagcacggctgccaatccctgctggcgctgttcccggctccgagatcatttggactcggcactcggcagggatggggatggggacggaatggccgccgacgcctgcgcagcagaggaaagcggtggtgagcgccgggtcggcgctgaagctggtactgttcgtgattctcgcgggcctcgcactgcggctgctggtggggcccccagcctacctcctgccgcccaccgccgcgccagagggggccgctcgtcttttcgcggtgccggagagggaaagaaccgccggcggcggcggcggcgggataccttccgtcgaaacggatgatgcggtttttactttgaaccgatcagaacctctaacagttttaggcaagaaggaaggctccacaaaccaaaaaaaaggtgggatcttctccacgcccagctgcctcccattaatcacgccccagctccataactgcccgcgccccttacttaagccctctccacaccgctgatataaggtcaaccatcccaccgatacaatcccaaacaaatcccactcccccgccccgccccacatc

SEQ ID NO: 23490 - protein, 78 aa, Zea mays
  misc_feature: Ceres CLONE 1393793-F
MAADACAAEESGGERRVGAEAGTVRDSRGPRTAAAGGAPSLPPAAHRRARGGRSSFRGAGEGKNRRRRRRRDTFRRNG

SEQ ID NO: 23491 - DNA, 764 bp, Zea mays
  misc_feature: Ceres CLONE 1393797-F
aaagctggagctccccgcggtggcggccgctctagaactagtggatcccccgggctgcaggaattcgcacgagaccattacctagaacatcctaatcaaaacatccagagagagacacggaggacctgggtttggttgcgctgcttgactcgctccgtgttccaagcgccttttgagcattcaggcagatataaaattcctctttttacactacaatccccgctgaatcagcagcagcaactctctccctctccgttcttggtggtccgagacccttgggcgtacgctctgcctcactcctccgtctcttgcttcccttgccgccggcggcgcgcggcgccgggcgcggatcggcggagcgagcatgccgcacgccccccccatcagcaacattaggtccatgcggggtcccccccctgtgctcgtgctcatgtgccaattgtacctctcaaaaaccctgcaccacgtgtcgcatcatgagaccagctgtgctgtatacacatcatctcctcttaatgccggacacgcctgcatccccccacccccctctgcacccaccctcctatcactctgctctatgatctttaccaccgccaccgccccttattcccctcttctacgccctccattgttctcgcccccacatccccttccaccctctttttcccctcaccctcccatcccgacctacctcacctcccccccccaacgtcaactcccaccccatgcactcctccccccatctgcccccactccccaccccg

SEQ ID NO: 23492 - DNA, 634 bp, Zea mays
  misc_feature: Ceres CLONE 1393798-F
  misc_feature (97)..(97): n is a, c, t, g, unknown, or other
  misc_feature (262)..(262): n is a, c, t, g, unknown, or other
  misc_feature (318)..(318): n is a, c, t, g, unknown, or other
  misc_feature (372)..(372): n is a, c, t, g, unknown, or other
ggtggcggccgctctagaactagtggatcccccgggctgcaggaattcgcacgagaccattacctagaacatcctaatcaaaagaaaagcgcagacnagagagagaaatcggaatccaagcgcaaccaaaagagaagagggcagacacgagggagcgcgtggggggagagggcatggtctctctcgtcccggcagtcccgtctcaagcaaaagctctctcctcttcttccgctcagtgcaccaatcactgcaacatactggnctgaggtcattgagttggtgaaggggaaaggaggggtatcatgggcatctcatccnagtggattaaatccttggttgccataaggaagcaagaaaaagccgcaaattgcnaaaaggcaggaaaaggggggtaacgctgaaagcaagggaaataaaaggttgggtaatcaatccctgccaaaagggaaattttttttggtacccgggggttgcttgggggccaaaaaatttacggccaaagggggaccttttggtggaaaaaaaagggggccaaaggggggtcaaaattttttttttttcaaaaagacccccccgtggtggggggccttttttcccggggggagaaataaaaaaaaaaaaaaaaattgggccg

SEQ ID NO: 23493 - DNA, 761 bp, Zea mays
  misc_feature: Ceres CLONE 1393803-F
  misc_feature: Encodes the peptide sequence at SEQ ID NO. 23494
  misc_feature (313)..(313): n is a, c, t, g, unknown, or other
  misc_feature (357)..(357): n is a, c, t, g, unknown, or other
  misc_feature (618)..(618): n is a, c, t, g, unknown, or other
  misc_feature (656)..(656): n is a, c, t, g, unknown, or other
  misc_feature (675)..(675): n is a, c, t, g, unknown, or other
  misc_feature (684)..(684): n is a, c, t, g, unknown, or other
  misc_feature (687)..(687): n is a, c, t, g, unknown, or other
tccccgcggtggcggccgctctataactagtggatcccccgggctgcaggaattcgcacgagaccattacctagaacatcctaatcgaaaaactgccaactcgcacgcagcagtacgacgtctctcctctgggtctggggccgagacaccgagcacgtactaccagcaagatggtggcgtctcccagattcaagcccatcgaggagtgctgctcggaggggcggtcggagcagacggtggccgccgacctggacggcacgctgctcatctccaggagcgcgttcccctactacctcctcgtggctctcgaggncggcagcgtcctccgcgccgcgctgctgctcctggtccgtgcgntcgtctacgtcacctacgcctttctctccgagtcgctggccatcaggacgctggtggacatctcccgtgcgggggttcaagggggggaacatcgagatggtggcgcgctcctggttccccaggttttagggggggaaggggcccccggaaaattgggggggggtcattccctttggaaggggttacttttttccggtcaaccccaggggtctgggccaaaccttttcccggggctttcttaggcgccaaaagaggccccgngcccagattgggggtgccgacgagaacctaaaacaccnctttttggcgcccggccangtgctcttnccnccaaccaaaaaaaaggcccccccctagaaaccccaagagcaacatataatctggggcatacgtatacatttatt

SEQ ID NO: 23494 - protein, 142 aa, Zea mays
  misc_feature: Ceres CLONE 1393803-F
  misc_feature: SWISSPROT Homolog: EC 2.3.1.15 Glycerol-3-phosphate O-acyltransferase
  misc_feature (48)..(48): Xaa is any aa, unknown, or other
  misc_feature (63)..(63): Xaa is any aa, unknown, or other
MVASPRFKPIEECCSEGRSEQTVAADLDGTLLISRSAFPYYLLVALEXGSVLRAALLLLVRAXVYVTYAFLSESLAIRTLVDISRAGVQGGEHRDGGALLVPQVLGGEGAPGKLGGGHSLWKGLLFSGQPQGSGPNLFPGLS

SEQ ID NO: 23495 - DNA, 681 bp, Zea mays
  misc_feature: Ceres CLONE 1393804-F
  misc_feature: Encodes the peptide sequence at SEQ ID NO. 23496
agagctggagctccccgcggtggcggccgctctagaactagtggatcccccgggctgcaggaattcgcacgagaccattacctagaacatcctaatcgaaaaatccgctcgtccttcagccgctcccaaccctagccacgcaggaactcacagccccgccgctcctcgcctccatcccaccctcttgttccccactttgcgttgtgccacgacgctccgggcatgcatggaggccgcaatagatccaggagatcgcttgggggcggcgggcaggcaaaggaggtcactcgctgggtttgctagcgtgggggacactagtgcgacagcttgtacaaggcgacgagactgcacggcgtgctcctggaggtggcgcatgtgcccttccctcaggaccgctatgcactgtgcctgcagctcgagtgcatccagttcggcatcattcgctcctgctccgacctcgtcacgggcaaggcgctggcctgcaagtccatcgccaagcccaacatcgtcgcctcaaagccgtgtacgaggaccgcgattccgtgcacctcatcatggagctctgcgctgggggggagctcttccatcgccctgaggaacgcgactgcttctccgagggagaaagagtcctcaatggagaggcaaaaaaccaccggaaaattgtgaccttatctagcatgg

SEQ ID NO: 23496 - protein, 42 aa, Zea mays
  misc_feature: Ceres CLONE 1393804-F
MELCAGGELFHRPEERDCFSEGERVLNGEAKNHRKIVTLSSM

SEQ ID NO: 23497 - DNA, 803 bp, Zea mays
  misc_feature: Ceres CLONE 1393806-F
  misc_feature: Encodes the peptide sequence at SEQ ID NO. 23498
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
ttttttttnnnnnnnnnccccctccccttccctctcgcccccnnnnnnccaaagctggagctccccgcggtggcggccgctctagaatagtggatcccccgggctgcaggaattcgcacgagaccattacctagaacatcctatcgaaaaaacccagaaacatagaaggcgtgtacaccaagaagaagccggccaaccaaccgactcccccgaccctcctgatcgatcgagggccccttgttctagccagttgtccccttccctctcgccggcgttgctcctgcctgctccaatggccgctgcctctgccgccgcctccacgaagacggcgaacatccccgcgacgatgcgggccgtgcagtacgactcctgcggcgggggcgccgctggactcaaggatgtggaagttcccggtcccttccggcaaaaagagtggagctttctgctgaagctggaggcagcaagcatcaacccagtggaatggaaggggaagaaaggaatgggtgaaggcttttcctggctcctaaaattacccttttatcccagggaactgatgtggccaaggagctcggggcctggatggttggctcccggaaaatcaatggggttcccaagccgggaagaacaaaggtggttgcctagggctccaccccctttttaagggtaggtgggcctttgggggaaggaatggctgggggcaatcaagaaaaatccttggacccgttcaaaaagggcccccccgggaagggtaacctggtttgccccaaagaggggccaggggtttggcccaatcccgaccgtcg

SEQ ID NO: 23498 - protein, 122 aa, Zea mays
  misc_feature: Ceres CLONE 1393806-F
MAAASAAASTKTANIPATMRAVQYDSCGGGAAGLKDVEVPGPFRQKEWSFLLKLEAASINPVEWKGKKGMGEGFSWLLKLPFYPRELMWPRSSGPGWLAPGKSMGFPSREEQRWLPRAPPPF

SEQ ID NO: 23499 - DNA, 679 bp, Zea mays
  misc_feature: Ceres CLONE 1393811-F
  misc_feature: Translation starting site: 123
  misc_feature: SWISSPROT Homolog: EC 3.2.1.4 Cellulase
  misc_feature (450)..(450): n is a, c, t, g, unknown, or other
tggagctccccgcggtggcggccgctctagaactagtggatcccccgggctgcaggaattcgcacgagaccattacctaaaacatcctaatcgaaaaatcacaagcaatcgatagagctagcatggcggtgaaggtgtgggtgttcgccgtggctctgatgatgtgcgctggtgtacggcttggagctgacgacgacggcggcagccgccttattagccgctgtcgtctgagctcgcccaactaccgcggcgccctggcaaaggccatcctcttcttcgaggggcagcggtcggggcggctgccggcaaaccagagagtcaggtggcgcggggactcggcgctcaccgacggccaacccgaaacgtgaacttggacggtggctactacgacgccggagacacgtcaagttcggtttcccgatggccgtcagcgtcaccctcctgagctgnagcgccggcgagtaccgcgaccaggttgccggcggcgggtcagcttccgcaacctccggtccgccatccagggggggcgccgacttccttcttcgtgcccaaaccacggcgaacaccctctaaactcaggtttggcgacggcaacgccgaaccaccatggctggggagcgcccaaaggacatgggacccgcccggggacgcctgtacaagatcccccggagttcgcccg

SEQ ID NO: 23500 - DNA, 679 bp, Zea mays
  misc_feature: Ceres CLONE 1393812-F
  misc_feature: Encodes the peptide sequence at SEQ ID NO. 23501
  misc_feature (595)..(595): n is a, c, t, g, unknown, or other
  misc_feature (614)..(614): n is a, c, t, g, unknown, or other
aagctggagctccccgcggtggcggccgctctagaactagtggatcccccgggctgcaggaattcgcacgagaccattacctagaacatcctaatcaaaaacgatcacacaccactccacagcagtagcaagagggatagagcaaggccacacacacacacacaccactaggctaggttagccttttaatcgtcgtcgagaagcaagaagggcgcgcacgcaagcaggcaagcaagaagagagccgatcgaccgagagctagcacgcgatggcgaggtcttccaagatgatggtggcggcagctctgctggccttggccctggccgtgtcgaccgccgaggcgaggaacatcaagaccacgacgacggaaaagaaggacgacgcggtggtgcagccgcagaccttcccgcccttcgaccgcctcggcggcggcgcgtccccggcgttcggcggcctccccggcggcagcattcctggcagcagcattcccgggttcagcatgcccggcagcggcagcagcctacccccgggtcagcttcgccgggcagcggcagcatgcccctccttcggcggcggctccccgggcttcagcggncttcggcggcatgcccggntccgccaccggccggctccgtccccgagaacgccaaacagccctgaacgccaaacagcgttggta

SEQ ID NO: 23501 - protein, 137 aa, Zea mays
  misc_feature: Ceres CLONE 1393812-F
  misc_feature (116)..(116): Xaa is any aa, unknown, or other
MARSSKMMVAAALLALALAVSTAEARNIKTTTTEKKDDAVVQPQTFPPFDRLGGGASPAFGGLPGGSIPGSSIPGFSMPGSGSSLPPGQLRRAAAACPSFGGGSPGFSGLRRHARXRHRPAPSPRTPNSPERQTALV

SEQ ID NO: 23502 - DNA, 672 bp, Zea mays
  misc_feature: Ceres CLONE 1393813-F
  misc_feature: Translation starting site: 303
  misc_feature: Pfam Name: Ferrochelatase Pfam Description: Ferrochelatase
  misc_feature: SWISSPROT Homolog: EC 4.99.1.1 Ferrochelatase
  misc_feature (445)..(445): n is a, c, t, g, unknown, or other
  misc_feature (453)..(453): n is a, c, t, g, unknown, or other
tggagctccccgcggtggcggccgctctagaactagtggatcccccgggctgcaggaattcgcacgagaccattacagaacatcctaatcgaaaaaaaaccgaccgaaagcggaaagcaaatagcagacggcagacaacagtcgaggggacacaggaaggcgcgaagaagaccgagatcctcgcccaacgccatcacgccactcccccaatactcaggtgtcaggacagcgagcaggcacaagcagatctcactccacgttgctccttccgcccttcctctccgccgctccccggaaggatcatggagcgcgggattcttggctccaggggcgccgtccaaatcttggggtcgaagaccggggccgcgatgtcatgtggcaaaacaacctctacaagttttacttgttctaccaaacacgagctgaacttgcatgtgaatgtaangccgttgncattgttttgctgaagaaaagatcggagtactgttattaaatctgggtggtccagaaaccctagacgatggtcaaccatttctggttcacctatttgctgatccagatatcattcgactgcctaggctcttcaggttccttcaaagaccactggccaaacttatttctacttttagagctcctaggagtaaagaagggtatgcttcaatcggtggtggg

SEQ ID NO: 23503 - DNA, 667 bp, Zea mays
  misc_feature: Ceres CLONE 1393819-F
  misc_feature: Encodes the peptide sequence at SEQ ID NO. 23504
  misc_feature (463)..(463): n is a, c, t, g, unknown, or other
  misc_feature (464)..(464): n is a, c, t, g, unknown, or other
  misc_feature (491)..(491): n is a, c, t, g, unknown, or other
  misc_feature (492)..(492): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
aaagctggagctccccgcggtggcggccgctctagaactagtggatcccccgggctgcaggaattcgcacgagaccattacctagaacatcctaatcgaaaagtgtttgttccattccatagggatcccgccggaccagcagcggctgatctttgccgggaagcagctggaggatggccgcacccttgcggactataacatccaaaaggagtctacgctccacctcgtgctcaggctccgcggtggcatcattgagccctcgctgcaggcgctcgctcgcaagtacaaccaggacaagatgatctgccgcaaatgctatgcacggctgcaccctagggctgtcaactgccgcaagaagaagtgtggtcacagcaaccagctgaggggcaagaagaagatcaagaactgagggtgtgctgctagtcagtttcatggacaatggttgttggttggtgaaccgtgnnttgttacgaactgtattttttgttggnntgtgaaccgtgtttgtttaccgacatatggnnncttatgtatgttttacatgttgtcgatgacacatactatatgacgatagcaactatgctatggtagtttggtcattggtcacctgatatggtgcataattttcgtacatttcgtagtgggcaaaaaaaaaaaaaaaagctaa

SEQ ID NO: 23504 - protein, 36 aa, Zea mays
  misc_feature: Ceres CLONE 1393819-F
  misc_feature (1)..(35): Pfam Name: Ribosomal_L40e Pfam Description: Ribosomal L40e family
MICRKCYARLHPRAVNCRKKKCGHSNQLRGKKKIKN

SEQ ID NO: 23505 - DNA, 657 bp, Zea mays
  misc_feature: Ceres CLONE 1393820-F
  misc_feature: Encodes the peptide sequence at SEQ ID NO. 23506
  misc_feature (520)..(520): n is a, c, t, g, unknown, or other
  misc_feature (530)..(530): n is a, c, t, g, unknown, or other
  misc_feature (565)..(565): n is a, c, t, g, unknown, or other
  misc_feature (583)..(583): n is a, c, t, g, unknown, or other
tccccgcggtggcggccgctctagaactagtggatcccccgggctgcaggaattcgcacgagaccattacctagaacatcctaattgaaaaagaccacacaccacagcactaaaatctgttcatctctggctccccaaattcagctggagagcactttttcccatcatggataagaactacggtgaactctacaacatcctcggatggggtgaggagtacttcgcggtgaacacggaggggcacctcagcgtgaagcctttcggccgctggacggagcccgggcaggagatcgacgtgcactcggtcatcgtggaagctctagcgacccaacccaacgacagcaccagcaaatctcagttccccatgatccttcgcttccccgacgtgctcaagaaccgtatcgagacgctccataacgcattcaacagcgccatggagtccaccgggtacacgtccaggtaccaaggggcgtgtccccgatcaggtgaacagaaacagcacgtcgtgcaggacatgggntaggtttcgncagcaatggaactatgggctcgaggctgggctccnagcagaactgctcatcgncatgagctggctccccgtcaccgaagcgagcccaagccgtatttgatctgcacggctacaaagacgggaactaa

SEQ ID NO: 23506 - protein, 118 aa, Zea mays
  misc_feature: Ceres CLONE 1393820-F
  misc_feature: SWISSPROT Homolog: EC 4.1.1.19 Arginine decarboxylase
MDKNYGELYNILGWGEEYFAVNTEGHLSVKPFGRWTEPGQEIDVHSVIVEALATQPNDSTSKSQFPMILRFPDVLKNRIETLHNAFNSAMESTGYTSRYQGACPRSGEQKQHVVQDMG

SEQ ID NO: 23507 - DNA, 668 bp, Zea mays
  misc_feature: Ceres CLONE 1393823-F
  misc_feature: SWISSPROT Homolog: EC 3.5.2.3 Dihydroorotase
  misc_feature (543)..(543): n is a, c, t, g, unknown, or other
ggagctccccgcggtggcggccgctctagaactagtggatcccccgggctgcaggaattcgcacgagaccattacctagaacatcctaatcaaaacttaatgtttccaaggttctgtggcagtgcgaggcattttgggaggtggtgagcgcctcgcttggcaccttcattttcgtgatgatgctgtccttcaggctgcagtgccacacaagttcgtttggtgtaggtgctgcttgatttttggcggtgcatgccgggtgttcgacaatgtttctgaggttttgtggcagtgcgaggcattttgggagggacatcatcatgcccaacttgaagtcgtccgtgaccacaacagcgagcgcggtggagtacatggatgaagtattgaaggcgttgtcgccagccgccgccgccgacgacggaggagcagcacctctcgtctgtccaccgctgaccgctcgtttgtcagcctagcaccggtgtgcatgaacgcccagtatatgctacagcaccgccgcccctggccctgccgcctggcgccggtcgntgccctgtgcactcccgcggcctcgggaatgggccaccagaactttttatcggtttggccacccttctcttctcttctctttttctccggcccgttctccctctctcccttctctcgggtttcgg

SEQ ID NO: 23508 - DNA, 704 bp, Zea mays
  misc_feature: Ceres CLONE 1393824-F
  misc_feature: Encodes the peptide sequence at SEQ ID NO. 23509
  misc_feature (310)..(310): n is a, c, t, g, unknown, or other
  misc_feature (434)..(434): n is a, c, t, g, unknown, or other
  misc_feature (651)..(651): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (660)..(660): n is a, c, t, g, unknown, or other
  misc_feature (661)..(661): n is a, c, t, g, unknown, or other
  misc_feature (666)..(666): n is a, c, t, g, unknown, or other
  misc_feature (675)..(675): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
tggagctccccgcggtggcggccgctctagaactagtggatcccccgggctgcaggaattcgcacgagaccattacctagaacatcctaatcgaaaaacacacgcgggcgcgctagctagtgagagtcggagatgtcgtcgccgcggccacacttcctcgtgctcaccttccctttccagggccacatcgccccggctctccgcctcgccaggcagctgctcgcggcggcgcccgacgcgctcgtgaccttctccaccaccgaggtcgcgcacaggcgcatgttcccggcaaagcccaacgacggcgccnaggactccgacgaagacggccgcctcgagttcctcccgttctccgacggcacggaggccgggtacgtccggagcgccgacctgggctcgttcaacgcctacatgacgtctttccacgccgcggnggcgcgcagcgccgcggagatcgtgacgcgttcccgggggcggggggccggccccggggccccgggtcggggaaccagctggctcccccccgtgggcggcccgacgtcgcggcggtaaccgcggtaatccccgtccggggctcctatgggatcccagccgggtccccggggggtcgccaatctaacccccattaactttccaggggcaaggcggggngnnnnnncnncgaancacccttcncccacccccgtnnnctcccccgggggaaa

SEQ ID NO: 23509 - protein, 139 aa, Zea mays
  misc_feature: Ceres CLONE 1393824-F
  misc_feature (60)..(60): Xaa is any aa, unknown, or other
  misc_feature (101)..(101): Xaa is any aa, unknown, or other
MSSPRPHFLVLTFPFQGHIAPALRLARQLLAAAPDALVTFSTTEVAHRRMFPAKPNDGAXDSDEDGRLEFLPFSDGTEAGYVRSADLGSFNAYMTSFHAAXARSAAEIVTRSRGRGAGPGAPGRGTSWLPPVGGPTSRR

SEQ ID NO: 23510 - DNA, 675 bp, Zea mays
  misc_feature: Ceres CLONE 1393825-F
  misc_feature (444)..(444): n is a, c, t, g, unknown, or other
aaagctggagctccccgcggtggcggccgctctagaactagtggatcccccgggctgcaggaattcgcacgagaccattacctagcatcctaatcaaaaaaagtctctcaaatctggaatcctttcacgccgccactctcccctttttccttctctcttcgtcgttgtggctcctgccttcctgcctcggcgcatcgactcgcggagagggacagcacagcgcctcctccccatcctttctccattcccagatcgaaggtccataaaaaaccatccttttgcatctgattgagcactgtctttgtgcaagagaacaatttagttgtacatacaaacaaaaagaagtgggagtatttttcagagtttattagaagagactgtttcgaggacccacgtcagagaaaggcgagaagctttagcagcggcaatggtctggtcaatggnacccgcaggtgaccgtccacggccgactggatgtcagccgtggtgccgctgatgaagctgtgggccctggggtagatcggcctgctcctcgccaaaccgggggtccagggtcgtgcccagggcccccttccagctccctgagaaggtcggcttagggcatcttctcccctgcctaattcttcgccacctggggaaagtcggccaccatagaacaggcccgggccgtggggt

SEQ ID NO: 23511 - DNA, 764 bp, Zea mays
  misc_feature: Ceres CLONE 1393826-F
  misc_feature: Encodes the peptide sequence at SEQ ID NO. 23512
  misc_feature (6)..(6): n is a, c, t, g, unknown, or other
  misc_feature (11)..(11): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (22)..(22): n is a, c, t, g, unknown, or other
  misc_feature (23)..(23): n is a, c, t, g, unknown, or other
  misc_feature (25)..(25): n is a, c, t, g, unknown, or other
  misc_feature (26)..(26): n is a, c, t, g, unknown, or other
tttttnttttntnnnntnnntnntnnttatttttgttggttttggtgtgtcggttacaaatctggagctccccgcgggggcggccgctctagaatagtggatcccccgggctgcaggaattcgcacgagaccattacctagaacatcctaatcgaaaaacttcattcgagccctaccactaccagtggcaggcgagcgagaggcggttgaggaggagcggacggaaccgtcgcctgctgcgtctgcctgcgagatctaggcgagcgcggccatgggtgctcgctgctccagctctccgtctgctggtggcctccccacttcaaatcgccaatgctcgagaatggcgccgccggagatgatggcagcggcgtgccggtgttcgccgagtacagcttcgacgacctccggggtggccaccgacggcttcgcccccgatcgcatcgtgtcggaagcacggggagaaggcaccccaacgtggtctaccgtggaacgctcttcagctccgggcggaccgtcgccattaagggcttcggccgcttccgcctggccgaactcacgccagttcctggaggaaggccaaggtttgttggccagcctgggtaaatggcagggtggcccaacttgttcgggtggctgctgcaaaaaggggggaacgtctcccccggcccaaaaatttcctggccgcaacggagacccttgggcaaaggcatcctctttcccactgggaagacaaattctcctttggggttgggccccaatggaag

SEQ ID NO: 23512 - protein, 90 aa, Zea mays
  misc_feature: Ceres CLONE 1393826-F
MLENGAAGDDGSGVPVFAEYSFDDLRGGHRRLRPRSHRVGSTGRRHPNVVYRGTLFSSGRTVAIKGFGRFRLAELTPVPGGRPRFVGQPG

SEQ ID NO: 23513 - DNA, 780 bp, Zea mays
  misc_feature: Ceres CLONE 1393828-F
  misc_feature (13)..(13): n is a, c, t, g, unknown, or other
  misc_feature (20)..(20): n is a, c, t, g, unknown, or other
  misc_feature (21)..(21): n is a, c, t, g, unknown, or other
ttttccccccccntcttttnnccacctcctccctccagtgagtgtattaaaaagtggagctccccgcggtggcggccgctctataactagtggatcccccgggctgcaggaattcgcacgagaccattacctagaacatcctaatcgaaaaataaacaatggaaaatcgagagagcgagagagaggaagctagcgagaaggtcaagccgcgaagagaagagacgcacgtcacagatccctctccactgtctcaccctttctctctcctcgaccctcccgacgcggcaaagcaaaaacacaaggaggagaggagggagagaaggaagaaggcgaggccaaaaatcccctccccctccccaaatcctagcccaataatctctcaatcaggggattcttaggtctgatcaagtcggaggattcggcagggcgcagccctgaacgagaaggcgtccgtctcccaggagctcaccgcccagcacaagaagatattggaagggccttcatacggatccctgaaattaaagaatgcggaagactgcaaaggcaaaggggccctcgaaggggcaagtggggaaacctagggtatcttttatatggcatgaacatggtctgggaatttcatagaaacgccggggggggggaccatattctaagggtaaaaatttggccccccccgggataacatgggctggccaaaagaaaggtggcattttatacccaccccaagggggaaaccgaaaaaaccaaatctagcttttggtggaaacccaaacctggccc

SEQ ID NO: 23514 - DNA, 679 bp, Zea mays
  misc_feature: Ceres CLONE 1393832-F
  misc_feature: Encodes the peptide sequence at SEQ ID NO. 23515
  misc_feature (432)..(432): n is a, c, t, g, unknown, or other
  misc_feature (531)..(531): n is a, c, t, g, unknown, or other
  misc_feature (547)..(547): n is a, c, t, g, unknown, or other
  misc_feature (623)..(623): n is a, c, t, g, unknown, or other
aaagctggagctccccgcggtggcggccgctctagaactagtggatcccccgggctgcaggaattcgcacgagaccattacctagaacatcctaatcgaaaacactcgccgcggctaacccagctcccagcccccgtctcgtcgccatgggaaccaggaatcttacgcggaaccgcgccgcttccatggcgacggcatccactacgctgctcctctcccttgccttcctcgccttcgcctgggcggcgtcgccgtcgccggatgcggaggcgatctcccggttccaggagtacctccgcatcgacacggcgcagccggcgccagattacgccgcggccgtggccttcctccggaaacaggccgccgaggctggactcgaggcgcgcacgcttgagctcgtcgccgggaagcccctgctgctgctgcggtggnccggtcggcggccgtcgctcccctcatactcctcactcccacactgacgtggtgccgtcggagccgaacagtggggacacccgcccttttccgccgccntcgatgaggcatcggntcgcatctacgcgcgaggctcccaggacatgaagtgtgtggggatgcagtacctttgagccattcgccgtctccgntctggcagatttggtccagatcgaatatctatattacatttggtcctgacgaggag

SEQ ID NO: 23515 - protein, 110 aa, Zea mays
  misc_feature: Ceres CLONE 1393832-F
  misc_feature (96)..(96): Xaa is any aa, unknown, or other
MGTRNLTRNRAASMATASTTLLLSLAFLAFAWAASPSPDAEAISRFQEYLRIDTAQPAPDYAAAVAFLRKQAAEAGLEARTLELVAGKPLLLLRWXGRRPSLPSYSSLPH

SEQ ID NO: 23516 - DNA, 751 bp, Zea mays
  misc_feature: Ceres CLONE 1393834-F
  misc_feature: Encodes the peptide sequence at SEQ ID NO. 23517
  misc_feature (19)..(19): n is a, c, t, g, unknown, or other
  misc_feature (20)..(20): n is a, c, t, g, unknown, or other
  misc_feature (23)..(23): n is a, c, t, g, unknown, or other
tttttctttctcccccccnnttntattttttttttatgaaatccgggcgccaaagctggagctccccgcggtggcggccgctttccaatagtggatcccccgggctgcaggaattcgcacgagaccattacctagaacatcctaatcgaaaagatccgccactacgccacaaaatcctctcctactccggcagttctgctcgccgccgcctccacgatgacggaagacgtgcagatgaacgactcggagccccagcctgcggcctcagctcccgccgtcggggcgccggcgctctccacactacaccatctgaaggagatcgcgtccgtgatcgaggccggttctctgtccaaggaggtccgccggatctcccgcgccttccgcctcaccgtcgcgctccgtcgccgcctcgccgcgcgggacgtctccgccttcctcgccttcgcgctacccgcgtcctccgaagcctacggacgcctcactgccctggtgcccaaggaagatgatactgagatggatgttgatgctgcagctccagaaactcagattttcatcaaacatggtctcccctgagattgaaatatattgctacttgctcggtactgatttttcctttattgatcattaggaaaaatggaggagggttaagggcatgcggcaagggggggaagcaattgcttcgtcctggaagaaatcctaaacccggagaaaaactgggtggacttggttttgggcaccccaccaaacggtg

SEQ ID NO: 23517 - protein, 118 aa, Zea mays
  misc_feature: Ceres CLONE 1393834-F
MTEDVQMNDSEPQPAASAPAVGAPALSTLHHLKEIASVIEAGSLSKEVRRISRAFRLTVALRRRLAARDVSAFLAFALPASSEAYGRLTALVPKEDDTEMDVDAAAPETQIFIKHGLP

SEQ ID NO: 23518 - DNA, 655 bp, Zea mays
  misc_feature: Ceres CLONE 1393839-F
  misc_feature: Encodes the peptide sequence at SEQ ID NO. 23519
  misc_feature (443)..(443): n is a, c, t, g, unknown, or other
  misc_feature (451)..(451): n is a, c, t, g, unknown, or other
ccccgcggtggcggccgctctagtactagtggatcccccgggctgcaggaattcgcacgagaccattacctagaacatcctaatcaaaaacatttcctctctctctttctctaactccgggtccctctctcctctctctattctctccatccttgcttctgggaagctcatcagccatggacgatgccactgcagaggaagaagcttccatgttcgagaccagccatgtcctcggcgccctgctggcctcctcgccgttgctggcgcgcgcctgggaccgctgcacagccgcctccgccgcagcgccgtggttcgttcacggcgaagacggcggcaaggtgtacgtggggttctctggggtgcaggctgcgcttacggcggcaggcgcggcggtggccggcggcggcgccgaatcttcgcgccggtgagtctcggcggggacngcggcggngcggatgttcgcgccgctggtcgccgccgagcccgacccggccgctaccggggagccggttgccgtgcaggcgctggcgctgcagtgcttcctgaaactctgctgcagtcctgattttcagatgcttctgaatcagatcaggggcaaggcagtcgtgttcacggaccactccccttggtggcgccgtggcctccccccggggcc

SEQ ID NO: 23519 - protein, 83 aa, Zea mays
  misc_feature: Ceres CLONE 1393839-F
MDDATAEEEASMFETSHVLGALLASSPLLARAWDRCTAASAAAPWFVHGEDGGKVYVGFSGVQAALTAAGAAVAGGGAESSRR

SEQ ID NO: 23520 - DNA, 880 bp, Zea mays
  misc_feature: Ceres CLONE 1393842-F
  misc_feature: Encodes the peptide sequence at SEQ ID NO. 23521
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (34)..(34): n is a, c, t, g, unknown, or other
nnnnnttttttnnnnnnncccccctcccccacanctaccccttctcccaaacccgacgctcctccgcggcggcgagcgttttacaatagtggatcccccgggctgcaggaattcgcacgagaccattacctagaacatcctaatcaaaaaacacacactcgactctcctctctcgcatccgcagcctctcgagctctactccatcccctcgatctcgaagcgcagcagcagcagtcaggcggccatggacgcgagcgcagccggagccggcgggaaggcgaagaagggcgcggccgcgcgcagggccgccgggccgaggaagaagtcggtgacgaggcccgtcaaggccgggctgcaagttccccgccggccgcatcgggggggtacctgaaaaaggggcgggtaccgcgacacgccgtccggaacgggcggccccccgttctaccttggagcccgccgtccctccgaagaaaccttgggcccggccgaagggtgcttggaaagattggcgccggggcaaaccctttgccccaagggacaaaacaaaggaaaggaccccgggaattcaattccccggggggccacacggggggcctccccgtttggcccatccccggcaaaacgaaccgaaagggagccttccgggccaaaggcttgggctgggcccggggaggtacacaccattcggcccccaacggggggggggcgttccctcccccccaaaaattacaacccccgggggtgtccccgggccccaagaaaaaacaccgcccgaaaaaaagggcgggcgggacccaaaggaagggccaaaagccgctcccaaaaaaaaggcccggccaaagtgccccccaagaaaaggcaataaaaagaggggcgcggg

SEQ ID NO: 23521 - protein, 48 aa, Zea mays
  misc_feature: Ceres CLONE 1393842-F
MDASAAGAGGKAKKGAAARRAAGPRKKSVTRPVKAGLQVPRRPHRGGT

SEQ ID NO: 23522 - DNA, 683 bp, Zea mays
  misc_feature: Ceres CLONE 1393844-F
  misc_feature: Encodes the peptide sequence at SEQ ID NO. 23523
  misc_feature (385)..(385): n is a, c, t, g, unknown, or other
  misc_feature (427)..(427): n is a, c, t, g, unknown, or other
  misc_feature (437)..(437): n is a, c, t, g, unknown, or other
  misc_feature (444)..(444): n is a, c, t, g, unknown, or other
aaagctggagctccccgcggtggcggccgctctagaactagtggatcccccgggctgcaggaattcgcacgagaccattacctagaacatcctaatcgaaaaatcacaattcactccactcatcttttctcgtttagaacctctaaaatttcccccactcgccagtcgcagcagcacctgtagcagtcatggacgccagcgaagccgttaccaaggcgaagaaggaggcggccgtccgaaaggcaggcggccccaggaagaagtcggtgacgcggtccgtcaaggccgggctgcagttccccgtcggccggatcgggcgctacctcaagaagggccggtacgcgcagcgcgtgggcactggcgcccccgtctacctcgccgccgntctggagtacctctccgtcgcttcagtcatggcaggaatggncacctgaggntctcagntcgatgctaagcactatgattctaagatgcaggagctgctgagcaccggtgagactggagagttcttcacttcatatggatgagttttttgaaagttttgatgatatggggcttccagaagaatctctggagagggatttatggttaatgggtttgagaagccatctggaattcaacaaagaggaattgttccccttctggaagggtttttgatgtgcattcagaaagaaaaattgggg

SEQ ID NO: 23523 - protein, 81 aa, Zea mays
  misc_feature: Ceres CLONE 1393844-F
  misc_feature (66)..(66): Xaa is any aa, unknown, or other
  misc_feature (80)..(80): Xaa is any aa, unknown, or other
MDASEAVTKAKKEAAVRKAGGPRKKSVTRSVKAGLQFPVGRIGRYLKKGRYAQRVGTGAPVYLAAXLEYLSVASVMAGMXT

SEQ ID NO: 23524 - DNA, 776 bp, Zea mays
  misc_feature: Ceres CLONE 1393845-F
  misc_feature: Encodes the peptide sequence at SEQ ID NO. 23525
  misc_feature (1)..(1): n is a, c, t, g, unknown, or other
  misc_feature (16)..(16): n is a, c, t, g, unknown, or other
  misc_feature (20)..(20): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (31)..(31): n is a, c, t, g, unknown, or other
  misc_feature (32)..(32): n is a, c, t, g, unknown, or other
  misc_feature (37)..(37): n is a, c, t, g, unknown, or other
  misc_feature (38)..(38): n is a, c, t, g, unknown, or other
  misc_feature (51)..(51): n is a, c, t, g, unknown, or other
  misc_feature (60)..(60): n is a, c, t, g, unknown, or other
  misc_feature (62)..(62): n is a, c, t, g, unknown, or other
  misc_feature (776)..(776): n is a, c, t, g, unknown, or other
ncccccctcccccccncccntnnncttcttnnccctnncctcttttttttngactccccncnccaaaagctggagctccccgcggtggcggccgctcttcaactagtggatcccccgggctgcaggtaattcgcacgagaccattacctagaacatcctaatcaaaaacacgcgaaggcacctagcagccgccactcgccgaactgaggaacacgccgggcgacgggatacagcagcagcgcgcccctctatgcccgacgcgacggcgccctgcagctgcagataaacctgttccaatggccaaacaaaaagagggtgtggacaaaagaactgctaggaagatgatccgatctacggaaggctgtgcaaagagcattactttcgagaggaacaacaaatcagacgctgtgcagcttcacgatctgccgaatgacatcctaggtagcatactatcacggttgacattcagagaatcctcacagatgggctttgtttctcatacctggcggcggctggggagaagctgttgccggaaactggtcttcaccagtgcccacatgttccaaccccgaaaataggagcatcaaacataccaaggaccaactttgccatggagagtcaacagttttcttgcgtcaggtaacccacttcttccctactccttaataaagtttggtaaattaagttccgggctgggcccaaggaaaccccaactccgcccatgggccaaccagaatgggattccgcgcttcctggtccccggggtccccgagaan

SEQ ID NO: 23525 - protein, 93 aa, Zea mays
  misc_feature: Ceres CLONE 1393845-F
  misc_feature (38)..(85): Pfam Name: F-box Pfam Description: F-box domain
MAKQKEGVDKRTARKMIRSTEGCAKSITFERNNKSDAVQLHDLPNDILGSILSRLTFRESSQMGFVSHTWRRLGRSCCRKLVFTSAHMFQPRK

SEQ ID NO: 23526 - DNA, 682 bp, Zea mays
  misc_feature: Ceres CLONE 1393846-F
  misc_feature (565)..(565): n is a, c, t, g, unknown, or other
aaagctggagctccccgcggtggcggccgctctataactagtggatcccccgggctgcaggaattcgcacgagaccattacctagaacatcctaatcaaaaaagaatatcgcatcgccgtcgcgtcgtcgtcgatctccccgccccgccccgcccgcgccgcggaatctgacacatctccctaatctctcctaggaccgggtgcccttacatccacgccgcaacgcaaatcgccgtccgagccctcgcggtctctcgtctccccgtgcgagaggacgccggcagcagcggcgtgccagtgcggtggcttggtgggggaagaccggaggcggcggcagagctcgcgcccagaggtgcacggcaggcctgttctcggcgtcggctgggggaaggcgagtacccccgggaaggacgagtgaataatcatgagctcgatctgccccttcgcgggagccaccactggtggtgggtgatgccctgtgaaatctgataagaaccacactggggtggtgccctgcaaaatctgaacaaagcatcagtggttgtatgccttggccctggcaagnattctgggaacaagctcaaggaaagggggggttattgttgaaaaaaaggggcccggaaccctcggggcggaaccagaaaaatggccatttgggttatgactcccaacattttcaggg

SEQ ID NO: 23527 - DNA, 703 bp, Zea mays
  misc_feature: Ceres CLONE 1393847-F
  misc_feature: Encodes the peptide sequence at SEQ ID NO. 23528
  misc_feature (703)..(703): n is a, c, t, g, unknown, or other
ggagctccccgcggtggcggccgctctagaactagtggatcccccgggctgcaggaattcgcacgagaccattacctagaacatcctaatcaaaaactcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgttgctggtgtgcgccgccgagctgggcagcctcagccgcgacgagctgtgccgcaaggggggtggggggaaggccaccttacgaccctcgccaccggtgctcgcctttcctcggcggtcctcgccttccaccattctccgtctaacatcatgggcaggcccccggccccgtgtaccctcattcgacttcccaatgcttacaagggcgggccgaacaagagttcaagggtggcccaagggggaggggttcttcgaccctgggcgccgcaaggtccccggaagggttcan

SEQ ID NO: 23528 - protein, 166 aa, Zea mays
  misc_feature: Ceres CLONE 1393847-F
  misc_feature: SWISSPROT Homolog: EC 2.3.1.119 Icosanoyl-CoA synthase
MAREEQALLSTEIVNRGVEPSGPDAGSPAFSVRVRRRLPDFLQSVNLKYVRLGYHYLISHGVYLATIPVIVAGVRRRAGQPQPRRAVPQGGWGEGHLTTLATGARLSSAVLAFHHSPSNIMGRPPAPCTLIRLPNAYKGGPNKSSRVAQGGGVLRPWAPQGPRKGS

SEQ ID NO: 23529 - DNA, 662 bp, Zea mays
  misc_feature: Ceres CLONE 1393848-F
  misc_feature: Encodes the peptide sequence at SEQ ID NO. 23530
tccccgcggtggcggccgctctagaactagtggatcccccgggctgcaggaattcgcacgagaccattacctagaacatcctaatcgaaaaattgttcgcgtcgtccgccttctctctctctctaacccactgccagccacctctgcgaccgtcgcgaccactcgccaagtaaattttcttccgcccacctgactacgcctcgacctcggcctcggcgccgcctccgtccgccggacgcggcagccatggcgccagcggtggggctcaagcgctccgccacgcagaccatcactctgccgccgcccgacacgcggctggctgtgcgcgatgtcatgcgctccacgatcccgtcgcagcccgccgtggcgccggcgtccacggagaggcaggcgcccgccgcggcgttgcaggggttcctgtgcctggaggaggtggacgggaggcggtggagctacgtggtggacgggggggccgcgaagggggagagcaggggcgggggcgtccccgctggggccgccgtcagggccgtgccgcttgaagcgccgtttccgcctggcgagaaaaaattgtaattcataaaaccatatgtggcgcctgaagggtttccagaaagggtaactcccttcatatggacccttaaatgaaccgggaggggctctgg

SEQ ID NO: 23530 - protein, 108 aa, Zea mays
  misc_feature: Ceres CLONE 1393848-F
MAPAVGLKRSATQTITLPPPDTRLAVRDVMRSTIPSQPAVAPASTERQAPAAALQGFLCLEEVDGRRWSYVVDGGAAKGESRGGGVPAGAAVRAVPLEAPFPPGEKKL

SEQ ID NO: 23531 - DNA, 748 bp, Zea mays
  misc_feature: Ceres CLONE 1393855-F
  misc_feature: Translation starting site: 238
  misc_feature: SWISSPROT Homolog: EC 1.2.1.3 Aldehyde dehydrogenase (NAD(+))
  misc_feature: SWISSPROT Homolog: EC 1.2.1.31 L-aminoadipate-semialdehyde dehydrogenase
  misc_feature (14)..(14): n is a, c, t, g, unknown, or other
  misc_feature (29)..(29): n is a, c, t, g, unknown, or other
gtttcccccccccncccccccctcccctntttttgtggttggctgaaaaaaaaaaggtgaagctccccgcggtggcggccgctctataactagtggatcccccgggctgcaggaattcgcacgagaccattacctagaacatccaaatcaaaaaacacctcagtctcagtcccccaccacatccgctccccgccttccgcttccctaccccccgcatcacctaccaacgccgacaccatgggggccttcgcgaaggaggagcaccagttcctagccgagctcggcctcgcgcagcgcaacccaggcgcgttcgcatgcggtgcgtggggcggctcaggtcccaccgtcaccctccacgagcccgaccaacaatcaggtcatcgcagagggcgtggaggcgtccgtgcacgactaccgaggagggcatgcggcgcctgcttcgatgcccgccaggacatggatggccgttccctgctccaaagcgaagagagatcggtaaggaaatcggtgatgcactgagagcaaagctccatcacctttgccaggtttggggcaccttgaaaagggggaaaattccttctggagggaaatcggtgggggttccaggaaaatcatcgaaaatgggggattaatgcggggggggcttaaatcccccaaataagaagggactccattatagccctctggaacgggcaaaaccatattgtctgactgggcaggctcgcaaaccccccctggagatggaggg

SEQ ID NO: 23532 - DNA, 646 bp, Zea mays
  misc_feature: Ceres CLONE 1393856-F
  misc_feature: Encodes the peptide sequence at SEQ ID NO. 23533
  misc_feature (209)..(209): n is a, c, t, g, unknown, or other
  misc_feature (280)..(280): n is a, c, t, g, unknown, or other
  misc_feature (307)..(307): n is a, c, t, g, unknown, or other
  misc_feature (343)..(343): n is a, c, t, g, unknown, or other
  misc_feature (344)..(344): n is a, c, t, g, unknown, or other
  misc_feature (407)..(407): n is a, c, t, g, unknown, or other
ggagctccccgcggtggcggccgctctagaactagtggatcccccgggctgcaggaattcgcacgagaccattacctagaacatcctaatcgaaaactccttcccctccctctttccacgacaccaaaagaaaccgaaaaccatcgacgcgctccgtccaccctccactaccccgcgtcctcctccccctacgctcccagcccagcggnaaaacctaaccctagatgggcgccgtcacctctacgggcgcggcgcgctttgccttttttccgccgagccngccgtcgtacgggttcgagcagccggngccggttccggcccctggcacacccgagcctccggnnccggccacatcaaggcgcccgctcccgggcccggcacacccaagccgccgcctccggcccggncacacccaagccggcgcccagggggaagaaaaaggcggtggccccgttgtgaactcacggccggccccgggagggtaacggggaagggcgggggtttggaacaaaaggggaacggaggggggcccgatgcactggccccaagggggggcaaagtttagcttgtttcaatcccagggaaaagccgcccgacctcggcaaaaggaagaagttttttcgggaaggttagggcccccccttaa

SEQ ID NO: 23533 - protein, 86 aa, Zea mays
  misc_feature: Ceres CLONE 1393856-F
  misc_feature (19)..(19): Xaa is any aa, unknown, or other
  misc_feature (28)..(28): Xaa is any aa, unknown, or other
  misc_feature (40)..(40): Xaa is any aa, unknown, or other
MGAVTSTGAARFAFFPPSXPSYGFEQPXPVPAPGTPEPPXPATSRRPLPGPAHPSRRLRPGHTQAGAQGEEKGGGPVVNSRPAPGG

SEQ ID NO: 23534 - DNA, 654 bp, Zea mays
  misc_feature: Ceres CLONE 1393857-F
  misc_feature: Encodes the peptide sequence at SEQ ID NO. 23535
  misc_feature (253)..(253): n is a, c, t, g, unknown, or other
  misc_feature (654)..(654): n is a, c, t, g, unknown, or other
gctctttaactagtggatcccccgggctgcaggaattcgcacgagaccattacctagaacatcctaattgaaaaacacaaaagagagaaccggcggcgagctaggagctagccatggacggacacggcgcggtctcaccgtggagcgtgctaggcggggcggcggctgtgctgctcctgtggttggcgtcgcaggtgctggagtgggcctggtgggcgccccggcgcgtgaaccgtgcgctgagggcgcaggncctgaggggcacccggtaccgcctcctctgcggcgacctcatcgaggagcagcgtctccgcgcggcggccctggcaaggcccgtccccgtggtatcgccacacgacttcgtccctcgcgtcgcgcctttccttcaccgcgtcctccaagagcacggcaagctctcgttttacatggttttggcccgaccccaagagttctaatcaccgatcccgagcttgcccggaaaggggtgtccaataagtggggcggacttcgggaagccgctgctccctcccctgtcaacgctgctggttgctggccctcccccccctggacggggaaaaggggatccagcaatcaaaggattcctgaatccgggatttccccgcggaaaaacctggaagggaaatgctgtccgcn

SEQ ID NO: 23535 - protein, 113 aa, Zea mays
  misc_feature: Ceres CLONE 1393857-F
  misc_feature: SWISSPROT Homolog: EC 1.3.3.9 Secologanin synthase
  misc_feature (47)..(47): Xaa is any aa, unknown, or other
MDGHGAVSPWSVLGGAAAVLLLWLASQVLEWAWWAPRRVNRALRAQXLRGTRYRLLCGDLIEEQRLRAAALARPVPVVSPHDFVPRVAPFLHRVLQEHGKLSFYMVLARPQEF

SEQ ID NO: 23536 - DNA, 667 bp, Zea mays
  misc_feature: Ceres CLONE 1393859-F
  misc_feature (466)..(466): n is a, c, t, g, unknown, or other
  misc_feature (558)..(558): n is a, c, t, g, unknown, or other
  misc_feature (639)..(639): n is a, c, t, g, unknown, or other
  misc_feature (648)..(648): n is a, c, t, g, unknown, or other
gagctccccgcggtggcggccgctcttcaatagtggatcccccgggctgcaggaattcgcacgagaccattacctagaacatcctaatcgaaaactgctagtgctcagtcctcgccctctcgctttccgagggagcctttgcctttcccctccgcccgccagccattaatggcggcggcatctccatccactcccccctcgcccccctcccactgctgctacttctagaagcgctggtggcagggcaggcggtatcccggccgctggcgctggcgcgagagttggttggtggtggtgttcagccccccctccctcttcaggtttagggtggagcgatccgtgcaggccaacgcggggtgcgtgacccagaaagggaaaccgccgccttttttctcttctggcgccccgcttttcaatccctcctcaactcatccgcccccccgcaccatcaacaaaaagtccccgncttcttcttcctcttctcctctgcccctggcttgtcgtttgctcgtgctcccccaccccctttctgattcaggcagggttcctttccgcggngcggcgggtcggcatgggcaacttgctggggcgccaagatcaggtccggaagcccccccccggggggcctccctccccgtnaaggaacgncgtcccaagttggcaaaga

SEQ ID NO: 23537 - DNA, 814 bp, Zea mays
  misc_feature: Ceres CLONE 1393861-F
  misc_feature (13)..(13): n is a, c, t, g, unknown, or other
  misc_feature (14)..(14): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (38)..(38): n is a, c, t, g, unknown, or other
  misc_feature (48)..(48): n is a, c, t, g, unknown, or other
  misc_feature (49)..(49): n is a, c, t, g, unknown, or other
aaacccccccccnncccnnnnnnncaccacccctacgncggcgcgaannggtgcaaggtggggctccaccgcggtggcggccgctcttacaatagtggatcccccgggctgcaggaattcgcacgagaccattacctagaacatcctaatcgaaaaaaaaaatttcgtttttctcctctcagtctccgacgccgacggactcatccccccagacgaccaccctcctcctcctcccccacccacctcggcggaaccctagcgccgaccgcctgccgtgcccatcgacggcgatcgcattgctgcgccccgatggcgacccgggcctcccagagttgcctctgcgggggcagctcttcgttcgatgaccccgaaggggtcgaggggtctccggcaaccgccgcgggtgcaagggtggccctcccgggcaccgcaagaggaagcggagcccaggttggaaccgcgaagaagcgcttcgaaatcgacggatggatgaatcctgcagggagcccctactttattggggggaaaaaagccacagggggcgaaaaagaattaaggcaaacttgggtgggatggtccccaatgggaattggctcccaaagccagggccaaggaggggggcctggggttccaggggacattcccctggggcccaaaggaacactatggctctcaaaaaattagacacggtctcctggggcgcgcggccccggaaaggggggtgccaagggaccaaggcgaatcatacaaatcaatcccggggggccttcacccctcttgcgggggactttgaaaaacacatattggctttttg

SEQ ID NO: 23538 - DNA, 783 bp, Zea mays
  misc_feature: Ceres CLONE 1393862-F
ggggcccccccccccccccccccccagccgccgcaaagagtgccccccacaagctggagctccccgcggtggcggccgctcttgcactagtggatcccccgggctgcaggatttcgcacgagaccattacctagaacatcctaaaaaaaaaaataggacaagccccagcagtttgccactcccacgcgaaacagaagccccagcagggcggcactcccgacgcgacgcccctgcttgccggccgggaggctcactcgactctgcctccacttcctcgtctgtccgttggagcacggcgccgatggcggcggcgccagcgctcgcgcgggagctgctggacgcggcgcgggagccggagttcgcgtagtgccagcgcggggtgcggcgccgaatcacccgcacccggagctggccttccaggagcaccgcaccagcgcgctcgtgcgggccgagttcgacgcgatcgggggcccgtacgcctggccccgtcttgcagacggggggtcggggcccccatcaccgggccccggcgcggggccccggggtttagggcttcggcgccgaactgggaaggggctccccattccaggaaaaggggtagaaagggccagtcccaagagccagggaaaaagcggggaaaaaggaatcgcgtggcgcgcccatggacgcccccgggggggggggggcgctttgttgggaacacactaaggggttggctttaagggccgccggggggggaaagctgttttagaggggaactcgggaatggcgactttttgacgc

SEQ ID NO: 23539 - DNA, 662 bp, Zea mays
  misc_feature: Ceres CLONE 1393864-F
  misc_feature: Translation starting site: 220
  misc_feature (394)..(394): n is a, c, t, g, unknown, or other
  misc_feature (409)..(409): n is a, c, t, g, unknown, or other
  misc_feature (472)..(472): n is a, c, t, g, unknown, or other
  misc_feature (497)..(497): n is a, c, t, g, unknown, or other
  misc_feature (498)..(498): n is a, c, t, g, unknown, or other
  misc_feature (559)..(559): n is a, c, t, g, unknown, or other
tccccgcggtggcggccgctctatcaatagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcggtgtcgacggcctcccgccggggcctccgggttgggcggtggtggggaacctgttccaggtgatcctgcagcgacggcccttcatgtacgtgntgcgcgacctccggnagaagtacgggcccatcttcaccatgcggatggggcagcgcaccctcatcgtggtcacctcgncggagctcatccacgaggcgctggnntgagcagggccccatgttcgcgagccggcccgaggacagccccacccgcctcctcttcagngtcggaaagtgcacccgtcactcgggggcctacggcccccccttgtggcgtgctctgcgccgcaacttcttcgcccgagatcgtgtccccgaccgcgtcaggg

SEQ ID NO: 23540 - DNA, 782 bp, Zea mays
  misc_feature: Ceres CLONE 1393865-F
  misc_feature (20)..(20): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
gggccccccccccccccccncccaccccgccccnnnncccccccccccataactggcgctccccgcggtggcggccgctctatcctagtggatcccccgggctgcaggatttcgcacgagaccattacctagaacatcctaatcaaaacatccagagagagacacggaggacctgggtttggttgcgctgcttgactcgctccgtgttccaagcgccttttgagcattcaggcagatataaaattcctctttttacactacaatccccgctgaatcagcagcagcaactctctccctctccgttcttggtggtccgagacccttggccgtacgctctgcctcactcctccgtctcttgcttcccttgccgccggcggcgcgcggcgccaggcgcggatcggcgacgggtgcatggtggaggccgcccccgccccccaaaacaaacacgggggtctgcccccccaccgaaggcggacctgacgcccggcacccccgcccccgaacgcgttgtacctccctcgccgccctgcgggcacccctttaaccgaatatgcatgcaccacgccacccccaagccgggcacacgccgcaagcccgcagactcctcccacgtcccccccccccttctcgcccgccacactccactcgccctaccacccaccacccattcgtacccttagatggagcggtctttcttacgatagtgttatctccctattctcaccttctcctccccacgacctggtcctgtcgatcagcgggcgctccctcctataaatatc

SEQ ID NO: 23541 - DNA, 776 bp, Zea mays
  misc_feature: Ceres CLONE 1393867-F
  misc_feature: Encodes the peptide sequence at SEQ ID NO. 23542
  misc_feature (30)..(30): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (353)..(353): n is a, c, t, g, unknown, or other
gttccccccctcccccccaactcccccaanataaaaaaggcgccctnnnntaaaactggagctcaccgcggtggcggccgctctatcaatagtggatcccccgggctgcaggaattcgcacgagaccattacctagaacatcctaaaaaaaaagcagtccaaacacgcaacgcaacactcgccttcccctcccaaccctccgaaccgaagcagcaaagctagacgatgacgctgacgatcccggacgaggtgcgcgccaaggcggaggtgtacgtgggcgacgcggcggggcaggagaagacgcggctgctcctccaggagacgggcctcccgagcgggctgctcccgctgcnggacatcatcgagtgcggctacgtggaggagacgggcttcgtgtgcctcccggcagcgccgcaaggtggaccactacttcgccaaggccggccgccacgtgtccttaccggcgccgaggtgtcggcggtggccgaccaaggggccgggctcaagaaaaacaggggcggcaaggccaagaagatggtggctgtggcccaccctccaaggagaactgcggtgaacaacccgcccaagggggaaagccccccctggagggccaatcgggggggcctggtccggcaagtttcccccggcggggggcctttccaagggcggaggaagcggggggccgccgcggagaagcccgggggggggttcttccccccgggaacacggggtacccaccccactacccaggcgccgggagggaaacctccaaacac

SEQ ID NO: 23542 - protein, 183 aa, Zea mays
  misc_feature: Ceres CLONE 1393867-F
  misc_feature (2)..(147): Pfam Name: DUF538 Pfam Description: Protein of unknown function, DUF538
  misc_feature (43)..(43): Xaa is any aa, unknown, or other
MTLTIPDEVRAKAEVYVGDAAGQEKTRLLLQETGLPSGLLPLXDIIECGYVEETGFVCLPAAPQGGPLLRQGRPPRVLTGAEVSAVADQGAGLKKNRGGKAKKMVAVAHPPRRTAVNNPPKGESPPWRANRGGLVRQVSPGGGPFQGRRKRGAAAEKPGGGFFPPGTRGTHPTTQAPGGKPPN

SEQ ID NO: 23543 - DNA, 663 bp, Zea mays
  misc_feature: Ceres CLONE 1393868-F
  misc_feature (432)..(432): n is a, c, t, g, unknown, or other
cgcgatggcggccgctctataactagtggatcccccgggctgcaggaattcgcacgagaccattacctagaacatcctaatcgaaaaaccaacagccaatccacacctcgcttgcgttgtcctcgccgcggcctcgccctgattcggttcccccgttcctcgcctctgtcatcgtctcctctgacccaaattgagccaagcgaagccgtggccgtgatccggtccatgcgcggagcgtggtagccggattctatcgccgtcgcctccccttcgccgctattttccagtcgccgggatcagccgagttgaatctcgaggcataaagcgttgcgggcgcccggcgaggatacgatgcctgcggtgctcgccgcattcgctacccttcgagccgccgctggcatcgccctccggggactcctccttcccctgttnccatcgtctcaagcatcgttttagtagaagtaattttagtaagagtaattgtattaaccctttgggttcctccgtggcgacgctcctacgctcggcctcactttcgaatttcggttttgggcctggttgtgctccatccagggtttactttggttttggggcttccctccttgccaaaaatttgggggtctggatccaacccggaaatccggaaggaaaacaagagggtca

SEQ ID NO: 23544 - DNA, 792 bp, Zea mays
  misc_feature: Ceres CLONE 1393873-F
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (42)..(42): n is a, c, t, g, unknown, or other
ggggggggggggggcccnnncccccccnnnnaccgnnnnntntcccgcccgcgcgggcccccgcgcaaagtgttactccccgcggtggcggccgctctataatagtggatcccccgggctgcaggaattcgcacgagaccattacctagaacatcctaatcgaaaaaaaaattcgattccacgaagcagcaatcgcaagttcgaagctctaaaataatctcttcccgacgtctctggaaggtcagaatctgaacccaggtagcctccagggctgggagaggtggcggacttcaaaccctaagcccccaaggggagccggggggggggggttcccgggaccggaacccgggcccgggtgggtggacaaaccccaaaaccccaaaaaagggtcccgggggggggggcccgggggaccccccggtcctttggggggtttcggcgcccaaaagagccccggctccccccctcggggggggggccccggggggggggggagcgaacccgggccctgaccgccccctggggtcccacaaggccccccccgaccgccgggcgaatgagacccccccccccacccggggggaggactacccccccggggggggggggggacgcaaaaagtccttgtggggcgcgggggtggtgagtgcgctcccctgaccaaaccggggcgcccgccccccaaacgaggggggggcggatcaccccacccccccgcgcgcgtatcatccagcccacccccccacccaacagtgcgagggcggggcgcgccccccccccccccgcccggcg

SEQ ID NO: 23545 - DNA, 729 bp, Zea mays
  misc_feature: Ceres CLONE 1393878-F
  misc_feature: Encodes the peptide sequence at SEQ ID NO. 23546
  misc_feature (1)..(1): n is a, c, t, g, unknown, or other
  misc_feature (13)..(13): n is a, c, t, g, unknown, or other
  misc_feature (15)..(15): n is a, c, t, g, unknown, or other
  misc_feature (21)..(21): n is a, c, t, g, unknown, or other
  misc_feature (27)..(27): n is a, c, t, g, unknown, or other
  misc_feature (373)..(373): n is a, c, t, g, unknown, or other
nggggcccccccncncccccncccccnaatggcgcgcgcgccaaataaaataaaactggagctccccgcggtggcggccgctctataatagtggatcccccggctgcaggaattcgcacgagaccattacctagaacatcctaatcgaaaactctcattccagaggactccgcgtcgtcaggcccgcttcgcgtgcgacgccggcatatagggtttcgccggcgccggcgatggacccaccccccgtgagccccgatcgctgggggcccagtcagggctctggcgtcgggccctccgccctccgcgatatgggctcaatttctccgcctcagcctcctccaggccccatcgcggccctccttgagtactccgncgtagtccagtccggccctggcctggcggcgcaccacccgtccgcggggccctcgtcgccggtgtcggcgtcggaggtcgatggtcttctctccgctggcgccgctgggaacgggaaagtttcaatccggattcagggcggccagggggaacggaggcccccgggggggccgggatgcggaacctccccccgaggatttggaccagggcaccggccggttttggaggttgaccaggccctcgctgggggggaaggggggcaagcccatcagatgggggagaaaaccgggggcgggacccggcccctgcgcgaaacccggtggtgcaaccacaacgaaacggctgaagagtcgtaca

SEQ ID NO: 23546 - protein, 166 aa, Zea mays
  misc_feature: Ceres CLONE 1393878-F
  misc_feature (48)..(48): Xaa is any aa, unknown, or other
MDPPPVSPDRWGPSQGSGVGPSALRDMGSISPPQPPPGPIAALLEYSXVVQSGPGLAAHHPSAGPSSPVSASEVDGLLSAGAAGNGKVSIRIQGGQGERRPPGGPGCGTSPRGFGPGHRPVLEVDQALAGGEGGQAHQMGEKTGGGTRPLRETRWCNHNETAEESY

SEQ ID NO: 23547 - DNA, 678 bp, Zea mays
  misc_feature: Ceres CLONE 1393881-F
  misc_feature: Encodes the peptide sequence at SEQ ID NO. 23548
  misc_feature (284)..(284): n is a, c, t, g, unknown, or other
  misc_feature (406)..(406): n is a, c, t, g, unknown, or other
tccccgcggtggcggccgctctatcaatagtggatcccccgggctgcaggaattcgcacgagaccattacctagaacatcctaatcgaaaagaaatgcggcagacgcgtgggtggtcggagctggggcctcagcttgatcccaggctgccgttcgcggaatctctcttcccactggcgacgactgggcgacctccgccgccacactaaaccctattccaggtgcccaggtctgcgtcgggcccttgccggcgacgagcacccgctagttactactgtgcggttnccaagatgcctcgccgtggattgatggaacaggacttaagcaaattggatgtgacaaagcttgacccactgtcacctgaagttatctcacgccaagcaacaatcaatattggtaccattggncatgtggctcatggaaagtctactgtttgtgaggctatatccggaagtcagactggtcgggtccagaatgagctgaaacgtaacattactataaaggtgggctatgctaatggaaaaatctacaaatgtgaggaatggaagatgtccacgaccaaggtgctacaaggcctatggaaggcggaaaagaagatagccctcctatgggatgggcgctgaatttgaaaaacctagaattgaagctcctggaaacatggtttcttttgggtggatgg

SEQ ID NO: 23548 - protein, 110 aa, Zea mays
  misc_feature: Ceres CLONE 1393881-F
  misc_feature: SWISSPROT Homolog: EC 2.1.1.43 Histone-lysine N-methyltransferase
MPRRGLMEQDLSKLDVTKLDPLSPEVISRQATINIGTIGHVAHGKSTVCEAISGSQTGRVQNELKRNITIKVGYANGKIYKCEEWKMSTTKVLQGLWKAEKKIALLWDGR

SEQ ID NO: 23549 - DNA, 779 bp, Zea mays
  misc_feature: Ceres CLONE 1393885-F
  misc_feature: Encodes the peptide sequence at SEQ ID NO. 23550
  misc_feature (278)..(278): n is a, c, t, g, unknown, or other
  misc_feature (348)..(348): n is a, c, t, g, unknown, or other
  misc_feature (387)..(387): n is a, c, t, g, unknown, or other
aaagtggagctccccgcggtggcggccgctctataactagtggatcccccgggctgcaggaattcgcacgagaccattacctagaacatcctaatcgaaaagctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccccctcacacgncttcagcacctacggcgagggtctcgagtccaagatcatcctcgatcgggagacgcagaggtcccgcggntttcggcttcgtcaccttctcacgaaggaggcgatgcgnaacgccatcgagggaatgaacgccaaggagttggacggccaaaaattcacgtaaagaaggccaaatcccgggtggcccggtgaaggggcgccgtgggtaaaggtgggggccgggaagggggcccttcctggggggggggccccctttttgcgcggggggttaaagggggggggggggttaacggggggggggggtttataggggggggggggggggttttacgggggggaaacgggggggggtgttttgagaattccccaagaaattggggggaaatgggggggggggcccccccccggaaaaaaatttcttttggtcccccggggggtgttcccccagccgaggggggtgttcttttctcccggggggggggggtggtagacaccccctcc

SEQ ID NO: 23550 - protein, 80 aa, Zea mays
  misc_feature: Ceres CLONE 1393885-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (27)..(27): Xaa is any aa, unknown, or other
MAASDVEYRCFVGGLAWATDDHSPSHXFSTYGEGLESKIILDRETQRSRGFRLRHLLTKEAMRNAIEGMNAKELDGQKFT

SEQ ID NO: 23551 - DNA, 671 bp, Zea mays
  misc_feature: Ceres CLONE 1393887-F
  misc_feature: Encodes the peptide sequence at SEQ ID NO. 23552
  misc_feature (391)..(391): n is a, c, t, g, unknown, or other
  misc_feature (469)..(469): n is a, c, t, g, unknown, or other
  misc_feature (477)..(477): n is a, c, t, g, unknown, or other
ggagctccccgcggtggcggccgctctatatatagtggatcccccgggctgcaggaattcgcacgagaccattacctagaacatcctatccaaaaacacgttctcccctccatccgcttcccatcagaggttcgagataactcgagtctccttcatcctcatcacaccctcccctcgcgcaccactcgcaaaagctctcctgctcctacgcccgacccaaaccctacccccgacagcgagcgatttcgatgtcctatggccgaatcagtcccgctcgcgctcggccggctaacgatgagacgcgacgcgctacgcgcgcgcgcgaccacacacgatggagcgccgtgtcttcttcgagccctctttcaagatctagcaggggcgtcgcggngctctacgactacggacccccaaggttgcgctgtcaaagctaacgtcctcgcattctggcgccagcattttgtattgnaggaaggnatgcttgaaggttgactgtccatgtgtgacgccagaaagttgttttgaaagcctctggacatgttgataaatttacagacttaatggttaaagatgaaaagacaggcaactgctaccgtgcggatcatttgcctgaagacttctgtaaggataagcttgagaaagatcacacattgtcaccagagatggcagag

SEQ ID NO: 23552 - protein, 37 aa, Zea mays
  misc_feature: Ceres CLONE 1393887-F
  misc_feature: SWISSPROT Homolog: EC 6.1.1.14 Glycine--tRNA ligase
MVKDEKTGNCYRADHLPEDFCKDKLEKDHTLSPEMAE

SEQ ID NO: 23553 - DNA, 881 bp, Zea mays
  misc_feature: Ceres CLONE 1393887-R
tcgaggtgatcctatcgatgagcttttttttttttttttttgaaacgagagaggttatccttttcgagaaacggactcttccatgaaaaaggaagaaaaaaaaattttgaaatcttcctatcttcatctttttctaaaaaaagctcatgttcttgctactgggatgaactcgccttccttgaaaaccccaacatcgatggtaatcgttttctccccgcttttcccatcctggggcaaaaaccccattttgcagaaatttcgcctggaaaacttttcccaaagcccggggtcaggcttcttgagcccaataatttgatcaaaataagcgtccgggtcggttatttcccaccggcacgcgggccgtttttctttcgaatggctccccccctcgtattgggtcaccgtcgtctcccccccgggaaaggcctcgggtcgccccaacaataggaagtacacccccggcttttggcacgggttgcgccccagcggcctctttttaaaggcgtacgctttttagacggcccggcggtaccagttgaggaacttgtgcgccgggttttccttctccggggggaactttttgcccctttgcacccggacagaagaacccccatgcccgggacaccttcccagggtttcgccgttcttctaaacaaaaggactgtttatataagcccccccggttgtcccgtttcattgggccgtgtgaaaaaacccccccaaccccccaaggggcgcccccttcccctcccggaaaaatgggttttctcaacctcccaaggtggttaaaaccttcccgaatcggccccccccccgggggggacaccctgagagccccaaagaaagtccccccttaacactcccatacggggtgtacaacc

SEQ ID NO: 23554 - DNA, 654 bp, Zea mays
  misc_feature: Ceres CLONE 1393889-F
  misc_feature: Encodes the peptide sequence at SEQ ID NO. 23555
  misc_feature (167)..(167): n is a, c, t, g, unknown, or other
  misc_feature (319)..(319): n is a, c, t, g, unknown, or other
  misc_feature (654)..(654): n is a, c, t, g, unknown, or other
gctcaagatctagtggatcccccgggctgcaggaattcgcacgagaccattacctagaacatcctaatcgaaaagacgacgacgacccatcataaaaaagcagggcgtgggcagggggcggacagagcagagctgagctgcctccaactccgacccacacccacggnacggaagtcggcagcagccagcgttgagcgcagtgccctcttgtctgctgcctcctacctcccccgccagtctcactcacacgctcccacttccgagtctcgctcgcagcctgttctcctggggtcccgatcggaggggggtgaggaaatgnacccagattcggcgacgacgaggctcgcatgggtggcgctgcttctcctgggggcgcccgccgcccgggctcgggggctccgggggaggaggccctgtcagcaatgtggactttagaacgcaccagccggcgggtttagaagatctgcgcctgttgctgaaggggcatcccccaatccctggttgggacatcaatggccacggccgaacttattttcccaaggccaacaccaggggggcatgatccttgatggtcccaaaggaagaccatggttgtaaggcttaggaaaatggtccaaccgttgggaagggtgggggacccccaaaaagggtccn

SEQ ID NO: 23555 - protein, 39 aa, Zea mays
  misc_feature: Ceres CLONE 1393889-F
  misc_feature (2)..(2): Xaa is any aa, unknown, or other
MXPDSATTRLAWVALLLLGAPAARARGLRGRRPCQQCGL

SEQ ID NO: 23556 - DNA, 724 bp, Zea mays
  misc_feature: Ceres CLONE 1393894-F
  misc_feature: Translation starting site: 146
  misc_feature: SWISSPROT Homolog: EC 1.11.1.6 Catalase
  misc_feature (347)..(347): n is a, c, t, g, unknown, or other
  misc_feature (426)..(426): n is a, c, t, g, unknown, or other
  misc_feature (491)..(491): n is a, c, t, g, unknown, or other
  misc_feature (552)..(552): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
gctctagaactagtggatcccccgggctgcaggaattcgcacgagaccattacctagaacatcctaatcgaaaaatgtaaaccacactccactccagcactgaacacttgattgattcagtgggtagctagctagctgaatcacaatggatcctaccaagttccgtccgtccagcagccacgacacgacggtgacgacgacgaacgcgggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcngggcctccgccatgggcttcttcgagtgacccacgacgtgacgtcgctgacgtgcgccgacttcctgcgcgcgcccggngtgcggacgcccgtgatcgtgcgcttctcgacgtggatcacgagcgggggtccccggagacaatncgcgacccgcgcgggttcgccgtgagttctccacccgggaggcacttgggacctggtgggnaaaaacttccccgttttctcatccgggaagtattcaggttccccgacgggatccacggtttaaaccaacccggggtcccacgggaggaatatggggtgttaatttggcccccgagcgccctggnnnnnnnnnnnnnnnnnnnnnnnnnnnnnnnnnnnnnnnnnnnnnnnnn

SEQ ID NO: 23557 - DNA, 651 bp, Zea mays
  misc_feature: Ceres CLONE 1393896-F
  misc_feature: Encodes the peptide sequence at SEQ ID NO. 23558
cgctttcaactagtggatcccccgggctgcattaattcgcacgagaccattacctagaacatcctaatcgaaaaatatataatggtattacccccgtcgtcaaatgcaccgccacccaaccccatggccgccgccaccggaagaaccatgaagacgatggcgctcgtcgtcgtcctcgccgccctcctctgctccatctcggtcgccgctgcagccagcggcggcctttcttcgtacgtggtgtacctcggccagcacgcgcacggcgcggcgctgggcacgcacggcgccgaggagctgcaggcgctggagcgcgacgccgccgaggcgcactgcgacctcctcgccggcgtcttgggcggagacaagcagaaggcgcgggaggcgatcttctactcgtacacgaagcacatcaacggcttcgcagccaacctggacgccgccaccgccgccgagattgcggggaaaaccccgggggatctctgtgttccccaaccagggccgcaagatgcacacgacccggtcatggcaggttcgccgccctggccgcgcccggagacgtccaccactgggggcagagggccgaaacccacctcctttcccctcccctctccccttccgtctcttccccccctaccctgccataccccg

SEQ ID NO: 23558 - protein, 176 aa, Zea mays
  misc_feature: Ceres CLONE 1393896-F
MAAATGRTMKTMALVVVLAALLCSISVAAAASGGLSSYVVYLGQHAHGAALGTHGAEELQALERDAAEAHCDLLAGVLGGDKQKAREAIFYSYTKHINGFAANLDAATAAEIAGKTPGDLCVPQPGPQDAHDPVMAGSPPWPRPETSTTGGRGPKPTSFPLPSPLPSLPPLPCHTP

SEQ ID NO: 23559 - DNA, 724 bp, Zea mays
  misc_feature: Ceres CLONE 1393897-F
  misc_feature: Encodes the peptide sequence at SEQ ID NO. 23560
aagctggagctccccgcggtggcggccgctctatactagtggatcccccgggctgcaggaattcgcacgagaccattacctagaacatcctaatcgaaaaagaccttctttcggtcccgtcctttcccctgcgcgccgcgagtgaattccggagtccccaatctatccgacgccacacgaaacgaaacacaagagaagagagaagagaatagagagaaggtcgaagggctagacccggtcccccaattccaattcgcccctctcgcggccggcctcgcgagacgccgattcggatcccatctcctgctcagagcctcgattcgaccggcggtggcgacgattcgaccgggtcggtagccaggcagaggcagcggaaggagaggatgagcttccaggacctggaggcgcggcacgtccgcggagcgccgctcggcgtcggtcggaggaacggcagggtccccgcgtgggcggagggcgccggcgccggcgcgtcgcaggtcgtggcgtcgagcgtcttccagatcaacaccgcggttgccacgttccagcgcctcgtcaacacgctcgggacgcccaaggatacacccgacctccgcgacaggatacataaaacacgccgacacataccacgactagtgaaagatacatcagaccagctttaaacagctagcgaggcggatcatcgcgttgaaagcagcgctaccaaaagattgctgatggcaag

SEQ ID NO: 23560 - protein, 92 aa, Zea mays
  misc_feature: Ceres CLONE 1393897-F
MSFQDLEARHVRGAPLGVGRRNGRVPAWAEGAGAGASQVVASSVFQINTAVATFQRLVNTLGTPKDTPDLRDRIHKTRRHIPRLVKDTSDQL

SEQ ID NO: 23561 - DNA, 684 bp, Zea mays
  misc_feature: Ceres CLONE 1393899-F
  misc_feature: Encodes the peptide sequence at SEQ ID NO. 23562
  misc_feature (385)..(385): n is a, c, t, g, unknown, or other
  misc_feature (388)..(388): n is a, c, t, g, unknown, or other
  misc_feature (435)..(435): n is a, c, t, g, unknown, or other
  misc_feature (502)..(502): n is a, c, t, g, unknown, or other
  misc_feature (521)..(521): n is a, c, t, g, unknown, or other
cgctcttaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgnccnacatgcactaccctactcaaccgccccggctcagcctcatccccagncacacccatggcccgtgcaacagccgcatccaaggcccgtgcagctgcagggaaccctgcggcgtgncagcaccccgatcctgggncagtgcgtcaagtttctgaggcatcaagtgagcccgaagggacgccctactgctcgcctcaaggcatcgttggggcagcaggttgccaaacctcaggaggtggagccgcaaaccgggacaggggatttcgggtgggccctccgccattccggaaaggggcgaa

SEQ ID NO: 23562 - protein, 131 aa, Zea mays
  misc_feature: Ceres CLONE 1393899-F
  misc_feature (81)..(81): Xaa is any aa, unknown, or other
  misc_feature (82)..(82): Xaa is any aa, unknown, or other
  misc_feature (97)..(97): Xaa is any aa, unknown, or other
  misc_feature (120)..(120): Xaa is any aa, unknown, or other
  misc_feature (126)..(126): Xaa is any aa, unknown, or other
MRVLLVALALLALAASATSTHTSGGCGCQPPPPVHLPPPVHLPPPVHLPPPVHLPPPVHLPPPVHLPPPVHVPPPVHLPPXXMHYPTQPPRLSLIPXHTHGPCNSRIQGPCSCREPCGVXAPRSWXSASSF

SEQ ID NO: 23563 - DNA, 769 bp, Zea mays
  misc_feature: Ceres CLONE 1393900-F
  misc_feature: Encodes the peptide sequence at SEQ ID NO. 23564
  misc_feature (253)..(253): n is a, c, t, g, unknown, or other
  misc_feature (262)..(262): n is a, c, t, g, unknown, or other
  misc_feature (265)..(265): n is a, c, t, g, unknown, or other
  misc_feature (268)..(268): n is a, c, t, g, unknown, or other
  misc_feature (313)..(313): n is a, c, t, g, unknown, or other
  misc_feature (317)..(317): n is a, c, t, g, unknown, or other
  misc_feature (326)..(326): n is a, c, t, g, unknown, or other
  misc_feature (351)..(351): n is a, c, t, g, unknown, or other
  misc_feature (353)..(353): n is a, c, t, g, unknown, or other
  misc_feature (424)..(424): n is a, c, t, g, unknown, or other
  misc_feature (431)..(431): n is a, c, t, g, unknown, or other
  misc_feature (617)..(617): n is a, c, t, g, unknown, or other
tggagctccccgcggtggcggccgctctagaactagtggatcccccgggctgcaggaattcgcacgagaccattacctagaacatcctaatcgaaaaatagcgaacaaacatcgagtacagtcggctaggtaatctggtggtacgacgacatggcggccaccagcagcaagtcgtcgtcgtcctcgagctcggcgcagcgggcagctgccgcactgctcgtggccgccgccgtggcggtgtccgtcctggtgntgggcgcgncgncgntgtgcgacatgagcaacgagcagttcatgtcgtgccagcccgcgncggncaagacgancgacccgccggccgcgccgtcgcangngtgctgcgacgcgctggcgggggcggacctcaggtgcctgtgcggctacaggacctcgccgtgggatggcngtctacnaaatcgacccccaggcgggccatggaacttccgggccaaggggggcctcccccacgccgcccaatggattacatggggggttcccaagcccagccaagggggaaagccccccggattgctaacgtgaaccgttctgggggggacttttccacaaggtgggagggaggggcccccaaaaagaagggntcttttccccccccccttttggccccgaaaatattgaagggggggggggcccaaaaaaaaaaaaagtttttttggcccccccggtgggggagtgataaacacgtgcccccgggatgtttatttttggggggcccccgcgccaaaaacaaaaa

SEQ ID NO: 23564 - protein, 135 aa, Zea mays
  misc_feature: Ceres CLONE 1393900-F
  misc_feature (35)..(35): Xaa is any aa, unknown, or other
  misc_feature (38)..(38): Xaa is any aa, unknown, or other
  misc_feature (39)..(39): Xaa is any aa, unknown, or other
  misc_feature (40)..(40): Xaa is any aa, unknown, or other
  misc_feature (55)..(55): Xaa is any aa, unknown, or other
  misc_feature (56)..(56): Xaa is any aa, unknown, or other
  misc_feature (59)..(59): Xaa is any aa, unknown, or other
  misc_feature (67)..(67): Xaa is any aa, unknown, or other
  misc_feature (68)..(68): Xaa is any aa, unknown, or other
  misc_feature (92)..(92): Xaa is any aa, unknown, or other
  misc_feature (94)..(94): Xaa is any aa, unknown, or other
MAATSSKSSSSSSSAQRAAAALLVAAAVAVSVLVXGAXXXCDMSNEQFMSCQPAXXKTXDPPAAPSXXCCDALAGADLRCLCGYRTSPWDGXLXNRPPGGPWNFRAKGGLPHAAQWITWGVPKPSQGGKPPGLLT

SEQ ID NO: 23565 - DNA, 737 bp, Zea mays
  misc_feature: Ceres CLONE 1393902-F
  misc_feature: Encodes the peptide sequence at SEQ ID NO. 23566
tccccgcggtggcggccgctcttgcaatagtggatcccccgggctgcaggaattcgcacgagaccattacctagaacatcctaatcgaaaaacactgaactgaacacgcgcgcgcgcacgccatccgcctcccgtagcgtgcggcgtgccgtcaatccaaaccaccaaaagcaatgccgccgccgtccgcaaacggcgccaccgccgccgccgccgccgcgagggacgacatgtccccggcggaggccaggctggcgatgatggagctggcgaacatggtgtcggtgccgatggcgctgacgatcgtgatccggctggacgtgccggccgaggtgtgttctggctgcgccaacgcgcccatgtcagtggacgacatcctccctgcgagacacccggtaccgtacgaccatggataagatgctccgactgtttgctgtcctgggacattttctccgagtctaccgagtccaccgcccacctcgttcccatattatattcttcgatgaccgtcggtgggccttaccctggagccgaaaaccccgcttcttccacttattacgccgaactactttttagaaaaacatccataatactgttctagggaactggaaccacctctggattaagccccgtgctgtgaccccgaagtaaaactacccagttcttcctattgctaccgtgggagggacggtcttacccctattactggaaagcacaaggccctcaaaccgagtcat

SEQ ID NO: 23566 - protein, 80 aa, Zea mays
  misc_feature: Ceres CLONE 1393902-F
MPPPSANGATAAAAAARDDMSPAEARLAMMELANMVSVPMALTIVIRLDVPAEVCSGCANAPMSVDDILPARHPVPYDHG

SEQ ID NO: 23567 - DNA, 688 bp, Zea mays
  misc_feature: Ceres CLONE 1393903-F
  misc_feature (377)..(377): n is a, c, t, g, unknown, or other
  misc_feature (378)..(378): n is a, c, t, g, unknown, or other
  misc_feature (380)..(380): n is a, c, t, g, unknown, or other
  misc_feature (381)..(381): n is a, c, t, g, unknown, or other
  misc_feature (497)..(497): n is a, c, t, g, unknown, or other
  misc_feature (498)..(498): n is a, c, t, g, unknown, or other
  misc_feature (505)..(505): n is a, c, t, g, unknown, or other
  misc_feature (688)..(688): n is a, c, t, g, unknown, or other
tccccgcggtggcggccgctctagaactagtggatcccccgggctgcaggaattcgcacgagaccattacctagaacatcctaatcgaaaaaacagcaaagcccaggctgcccagcacacgcgacgcgaaccagctgccgaggaaccctagcggagcactgtgcaggcgaccgcggcgcgctatcacttacggggggatacggcggcatcgtccccctcggcccctcctccatccctggtgcggcggcgccagcctgcaggtgttgaatgctgatttgttgtggctgattaattgggttgatcgtcgattaatcgtgattagtccgctgatcgcccttctggcgatcagaaacgataagggcatctgaaaacatggnncnngcaacctccagagcgactcccgcgagccgtgaccaccatagccccaatcacgcaccagaagctttcccggagctgcctcgtccacggagggtccaggtgactcctatcccctgggnnatggaancttctgcaaagaagggcggggggttttgcacccccccccccggggggatccgggggttgcccaaaagggggcccccccccccccccccccggagaaggggcccctttggggggcgggggggaaaaggaacaccagggtttttgggagaaggcccccccccccggggggggggggtttcaaccn

SEQ ID NO: 23568 - DNA, 760 bp, Zea mays
  misc_feature: Ceres CLONE 1393904-F
  misc_feature: Encodes the peptide sequence at SEQ ID NO. 23569
  misc_feature (291)..(291): n is a, c, t, g, unknown, or other
  misc_feature (368)..(368): n is a, c, t, g, unknown, or other
  misc_feature (369)..(369): n is a, c, t, g, unknown, or other
  misc_feature (436)..(436): n is a, c, t, g, unknown, or other
  misc_feature (449)..(449): n is a, c, t, g, unknown, or other
cgctctagtactagtggatcccccgggctgcaggaattcgcacgagaccattacctagaacatcctaatcgaaaactaatcgagcatcgcagagataggcgtcttcgtactcgcctacctccgcggctcaaacctttcccccttctcccaattccctccgtcggccgccgctccatcccgtacgacgacaccatgagggagtgcatttcgatccacatcggccaggccggtatccaggtcggaaacgcgtgctgggagctgtactgccttgagcatggcattcaggctgancgtcagatgcccggtgacaagaccatggggggaggtgatgatgctttcaacacctttctcagtgagactggtgctgnnaagcacgtgccccgtgctggtttttgtgacctggaaccaactgtcatcgatgagggggaggacgggnacctacgggcagntcttcccaccctgaaaagttcatccggggggagggaggatgcagccaaaaacttggccccggggcccctaacccattgggaagggaaattggtgaccatatgccttgaacccaaaagaaaagttggccaaaaatggaatgggttccagagggtttccccccttttaaaccttttgggagggaaaaaaagttttttgctttttgtctcccccttcccaaaaggggtgtgtgtggtaataaaaaaaaaaaaaaaccctttgtggggtaagtgggcaccccccccccccagatttttttttgggggggggagaa

SEQ ID NO: 23569 - protein, 189 aa, Zea mays
  misc_feature: Ceres CLONE 1393904-F
  misc_feature (33)..(33): Xaa is any aa, unknown, or other
  misc_feature (59)..(59): Xaa is any aa, unknown, or other
  misc_feature (82)..(82): Xaa is any aa, unknown, or other
  misc_feature (86)..(86): Xaa is any aa, unknown, or other
MRECISIHIGQAGIQVGNACWELYCLEHGIQAXRQMPGDKTMGGGDDAFNTFLSETGAXKHVPRAGFCDLEPTVIDEGEDGXLRAXLPTLKSSSGGREDAAKNLAPGPLTHWEGKLVTICLEPKRKVGQKWNGFQRVSPLLNLLGGKKSFLLFVSPFPKGVCVVIKKKKNPLWGKWAPPPPRFFFGGGR

SEQ ID NO: 23570 - DNA, 739 bp, Zea mays
  misc_feature: Ceres CLONE 1393908-F
  misc_feature: SWISSPROT Homolog: EC 2.7.11.24 Mitogen-activated protein kinase
  misc_feature (424)..(424): n is a, c, t, g, unknown, or other
tccccgcggtggcggccgctctagtaacagtggatcccccgggctgcaggaattcgcacgagaccattacctagatcatcctaatcgaaaacccggcccgcgcctcgctctctcttgtctcgcccgctagctcccatcccagcctcccaccgcgcccgcctgccccaacatcccccctccccgctccgctccacgcacggctccagatctgctacggcggcggccggtggacgccgcgccgcgcgtgccggaggcggtgacgtgagcggcggatcctgcccggccgtgccatcctggcgacgatgacagcgtaagcgggcggcggacgaccgcgcccccccggcccctactcccgaggtcattggcgtgtgctccttggcagaaatggcgatgatggtggatccccccaatgccatgccaagtncaggaaagcattactatactatggtgcagacactggtttgagatcgacaccaagtacgggccgatcaaacccatcggaggaggagctaacggaaacgtttgctcatctgttaacgggaaaaccaaggaaaagccgcgaaaaaaaagaaaacaaacgtctttgacaaccggggggaatgcctaaagaccctaaaaaagctaaacccccttccccccctagagaaaaaaaaggtattgcctccaaggaaaaaaagggcccggccaaaaaaaaaggtttaagggccttaatttggtttaagggccccggggcccggcc

SEQ ID NO: 23571 - DNA, 721 bp, Zea mays
  misc_feature: Ceres CLONE 1393910-F
  misc_feature: Encodes the peptide sequence at SEQ ID NO. 23572
tccccgcggtggcggccgctctataactagtggatcccccgggctgcaggaattcgcacgagaccattacctagaacatcctaatcgaaaactctaatctctttgcctctttggctccctccaccaccagtccaccaccactgctacccaacccttgcttccccaaaccctagccaagggacacggtggccgacgatggacggcgacggaggaggcgctggtgcgctgcaccaccacacgcgctcacccgaggacgtcttccgcgatttccgcgcgcgccgagccggcatcgtcaaggcgctcaccacggatgtggagaagttctatcagcagtgcgatccagagaaagagaacttgtgcctttatggtttgccaaatgagacttgggaggtcactctctcagctgaggaagtacctcctgagcttccagaaccagcactggggataaactttgcccgtgatggaatggtcgaaaaagactggttgtctctaagtgcagttcatagtgatgcatggctcctgtctgttgcattctacttgggagctccgttttggatttgacaaagatgcagggagaagctcttccacatgattaacaacctggccactggttatgaagttggggacggggggtgcttagaagaaatcgaaaagcccccaaggggagcagcaaaggagcaggcctactctaaaccatcaaactgacccattctaaacggag

SEQ ID NO: 23572 - protein, 121 aa, Zea mays
  misc_feature: Ceres CLONE 1393910-F
MDGDGGGAGALHHHTRSPEDVFRDFRARRAGIVKALTTDVEKFYQQCDPEKENLCLYGLPNETWEVTLSAEEVPPELPEPALGINFARDGMVEKDWLSLSAVHSDAWLLSVAFYLGAPFWI

SEQ ID NO: 23573 - DNA, 682 bp, Zea mays
  misc_feature: Ceres CLONE 1393915-F
  misc_feature (324)..(324): n is a, c, t, g, unknown, or other
  misc_feature (682)..(682): n is a, c, t, g, unknown, or other
tccccgcggtggcggccgctctagaactagtggatcccccgggctgcaggaattcgcacgagaccattacctagaacatcctaatcgaaaagtgtcgtcttcctctccgccgcttctcctgtccaccctcgactgcttgcgcgtgacctgagccgccgccgcctacatccgctcatccccgcgcccgcctcaaccacgccgccaccgaccacgtataatcctgcctccccttcgcgcggtttcgaggctcgtttcctttgggatcgttcgtctgccccgaccgcgtgggcgcttcttcttcgggatctcgctggaccgagcggnccagggctagggattcaggcccatggcgtgccgccgcgtcctcacccagattgcaaggcatcgaccagcaaaagcatctaccatgacctagttgctcctccccctttggtggttctccaagggacattcacttcaggtgccaggattaaacttttaacagaggagaacccggcaaggtaccttggaaacctggccccccgggcccgaaatttaaaatccccaggggaacttcccggtttaaaaaattttaccagaagggccccggggggggctaaaaaaaattttgaaaggcccccctttttaaattttaaatccgggaccatttgggggatagaaaaactctccttggagggtctcn

SEQ ID NO: 23574 - DNA, 644 bp, Zea mays
  misc_feature: Ceres CLONE 1393917-F
  misc_feature: Encodes the peptide sequence at SEQ ID NO. 23575
  misc_feature (644)..(644): n is a, c, t, g, unknown, or other
cgaccttacctagaacatcctaatcgaaaagatggtctcgtactcttgtcacgttccttcctgactgcccccacttctcctccggcggcgcggcggcgggttacctcccaacagcccgaccatggaagccgacatcgctttcaggtatgagatcccccggaccgcccagttcctccgcgacggcgcctacaccagggtcgcgctccagttccccgacgagatgctgaaggatgctgctgcggtggcgagggcgttgcggcgggagcttgcctccggcggcgccgacagtggggttagggtgttcgtgatggacgacacggcgtacaactcctgctgcgtggacgaggtgggcgcgtcccacatcgatgcgcagtgcgtcgtccactacggccacgcctgcatgagcccaacatcaaatttgccagctttctttgtatttgggaaggcaccgttggatgtccacgcatgtgccggcacattgctggagtgctcacggaacagcaataagcgcattctggttttatatggactagagtacgcatatgcattggatggacttagacagactttcatggagtcatgaaaatcaaatcctggcaatcatggaggccagtatggaaaagttctattgtccagtattgagn

SEQ ID NO: 23575 - protein, 153 aa, Zea mays
  misc_feature: Ceres CLONE 1393917-F
MEADIAFRYEIPRTAQFLRDGAYTRVALQFPDEMLKDAAAVARALRRELASGGADSGVRVFVMDDTAYNSCCVDEVGASHIDAQCVVHYGHACMSPTSNLPAFFVFGKAPLDVHACAGTLLECSRNSNKRILVLYGLEYAYALDGLRQTFMES

SEQ ID NO: 23576 - DNA, 702 bp, Zea mays
  misc_feature: Ceres CLONE 1393919-F
  misc_feature: Encodes the peptide sequence at SEQ ID NO. 23577
  misc_feature (522)..(522): n is a, c, t, g, unknown, or other
gctctatactagtggatcccccgggctgcaggaattcgcacgagaccattacctagaacatcctaatcgaaaaagtctgcacaccgccactcgcccacacgcgaaggcacctagcagccgccactcgccgaactgaggaacacgccgggcgacgggatacagcagcagcgcgcccctctatccccgacgcgacggcgccctgcagctgcagataaacctgttccaatggccaaacaaaaagagggtgtggacaaaagaacttctaggaagatgatccgatctacggaaggctgtgcaaagagcattactttggagaggaacaacaaatcagacgatgtgcagcttcacgatctgccgaatgacatcctaggtagcatactatcacggttgacattcagagaatcctcacagatgggccttgtttctcatacctggcggcggctgtggagaagctgttgccggaaactggtcttcaccagtgccaccatgttccaacccggaaataggagcatcaaacatacnaggaccaactttgccatgagagtcaacagtttcttgcgtcagctacgcactcatcctactcttaataagtttggtattaagttcgggctgcgcaggaagcacactcgccatgtcaacagatggattcgcttctgctccgtgtcgcgagcaagcacatcactattaatttcactcctggag

SEQ ID NO: 23577 - protein, 159 aa, Zea mays
  misc_feature: Ceres CLONE 1393919-F
  misc_feature (38)..(85): Pfam Name: F-box Pfam Description: F-box domain
MAKQKEGVDKRTSRKMIRSTEGCAKSITLERNNKSDDVQLHDLPNDILGSILSRLTFRESSQMGLVSHTWRRLWRSCCRKLVFTSATMFQPGNRSIKHTRTNFAMRVNSFLRQLRTHPTLNKFGIKFGLRRKHTRHVNRWIRFCSVSRASTSLLISLLE

SEQ ID NO: 23578 - DNA, 711 bp, Zea mays
  misc_feature: Ceres CLONE 1393922-F
  misc_feature: Encodes the peptide sequence at SEQ ID NO. 23579
ggcggccgctctatcctagtggatcccccgggctgcaggaattcgcacgagaccattacctagaacatcctaatcgaaaaatctcatcttcgtctgtgttcttgggcgtacgcggacacagccccgatccgaatcgtcgtccttgcgagcctcgccgatcccccactcccctcccctcgcttcaagatgcagatctttgtgaagaccctcaccggcaagactatcaccctcgaggtggagtcttctgacaccattgacaatgtcaaggctaagatccaggacaaggagggcatccctcctgaccagcagcggcttatcttcgccggcaagcagcttgaggacggacgcacacttgctgactacaacatccagaaggagtcaaccctccacttggtgctgcgccttaggggaggcatgcagatctttgtcaagaccttgactggcaagacaatcacccttgaggtggagtcctcagacaccattgacaatgtcaaggcaaagatccaggacaaggagggcatcccacctgaccagcaacgtctcatctttgccggcaagcagttggaggatgggaggacccttgctgactacaacatgcagaaggagagcaccctccacttggtgctgcgtcttaggggtggtatgcagatctttgtgaaaaccttactggcaagaccatcactcttgaggtggagtcttcagataccattg

SEQ ID NO: 23579 - protein, 175 aa, Zea mays
  misc_feature: Ceres CLONE 1393922-F
  misc_feature (6)..(74): Pfam Name: ubiquitin Pfam Description: Ubiquitin family
  misc_feature (82)..(150): Pfam Name: ubiquitin Pfam Description: Ubiquitin family
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNMQKESTLHLVLRLRGGMQIFVKTLLARPSLLRWSLQIPL

SEQ ID NO: 23580 - DNA, 653 bp, Zea mays
  misc_feature: Ceres CLONE 1393924-F
  misc_feature (295)..(295): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (607)..(607): n is a, c, t, g, unknown, or other
  misc_feature (611)..(611): n is a, c, t, g, unknown, or other
  misc_feature (613)..(613): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (653)..(653): n is a, c, t, g, unknown, or other
tcagaactagtggatcccccgggctgcaggaattcgcacgagaccattacctagaacatcctaatcgaaaaaactaggagagtggtggaggaggagacccaccgtcggctcgcccgtgtcccgattcccactcacgacatcaacctgtccccatccatctcgcccgcgacgtttgatggagtctctcctcgcctcgcgatccattaggtcttccttctccgccgtcgccagcaccaggggcgccgcttcccccaggccctcgcgcgtcgccaccctcgccagcgccggcgccggngcccgctcccgcgcgctccgtgctgggcacacgaactcaatccttgagtgctggcacaggacgatatgctgaacgcaaaggagctgtccaatgggagaaaggcttgtcattcaatgacataaggggtaagaaggggatccccatccgaaaaaatggcggcccattgcctccttggaagaaaaaaaggaggagttgggaccccccctttaactctcaaaaacatcctttggtacagataatgagtgaactggggtgtacagcatgnnnnnnnnnnnnnnnnnnnnnnnnnnagnnnnnnnnnnnnnnnnnccnttcntnaccnnnccccccccccccttttccccctcccgctcccccn

SEQ ID NO: 23581 - DNA, 718 bp, Zea mays
  misc_feature: Ceres CLONE 1393930-F
  misc_feature: Encodes the peptide sequence at SEQ ID NO. 23582
gctctttaactagtggatcccccgggctgcaggaattcgcacgagaccattacctagaacatcctaatcgaaaaattcatttcctcactcattgagggtatgctatttgtgcgtcaagctcaagccgtcaggcgatacaactacaagcctacagtgcctacccctccgccgcctatagagatagattccagcgatgacgaagaccacgccgccggtgttcgtgtaccggatcagcacgctcgacgagtgggcggagtttcagcgcacgaacgccacccttggagacgatctcaacagctccaccggctgcatccatctcagtgacctactctagcagaacatgactttgaaaatctttttccttgtaaggaatgatctgtacctactggaaattgatactttcctgcttgcagatgtgttaattgatgagcttacgcgatgatgataactatctgccccatttctatgatcctgatcggagctatgcacctcttcaactatatactgttgtgatggcatacaaaatagagtttcgcagacaatgttttttcccttgcgggctacttgagggaagttcctctcccaagctgatctgtagagtcttctcctcaattttaaaagtggatcctttggtttcctctggcaaaggttatcggcttaatatgtctatttgctgccaaaagccgtgcatatatttgagggaaaaatttttccctgc

SEQ ID NO: 23582 - protein, 46 aa, Zea mays
  misc_feature: Ceres CLONE 1393930-F
MTKTTPPVFVYRISTLDEWAEFQRTNATLGDDLNSSTGCIHLSDLL

SEQ ID NO: 23583 - DNA, 697 bp, Zea mays
  misc_feature: Ceres CLONE 1393931-F
  misc_feature: Translation starting site: 310
  misc_feature (401)..(401): n is a, c, t, g, unknown, or other
acccgcggtggcggccgctctataactagtggatcccccgggctgcaggaattcgcacgagaccattacctagaacatcctaatcgaaaaattgctctccaaccaaacctcgtctcgtcttctctccgctaccaccaccactgctcgttttacagaaaccggaaggaaccaaacgcctttccgccccgggccgccgctacccaagcccagcaaccaccactcgttgtcgtcgactactaggcggcaagcaggcgtcctgttttttttttttggtcctcgtcgtcgtccggactccggacaggacaggacatgggcgcggaggcggcggagcgcgacagaatcaggggcccgtggagccccgaagaaagacgagcgctgcggcggctggtggagcggcacgncgcgcgcaactggacggcgatcgggcgcgccgtcccgggccggtcgggcaagtcgtgcccgctgcggtggtgcaacagctgtcgccagggtggcgcgccgcccccttcacgccgacgaggacgggtcaatcgccggggccaacgcccggctgggaaaccgttggggcggcatcgggcgcctgctccccgggcgaacgaaaaaggcggtaaaaaacattgggactggtcccctcaagggaaattccgggcccccccccgcccggtccgttttcgggggtttcccgtgaaaaactccg

SEQ ID NO: 23584 - DNA, 722 bp, Zea mays
  misc_feature: Ceres CLONE 1393933-F
  misc_feature: Encodes the peptide sequence at SEQ ID NO. 23585
  misc_feature (561)..(561): n is a, c, t, g, unknown, or other
  misc_feature (702)..(702): n is a, c, t, g, unknown, or other
  misc_feature (703)..(703): n is a, c, t, g, unknown, or other
ggagctccccgcggtggcggccgctctagaactagtggatcccccgggctgcaggaattcgcacgagaccattacctagaacatcataatcgaaaaacgacccctcagccctcacacaagagacgcagctgcgagtccgccagccttatcctcctccccgtctccggctccaacccgcaagcgcggtaaggtatggcttcgacattcggtgccacttctactgtcggccttatggctgctccaacagggaagaatgtgcgccttcagaggagggtgaacttcagagtaagagcagctaaggagctgtacttcaacaaggatggctcagctatcaagaagctccagactggagtcaataagcttgcagacctagtcggagttacactcggaccaaagggaaggaatgttgttttggagagcaagtatggttctcctaaaattgttaacgatggtgttacagttgccagagaggttgagctggaggaccctgtggagaacattggtgctaaattggtcaggcaagcagcagctaagaccaatgatctagctggagatgggacnaccacctctgtggtccttgctcaggggctgatcgctgagggtggtaaggttgtggcagctggtgctaatccctgtcagattactcgtggtatcgagaaaacagcgaaagcactagttgaagaactacgggagttgtctaanngaggtcgagatagtgagct

SEQ ID NO: 23585 - protein, 176 aa, Zea mays
  misc_feature: Ceres CLONE 1393933-F
  misc_feature (170)..(170): Xaa is any aa, unknown, or other
  misc_feature (171)..(171): Xaa is any aa, unknown, or other
MASTFGATSTVGLMAAPTGKNVRLQRRVNFRVRAAKELYFNKDGSAIKKLQTGVNKLADLVGVTLGPKGRNVVLESKYGSPKIVNDGVTVAREVELEDPVENIGAKLVRQAAAKTNDLAGDGTTTSVVLAQGLIAEGGKVVAAGANPCQITRGIEKTAKALVEELRELSXXGRDSE

SEQ ID NO: 23586 - DNA, 668 bp, Zea mays
  misc_feature: Ceres CLONE 1393934-F
  misc_feature (278)..(278): n is a, c, t, g, unknown, or other
  misc_feature (326)..(326): n is a, c, t, g, unknown, or other
  misc_feature (405)..(405): n is a, c, t, g, unknown, or other
  misc_feature (410)..(410): n is a, c, t, g, unknown, or other
  misc_feature (411)..(411): n is a, c, t, g, unknown, or other
  misc_feature (434)..(434): n is a, c, t, g, unknown, or other
  misc_feature (435)..(435): n is a, c, t, g, unknown, or other
  misc_feature (492)..(492): n is a, c, t, g, unknown, or other
  misc_feature (509)..(509): n is a, c, t, g, unknown, or other
tccccgcggtggcggccgctctagaactagtggatcccccgggctgcaggaattcgcacgagaccattacctagaacatcctaatcgaaaaaccattaaaatgtactggtacctagctagcgcgcggtagtcacagtgggtggcactgggcaatggcagcagtcgcagaaagagaggacgactgaggagcagcgatccagcggctgcagctcttcctccctgccctgaagctgaagctgctgagaatagatgccctctccttccctccctccctcccntcatctccatgagttgagcagcctgagcagatgaggtgaagtgagttngctgccagcgcgtgctgtatcttgtatggctgtactgtatcccccctcctctcgctaaccctttgtctccttcccccanaaaanncacctcgccccctccctccacanngtacctgtgagtgtgagctccttgctgcggctgcttgctccctcatctctagctgtnacactgggtttgagtgntttgccagtggtctcccccacctgctcctctcgatccactcccatcccttttggccatggggtgtgccagcatacttctaccggaaattgcatcgctcctcctggctttggagcggaacccttaccctagccctgccggcctgaggaaaaactttcggt

SEQ ID NO: 23587 - DNA, 671 bp, Zea mays
  misc_feature: Ceres CLONE 1393936-F
  misc_feature: Encodes the peptide sequence at SEQ ID NO. 23588
  misc_feature (237)..(237): n is a, c, t, g, unknown, or other
  misc_feature (257)..(257): n is a, c, t, g, unknown, or other
  misc_feature (454)..(454): n is a, c, t, g, unknown, or other
  misc_feature (468)..(468): n is a, c, t, g, unknown, or other
aagctggagctccccgcggtggcggccgctctagaatagtggatcccccgggctgcaggaattcgcacgagaccattacctagaacatcctaatcgaaaaatcccaagaagagccgccctacctattccttctccccgccgtcgagctgcccaacccagagcaccagcagccctcacctccttcctctcggccggtccttccacgagcccgctggtcttggagccgcaccgttctcngtctggacgaacgttcaggnagattgcatttggggatgctctaatggagtcgaaaggtggcaagaagtctagtagtagtagtagtaatttcatggacgaagctccccttggctacaagatcgaggacgttcgcccagccggaggaatcaagaagttccagactgctgcttattccaactgggtccgccagccatcctgatatcgcctcacatgcaantcgcgggagagtangattttaattcagttctcctctggggcccggagttttccgttgggtctgggtgccttcctctgcttctgagataccaactgggcttgcccatctctccttttcctctctcatcttctctttcttgcacgtatccaagtggggatggcttcacaagatcttggggcctctcctccgcctcccctattggttttgagggatataa

SEQ ID NO: 23588 - protein, 51 aa, Zea mays
  misc_feature: Ceres CLONE 1393936-F
  misc_feature (1)..(51): Pfam Name: AdoMetDC_leader Pfam Description: S-adenosyl-l-methionine decarboxylase leader peptide
MESKGGKKSSSSSSNFMDEAPLGYKIEDVRPAGGIKKFQTAAYSNWVRQPS

SEQ ID NO: 23589 - DNA, 552 bp, Zea mays
  misc_feature: Ceres CLONE 1393937-F
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
ggagctccccgcggtggcggccgctctagaactagtggatcccccgggctgcaggaattcgcacgagaccattacctagaacatcctaatcgaaaaacacggtccacacagcccaacaaaggagcgcggcggcccctccttccttcctcccacttctctcgcgcggcgctcgcttacctcgcctcgcattccgttcgagcaggggagcggcagtgagaagggagggaattaaggcaagatgttcatcgagagcttcgcgtcgagagcccccaacgtggcggtaacgggccccggaaggggaaaaaattggggggtcggggaaacccggggaaaaaaccccccccccnnnaaaattttgggggcggccacgacgcccccccagggggggggggnnnnnccccccccccccccccgtgtggggggttnnnnnntccccccccccccccccccccggggaaaaaattttttttgagaaaaagggggggcccccaaaaaagatttttttttttttgtggggggggggggagaaaaaaaaacacccccccccccccc

SEQ ID NO: 23590 - DNA, 656 bp, Zea mays
  misc_feature: Ceres CLONE 1393941-F
  misc_feature: Encodes the peptide sequence at SEQ ID NO. 23591
  misc_feature (286)..(286): n is a, c, t, g, unknown, or other
  misc_feature (305)..(305): n is a, c, t, g, unknown, or other
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (316)..(316): n is a, c, t, g, unknown, or other
  misc_feature (326)..(326): n is a, c, t, g, unknown, or other
  misc_feature (330)..(330): n is a, c, t, g, unknown, or other
  misc_feature (406)..(406): n is a, c, t, g, unknown, or other
  misc_feature (411)..(411): n is a, c, t, g, unknown, or other
  misc_feature (440)..(440): n is a, c, t, g, unknown, or other
tccccgcggtggcggccgctctagaactagtggatcccccgggctgcaggaattcgcacgagaccattacctagaacatcctaaaaaaaaaaaaaaaaatcccagccttttgtttgcttctctgtctcctgctgattggtgtccccgggtccaggactcttgatttgctcctcgcgggggttcggtcccatggcggcagctgcgctggcaatggcagagcaggtggtgcccgagctccgagtgaggtgtgagacgcccgcgtcgatgctgcgcgaggtggccgtgnagatggcccgcgagatggncgcgnnnctgnagaaggacgncggnagcagggtcaagatgctcctctcctacgtcgataagctcccacaggggagagaggaaggattattctatggattgnacctngaaggaacgaatttcggcgtcttgaaggngcactaagggggaaatgcaaaccatgtcgttgaccgtgactccagagaaagcggaattccgccacatctggtggcgggaagctcctccggagttttttggttccttggtttcgaattggccagagtttgtgacaagaaaaaaaagggccttaactttgtgaagggaaaaaagggacaataaggctccccttttttccccccaaggaaaaagggttc

SEQ ID NO: 23591 - protein, 85 aa, Zea mays
  misc_feature: Ceres CLONE 1393941-F
  misc_feature: SWISSPROT Homolog: EC 2.7.1.1 Hexokinase
  misc_feature (33)..(33): Xaa is any aa, unknown, or other
  misc_feature (39)..(39): Xaa is any aa, unknown, or other
  misc_feature (41)..(41): Xaa is any aa, unknown, or other
  misc_feature (43)..(43): Xaa is any aa, unknown, or other
  misc_feature (46)..(46): Xaa is any aa, unknown, or other
  misc_feature (73)..(73): Xaa is any aa, unknown, or other
  misc_feature (84)..(84): Xaa is any aa, unknown, or other
MAAAALAMAEQVVPELRVRCETPASMLREVAVXMAREMXAXLXKDXGSRVKMLLSYVDKLPQGREEGLFYGLXLEGTNFGVLKXH

SEQ ID NO: 23592 - DNA, 667 bp, Zea mays
  misc_feature: Ceres CLONE 1393945-F
  misc_feature (321)..(321): n is a, c, t, g, unknown, or other
  misc_feature (342)..(342): n is a, c, t, g, unknown, or other
  misc_feature (378)..(378): n is a, c, t, g, unknown, or other
  misc_feature (434)..(434): n is a, c, t, g, unknown, or other
  misc_feature (546)..(546): n is a, c, t, g, unknown, or other
  misc_feature (547)..(547): n is a, c, t, g, unknown, or other
  misc_feature (550)..(550): n is a, c, t, g, unknown, or other
  misc_feature (552)..(552): n is a, c, t, g, unknown, or other
  misc_feature (569)..(569): n is a, c, t, g, unknown, or other
cgctcttaactagtggatcccccgggctgcaggaattcgcacgagaccattacctagaacatcctaatcgaaaaaatctctctcttctcctcgcctcgccttggtgttcacgccgtcgctagcgcctgccgcggcgaagcttctgccctccccggcgccaggctcgggtcgtcgtcggccaggcagctgctacgcgtgaacacggtcacaccagtacggcagtaccacgcgacgtgaacggtgaactcgtgaagaacagagccgccactgaggaaaccctagcgacggcggcgtgctaccggtgacattgtccccctcggnccctccatcctgacgcagcgncgccagcctgcaggaagccagcccctattcgagacnaggtcgatcttttgctgctttgcgagcttcagccgaaatcaggtcgagcatggcgncaggccagtaaatagagcaacacaaaacccttcaaattatgggaaacctctgaaggaaccccgaccccggcggcaaaccagggggccaattccccatggccatcgccctcgnngtngnttgaggtggggaggccnggggggaccgaaaaattgcgaatcagggggccattttgaagccccccaagaaaaagggtttggcccccttttgttaaggccgggccccacccccccgg

SEQ ID NO: 23593 - DNA, 706 bp, Zea mays
  misc_feature: Ceres CLONE 1393947-F
  misc_feature: Encodes the peptide sequence at SEQ ID NO. 23594
  misc_feature (540)..(540): n is a, c, t, g, unknown, or other
  misc_feature (695)..(695): n is a, c, t, g, unknown, or other
aagctggagctccccgcggtggcggccgctctagaactagtggatcccccgggctgcaggaattcgcacgagaccattacctagaacatcctaatcgaaaaattttatccttcctggtgctctgtccacctctctcgctctgggccgccgccgccgccctaagccacgtgctgaggctttcgttggtctcttcgccggcgacgagcacccagcagttctgtagaaatggctgatggtgaggacatccagcctcttgtctgcgacaatggcactggaatggtcaaggctggttttgctggcgatgatgcaccaagggcggttttccctagcattgttggccgtcctcgccacactggtgtcatggtagggatgggacagaaggacgcatatgttggcgatgaggcacagtccaagagaggtattcttacgctcaagtacccgatttgagcacgtattgtgagcaactgggatgacatggagaaaatctggcatcatactttctaacacgagcttcgtggtgcccccagagagcaccctgtngtgctcaccgaggctccttttgacccaaggggccacagggagagatgacccaattatgtttgagactttcaatggtccctgcatgtatgttgcaatccaagcgtgctctcactctatgctagggggcgtactactggtattgactcgactctggntgatgtgtgag

SEQ ID NO: 23594 - protein, 73 aa, Zea mays
  misc_feature: Ceres CLONE 1393947-F
  misc_feature: SWISSPROT Homolog: EC 2.7.10.2 Non-specific protein-tyrosine kinase
MADGEDIQPLVCDNGTGMVKAGFAGDDAPRAVFPSIVGRPRHTGVMVGMGQKDAYVGDEAQSKRGILTLKYPI

SEQ ID NO: 23595 - DNA, 712 bp, Zea mays
  misc_feature: Ceres CLONE 1393955-F
  misc_feature: Encodes the peptide sequence at SEQ ID NO. 23596
  misc_feature (253)..(253): n is a, c, t, g, unknown, or other
  misc_feature (255)..(255): n is a, c, t, g, unknown, or other
  misc_feature (256)..(256): n is a, c, t, g, unknown, or other
  misc_feature (262)..(262): n is a, c, t, g, unknown, or other
  misc_feature (264)..(264): n is a, c, t, g, unknown, or other
aaagctggagctccccgcggtggcggccgctctagaactagtggatcccccgggctgcaggaattcgcacgagaccattacctagaacatcctaatcgaaaacctcactctgtctcttcctcagtcccggcatcagcgctcaaaccctaacacgccacgcgatcccgatgcgcaggggtctgggcagcgaggcatcgttgcgccggcggcgcgggccggcgcggctttgggtggcagtggcgccgctgtgggncnncaccgngngcctcttctcctcctcctcggccggcctggtgggcgcctccttacggggccccggatgttggttgtatttttggtgggggggcacttgctatttctaatgggggtgggaaaccatcttcgggagacggcgccacttacgggccccccccccccaaatggaaatctgtaaagaaaggggtttacttggggggtccggggggaaagggtgagcctctgacccacccccgggctgggggaaaagggtacagcccctcgttgccctgcaccggaaaacggaagtggcacccctggggcctcctccgaaagtatggcactcttttcattttcgggatggtgggaaaggggggcttccgggggcggttccgggcgcgggccgcccgtggtccgatacatctggagaatatgcgccccccacttcctatgctgcgtgcctcccgagcgcgggggc

SEQ ID NO: 23596 - protein, 64 aa, Zea mays
  misc_feature: Ceres CLONE 1393955-F
  misc_feature (29)..(29): Xaa is any aa, unknown, or other
  misc_feature (30)..(30): Xaa is any aa, unknown, or other
  misc_feature (32)..(32): Xaa is any aa, unknown, or other
  misc_feature (33)..(33): Xaa is any aa, unknown, or other
MRRGLGSEASLRRRRGPARLWVAVAPLWXXTXXLFSSSSAGLVGASLRGPGCWLYFWWGGTCYF

SEQ ID NO: 23597 - DNA, 642 bp, Zea mays
  misc_feature: Ceres CLONE 1393958-F
  misc_feature: Translation starting site: 151
  misc_feature: SWISSPROT Homolog: EC 3.4.23.40 Phytepsin
  misc_feature (213)..(213): n is a, c, t, g, unknown, or other
tggagctccccgcggtggcggccgctctagaactagtggatcccccgggctgcaggaattcgcacgagaccattacctagaacatcctaatcgaaaaaccagctttccccttctctacggtccgggaatcggaagctcacggcagaagccatggggcagacgcatcttttgttgctcgcttggttctgggtcctgtcacatgctccttgctanctgatgcttcctccgatggactggtaagaatcaacctggacaagaagagactggacaaggaagctttgactgctgcgaaattggcgaagaaggagagcaaccttcgaaggtctgtgggtgctgcccagtatctcagtgcctcaactgatgacatagtccctttggacaactacctggacacccagtactttggacagatcagcatcggcacgccacacagaacttcacagtgatattcgacactggagctcccaacttgtggggtcccctcatcccagtgctactttttcgatagcatgctacttacaccacagatacaagtcaccccagggcgaagactaacaccaaggaaggggggatcttgacgaataaaaattttgggttcggggaaaaaaccttggttttctaggggggggaaaaagggggtgt

SEQ ID NO: 23598 - DNA, 657 bp, Zea mays
  misc_feature: Ceres CLONE 1393959-F
  misc_feature: Encodes the peptide sequence at SEQ ID NO. 23599
  misc_feature (323)..(323): n is a, c, t, g, unknown, or other
  misc_feature (513)..(513): n is a, c, t, g, unknown, or other
  misc_feature (516)..(516): n is a, c, t, g, unknown, or other
  misc_feature (518)..(518): n is a, c, t, g, unknown, or other
  misc_feature (519)..(519): n is a, c, t, g, unknown, or other
tccccgcggtggcggccgctctagaactagtggatcccccgggctgcaggaattcgcacgagaccattacctagaacatcctaatcgaaaaaaaaataggaaacgagcaaaggtctggcgagctacctaccaataaactaccatctccacaaacaggctagcacgtagctatatgccagaactgacctagtagaggatcgatcgcagatggtgtttcctgccatcctccccaaggtggccgcacgatggctcttcacgttctaccgcgccgccagaaagctcaggcgccacgccttccagctctactaccgcaacaccgccgnccaagccgtcgtccgccgtctcgcagcagcagggcgggggccgccgccactgtcactggccgccgccgccttcaagacgggcgccgcatcccctgacgccgggggccggaccgttgtgtgggacatgacggcggcctggtgggctccaccggggtcttcccctaattcatgctccggggcctgcgaaggnggnanncttcgcccggccatggtggtggtctgggccttccccctcgggtgggcgctcggggacccccgccgccccgcgtccggggaatggggcggcaccttcgggggtcaaggggcgggagtgggctgggggccgggggggtag

SEQ ID NO: 23599 - protein, 149 aa, Zea mays
  misc_feature: Ceres CLONE 1393959-F
  misc_feature (39)..(39): Xaa is any aa, unknown, or other
  misc_feature (104)..(104): Xaa is any aa, unknown, or other
MVFPAILPKVAARWLFTFYRAARKLRRHAFQLYYRNTAXQAVVRRLAAAGRGPPPLSLAAAAFKTGAASPDAGGRTVVWDMTAAWWAPPGSSPNSCSGACEGGXLRPAMVVVWAFPLGWALGDPRRPASGEWGGTFGGQGAGVGWGPGG

SEQ ID NO: 23600 - DNA, 800 bp, Zea mays
  misc_feature: Ceres CLONE 1393960-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (19)..(19): n is a, c, t, g, unknown, or other
nnnaatccccccccccccnccccccaacaaggccacaccccccccaacccccgtaaaaaatgcaactccacgcggtggcggccgttctaaaatagtggatcccccgggttggaggaattcgcacgagaaccattacctagaacatcctaatcgaaaaagccgccacctcaccccccccatcggccgcctgcgtcccaccacccgctcctgctgccgggcctgccgcccgtttgctctcgccactgaaacactcgccgccgaatacgcctccagccgattgctagccctcctgcccggctgcctccccaggataaaaagcgggagcatcctggaaaagaaaaggttgttcggacttgagccttcccacgagtttcctccaaaaaaaaaatccagaaaataaccacaaatggggacccttggaaggcccaaaacaagccccgccccagagtcacttcgtttacacctcaggaggaacaaggccccatgacacccctacagcttccatcacaggccacaaaacagcgagcgccatggtatgttagggaatagagaaagaacgagagagctgaaagggtccccggtggaggcgggtggcgtctcccacctaaacccaccaatagcccatcaatttaagatgcgcgctttgtcgccgtgcgcttcccccggcggatatggggttacagcgcgtggccgaaaacctccccataccccaacaagatcggttcccaagcatacgaccaacccgcggtacaccccccctcttcccccacgatgtcacaccgacgcccgagataacctcc

SEQ ID NO: 23601 - DNA, 684 bp, Zea mays
  misc_feature: Ceres CLONE 1393961-F
  misc_feature (620)..(620): n is a, c, t, g, unknown, or other
  misc_feature (625)..(625): n is a, c, t, g, unknown, or other
  misc_feature (632)..(632): n is a, c, t, g, unknown, or other
tccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatggtggtggcgtcggtgctccaagaccggcggtgtcgacggcctcccgccggggcctccggggtggccgggggtggggaaccctgttccaggtgatcctggagcgacgggtccttcatgaacgtggtgcgcgaacctccgggaggaagaacggcccatcttccccaatggggatgggaaagagcaccctcatcgggggccaccttcgcgggagctcattccgcgagccgctgggtgaaggagggcccccatgttcgcagagccgggccgaaggacggtcccaccccccctcctctttaggcggcgggaaggggaacggtcagctcgggggcccaagggccccctggggngggantttgggngcaagactccgtaaccgagaagaccaccgcccccccccgcgcaaggggcttt

SEQ ID NO: 23602 - DNA, 664 bp, Zea mays
  misc_feature: Ceres CLONE 1393962-F
  misc_feature (209)..(209): n is a, c, t, g, unknown, or other
gctctagaactagtggatcccccgggctgcaggaattcgcacgagaccattacctagaacatcctaatcgaaaaagttccccaaattcccaacgccgccgcgacggcgctgctagctagtctttggtgttgtaggtgttcgattcctgattccaaattccagactccaaactcggttcttcaatcgacagattccgatttacatcccanagctcttcggattgaaatccagccgcgacccaagagataagagtatttgggattagtagataggatagtagaatagaagaggaacactttcgctgattgattacggcggagagaaaaacccccgaaaagggaggatggaggaagaagccaaaccgccgcccgaaggtttttcctgaagaccatctgcccggtccccggagaggggacgctggacccccaccattcccccctttgggggaatccggcccgacaggcctgtgtgtagaggagacgggccggctcgcctcccaccccgacgtcacaatagcgctctacagttcgccgcctttctctctctcccccctgccccagcccgcccgcccctgtagaggaaggagggtatgggtggggagatgatcggctgtctcggtcccccgcacctcgggatggtacccgcaccacccgccgacttgccc

SEQ ID NO: 23603 - DNA, 683 bp, Zea mays
  misc_feature: Ceres CLONE 1393964-F
  misc_feature: Encodes the peptide sequence at SEQ ID NO. 23604
  misc_feature (265)..(265): n is a, c, t, g, unknown, or other
  misc_feature (289)..(289): n is a, c, t, g, unknown, or other
  misc_feature (292)..(292): n is a, c, t, g, unknown, or other
  misc_feature (302)..(302): n is a, c, t, g, unknown, or other
  misc_feature (318)..(318): n is a, c, t, g, unknown, or other
  misc_feature (419)..(419): n is a, c, t, g, unknown, or other
  misc_feature (474)..(474): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (490)..(490): n is a, c, t, g, unknown, or other
  misc_feature (509)..(509): n is a, c, t, g, unknown, or other
tccccgcggtggcggccgctctataactagtggatcccccgggctgcaggaattcgcacgagaccattacctagaacatcctaatcaaaaaatatcccatccatcacagctagctagcgtacagacgaataatctcttcttcacctcactagctaacaccagctagcagctcgatcgctctgtcctgcaataatggccgctcgctcctcctcccagcagctggtcgcggcggcggtcctggcagcggcgctgctgctgctggcgncgggggccggaaccggcgtcgcgncgntgagctgcgncgaggtgacgtcgtcngtggcgccgtgcctcgggtacgcgatgggcagcgcggcgtcgccctccgcggcgtgctgcagcggggtgcgctcgctcaacagccgcgcgtcgtcggcggnggaccggcaggccacctgcactggctcaggagcatgacgggccggctcggcgggngnnntnnnatggccancgccccccatttccccggnaggggcgggcgctccgtcggggtgcccaacaccgccacccccgaacggaccaaaaaaaaggggagtaaggaaaccaaagtgggagggaaacccgcaacagtgttggtaatctgcaacgacgccatccggcgggtagtgcacctatatcctacccggaccactccccacacccac

SEQ ID NO: 23604 - protein, 87 aa, Zea mays
  misc_feature: Ceres CLONE 1393964-F
  misc_feature (25)..(25): Xaa is any aa, unknown, or other
  misc_feature (33)..(33): Xaa is any aa, unknown, or other
  misc_feature (34)..(34): Xaa is any aa, unknown, or other
  misc_feature (37)..(37): Xaa is any aa, unknown, or other
  misc_feature (76)..(76): Xaa is any aa, unknown, or other
MAARSSSQQLVAAAVLAAALLLLAXGAGTGVAXXSCXEVTSSVAPCLGYAMGSAASPSAACCSGVRSLNSRASSAXDRQATCTGSGA

SEQ ID NO: 23605 - DNA, 657 bp, Zea mays
  misc_feature: Ceres CLONE 1393972-F
  misc_feature: Encodes the peptide sequence at SEQ ID NO. 23606
aagctggagctccccgcggtggcggccgctctagaactagtggatcccccgggctgcaggaattcgcacgagaccattacctagaacatcctaatcaaaaaaatctctcgcacgcaaacgactagcgcaggcgcagcaaacaccccacctcgctcgcggtcgcggcacggcggcggcgatccaccgcggctcgctgccttcgccagtgatctggtctcttcgagtcccggcatcagataatcatccacagcccctcccctcctctcccagccccctcccttccccttccgctgaatcggcgcggagaggatgccgtcccggcggggcagcagcagttgcgtgctctgcgagggatccaacctgccgtcttgttgcgcctcgtgcgtcaacgcgaggctggtcgagtacacacgaggctgcgcatgatgaggagcctccgcgactccctccacggccgaaatcgcgcacgcctcgaaagccagagaaaaaacatgagcaggcggatctggagaacaagcaaagaacaggtatccctggaggtgaggaaacggctccccggattggaaaaaaaaaatggccgaaaaaaagaacgagggccgggagggctttgagggggttctcaggggaaaaaatggggcccttggaaattgggccccg

SEQ ID NO: 23606 - protein, 38 aa, Zea mays
  misc_feature: Ceres CLONE 1393972-F
MPSRRGSSSCVLCEGSNLPSCCASCVNARLVEYTRGCA

SEQ ID NO: 23607 - DNA, 864 bp, Zea mays
  misc_feature: Ceres CLONE 1393975-F
  misc_feature: Encodes the peptide sequence at SEQ ID NO. 23608
ttccccccccccccccccccccacccttgttgtataagcactgcccccccacgctggcgctccccgcggtggcggccgctctagaactagtggatcccccgggctgcaggaattcgcacgagaccattacctagaacatcctaatcgaaaaaaccccaccagaccttcaaccgctacatttccgtcactaccggagccgccactccgacgaacgcgggcggcggagcggaagcgaaccagagcaccggtaaaaagaaaaggatgaggcttgggagtataaacggcttgcggttcacgcagcttaaacttgtcatccttgcgttcttcatgttgtttgttctctggaaatgggagaagggctcgtcatactacgattccgaaatcctccagcaagattcggttggttctgactcatccagctaaactcggaagtttggaacaccaagcacacatcccccggaacaagacttttccaggggcagatcggaatcacagcggggcagggagggtaaacgtaacaaaagggcgcgtcaacataagtggcggatcgaaaaccaatggggcataacggaaagggcgcaaaataccagcggcgacggccgcgcacgacggcgcacagtgtaccgttacttcctcccgtgcggataaagggaaacggtacggcggactgcaccatgaacaaagagacggaccgccgaaacaataactcagcattacttgtggagatacctattaatcggagatgagaacaatgagagcgactcggtaaccaccacggacaccagccgtccaacagacgcgggcggtccacggcacaggaggagaccatccgccgatataaagtcctcacgctccgcccaccct

SEQ ID NO: 23608 - protein, 53 aa, Zea mays
  misc_feature: Ceres CLONE 1393975-F
MRLGSINGLRFTQLKLVILAFFMLFVLWKWEKGSSYYDSEILQQDSVGSDSSS

SEQ ID NO: 23609 - DNA, 691 bp, Zea mays
  misc_feature: Ceres CLONE 1393979-F
gctctataactagtggatcccccgggctgcaggaattcgcacgagaccattacctagaacatcctaatcaaaaattcctcttgctcttcctcttccattcattagctgcactcgcctccctcgcgccaccgccttctcagccaccaccgccgcgggtgcctcagaaagtgcaggtgtggcccaagccggtgtccatctcgtggccgttgccggcatacgcgccgatctccccgtcgttcaacatccgcgcctcgccgtcgcacccgtcgctccgtcacgccctcgcgtactacacccgcctcatccgcacggaggggtacacgccgattatccccccccgtcaactacaccgggtctcgggggtcccccatccgccttgttcgggctctccgtctccgatccccgacgtcccgctccggcccccgggggtcaaagaagtctacacggctctccggtgccaccaaattccagcttcggttgaattttctgcccgccactccccgggggaatccattccgcgggcttcgaaaaccttctccccaggtcggcttggaagcaggggccgcccgcccgacgggaggcgcgccagcccgatcggcccccgaggggaaataataaatcctccgaacacccccttggtcaaaccccaaccggggggaactcctccttccaacccggcacggaaattacg

SEQ ID NO: 23610 - DNA, 728 bp, Zea mays
  misc_feature: Ceres CLONE 1393985-F
  misc_feature (235)..(235): n is a, c, t, g, unknown, or other
  misc_feature (236)..(236): n is a, c, t, g, unknown, or other
  misc_feature (302)..(302): n is a, c, t, g, unknown, or other
  misc_feature (327)..(327): n is a, c, t, g, unknown, or other
  misc_feature (328)..(328): n is a, c, t, g, unknown, or other
  misc_feature (376)..(376): n is a, c, t, g, unknown, or other
  misc_feature (392)..(392): n is a, c, t, g, unknown, or other
aagctggagctccccgcggtggcggccgctctagaactagtggatcccccgggctgcaggaattcgcacgagaccattacctagaacatcctaatcaaaaaaaacaacacacgaacaccgcaccgcaacgtagccggctaggggaagagctctttccttcagctgtgccgtgcacaacgcacggcacgctggtttggtttgcatcgcccccgccaagaagacgctgccgtgagcnnggctgagcggcgaaaagcagcagcaggcgggcgacatgccgagcggcagcgcgttctccgggtcgntgaaccctcagcacgtcaagctggnngtacagtacctgggtgaaccacttcctgacgctgctgctgggtgccgntgatgggccgccacgncgcttgaaagttgccccggctccggccccgggggagttgttctccgttggggggctccctgggacttgaacctggccccattccctcgggtcggggggttctggggctttttcccccggaaccggggtaagtggagggccccccccccggccgcggggacccgggggggaaaaccctgggtaaaaacccccccgccagggggggcgggggcgcctttcccccccttttggggggagacccgcctctttaaaaaaaaaaaaacaaaaagagggggtgtcttcaaacaaaaaaattctgggggggcctcgggttcccaaagaaaaaaacccccccccc

SEQ ID NO: 23611 - DNA, 690 bp, Zea mays
  misc_feature: Ceres CLONE 1393986-F
  misc_feature (210)..(210): n is a, c, t, g, unknown, or other
  misc_feature (253)..(253): n is a, c, t, g, unknown, or other
  misc_feature (286)..(286): n is a, c, t, g, unknown, or other
  misc_feature (300)..(300): n is a, c, t, g, unknown, or other
tccccgcggtggcggccgctctagaactagtggatcccccgggctgcaggaattcgcacgagaccattacctagaacatcctaatcgaaaagatacaccacccctcgtctccccacggaggccgtcctctcctctcctctgcgtccgccactgcccaccgctcgcccgcgcgcgctccattacctcggcgggcgatgggcgacctatccnacaccggctccacctaacacgagcagcgcccccgccctagcgncagctgcctggtcggtcgtcgagcagctagcgncggcagcgcccggnaggaagccgtctcactctcctcgtcggggcggcaggagatggaggccatcgtggccgtccccgcccccccccgtggcccgttcctggcccgcctccaaaacccgccggcggcccttttgccccccaaaatcccaacggggaagctcccggtgcccggggaaaagggccccgaaagttgtgtgttctttgaccccaaaaaaggggggcccccccgattcctccctcccttggggccgcgacagggggagggggaaaaaagaaagcccccccccccggggggggagaacaccctctcataaaggccgggataacgggcctcccccccaccccccctagggggacggccgcgcccccccccctcgggggggcaagaatctaccactcgcctcg

SEQ ID NO: 23612 - DNA, 894 bp, Zea mays
  misc_feature: Ceres CLONE 1393987-F
  misc_feature: Encodes the peptide sequence at SEQ ID NO. 23613
  misc_feature (14)..(14): n is a, c, t, g, unknown, or other
  misc_feature (15)..(15): n is a, c, t, g, unknown, or other
  misc_feature (18)..(18): n is a, c, t, g, unknown, or other
  misc_feature (19)..(19): n is a, c, t, g, unknown, or other
  misc_feature (22)..(22): n is a, c, t, g, unknown, or other
  misc_feature (29)..(29): n is a, c, t, g, unknown, or other
  misc_feature (40)..(40): n is a, c, t, g, unknown, or other
tttttttttctttnnttnnttnccttttntctgcgcttanaaattttatattaaaagctggagctccccgcggtggcggccgctctagaactagtggatcccccgggctgcaggaattcgcacgagaccattacctagaacatcctaatcgaaaaaatgtaaactgtgatcttccaggctgcaccaactccatctccaggtggaatggagttagcttgcctgcacactcagtcacggtggcgtccctataaggcgtaggcctgacgtcacccacgccctcgcctcgcacggggcggcgcggcggccggcggagggaatggcgaggcgaagcagaggcagcggcagcgtcacggacgcggcgtcgaaggcggacgcggcggcgatgcggatgttgtcccgcaaggggcgccgtgcggatgggcgcatcggggcggccaaccgacctgggcccaggcttcggggttcgacgaagcctcgcctttccaaccttcgggacaatgaaagctcccccggggatggcaattccttcctcaagaatgttttgggagaaaaaaatgaaggcgcaccaggcccgcgcctgccggggagtagggataatcgataagggggaactttcccccatctctgtgatccctgcttctcgcccgcgcctgcccaccgtatcacactgggctccgacgacgagggattttcaaacacacgggccgcgcaggccatgtgacccacgagtgggaggggaaggacgagagcaggcccaatttgagcgcggcgttatctccccacaccccaggagtgggtggcgcgccaccggcctgccgagaaatcgaccgcgcgccccaccgcgaccgcccctcgccggcgcccggccgcacaacagagccgcgccctaggccg

SEQ ID NO: 23613 - protein, 95 aa, Zea mays
  misc_feature: Ceres CLONE 1393987-F
MARRSRGSGSVTDAASKADAAAMRMLSRKGRRADGRIGAANRPGPRLRGSTKPRLSNLRDNESSPGDGNSFLKNVLGEKNEGAPGPRLPGSRDNR

SEQ ID NO: 23614 - DNA, 657 bp, Zea mays
  misc_feature: Ceres CLONE 1393991-F
  misc_feature (252)..(252): n is a, c, t, g, unknown, or other
  misc_feature (258)..(258): n is a, c, t, g, unknown, or other
  misc_feature (300)..(300): n is a, c, t, g, unknown, or other
  misc_feature (438)..(438): n is a, c, t, g, unknown, or other
  misc_feature (439)..(439): n is a, c, t, g, unknown, or other
  misc_feature (493)..(493): n is a, c, t, g, unknown, or other
tggagctccccgcggtggcggccgctctagaatagtggatcccccgggctgcaggaattcgcacgagaccattacctagaacatcctaatcgaaaattcacttgctaaaccctctccagcccgcgttcctcgctttccctcccaaaaccctagcgctgcttccaccagccacccagatcccatggcgcgctcgacctcactctccgaggcggagggcggcatctcctgctttgcctccctccctccttgatnccgcgncgtcctcaagcaccgctatgccgacttcatcgtccatgaggntgcccgcgatggcgctctcgtccagctcacctcgttcgacctccccaccgagagcgtttgtttgcacgaagaggacaggcgccccgtcggctgaagcggatcactcgaggccctcgagtcgttccgttcgctctgcgnngatgccgattgaacgcaattgagggctcctggaaaaagtggcggcgaagggggncgtttaattccccccctgcattctatggctggagccaaaaaagcaaacgggtgggaggggcaaaattctttaaaaaaccttcaagtccggggcacgaacacggggaacccaaggtggggcccaaagcgccctcgcgttggctctgcccaaacccgccccccgac

SEQ ID NO: 23615 - DNA, 651 bp, Zea mays
  misc_feature: Ceres CLONE 1393992-F
  misc_feature: Encodes the peptide sequence at SEQ ID NO. 23616
  misc_feature (581)..(581): n is a, c, t, g, unknown, or other
  misc_feature (651)..(651): n is a, c, t, g, unknown, or other
tccccgcggtggcggccgctctagaactagtggatcccccgggctgcaggaattcgcacgagaccattacctagaacatcctaatcgaaaaatatctttttctccccaagaaaaaaaaggcggcgagagcataagaagaaaaaaaacacacacacacacacacaaagcgcacttttcaaatcgacaaaggggaaaggttcgcttcttgtggcatcttgctttccttcgagtgccatggccgatccggcggaggagaacgttgtctcgccgccaccgacccctgcggccccagccgtgggcgcctcagacccgcccctgcagcctgctgctgacagcgcctcaacggagaaggtgtctgctccggcgccggaggtaaggtcccggggattcaggcttcttggagaggacacttccgtgacaaatcccttgggggcggaaaaactgctgacgttctgttatggaaagacagaaaacttctgctggtgtaaatagcgcgcatggccatcttgggttcttggtcgaaagggttgaataccacctcctgaccctgaatccatgcacttgattggggtgcttgccgnctaattcctgggggcccaaagaacccacttcatcaagaagagtccacggatatcccactagggcaggtan

SEQ ID NO: 23616 - protein, 85 aa, Zea mays
  misc_feature: Ceres CLONE 1393992-F
MADPAEENVVSPPPTPAAPAVGASDPPLQPAADSASTEKVSAPAPEVRSRGFRLLGEDTSVTNPLGAEKLLTFCYGKTENFCWCK

SEQ ID NO: 23617 - DNA, 682 bp, Zea mays
  misc_feature: Ceres CLONE 1393995-F
  misc_feature: Encodes the peptide sequence at SEQ ID NO. 23618
  misc_feature (342)..(342): n is a, c, t, g, unknown, or other
tacccgcggtggcggccgctctataactagtggatcccccgggctgcaggaattcgcacgagaccattacctagaacatcctaatcgaaaagattttggctcctcactgccgcgccgccaccccctacaggtaaggaagaggagggcaggatgtcgcaccgtaagttcgagcacccgaggcacggctccctcggcttccttcccaggaagcgctcctcccgtcaccgcggcaaggtgaagtcattccctagggatgaccccaagaagcctttgcatctcactgccttcctttggctacgaggcctgccatgactcacattggtccggtgagggttgaaaaancccaggattcaaaaactcccataaaaaaaggaaaaatttgggggggggttggtaacccataattggaaacccccccccccttggcatgggggggctccggggaaatgggaaaaaccccccgggggcccccaaaaaaccaaattttggtgggggccccccttttttttgaaaaaaggggggaaaaatttttcacaaaaaagggggggaaaaaaaaaaaaaaaaattttttcaaaaagatgggcccccaaaaaaaaaaaaaagggggggggaaaaaaaaaaaaaaaccccggcggggtggaaaaaaaaaaaaaaaaaaaattctttgttttaccggcgggtt

SEQ ID NO: 23618 - protein, 53 aa, Zea mays
  misc_feature: Ceres CLONE 1393995-F
MSHRKFEHPRHGSLGFLPRKRSSRHRGKVKSFPRDDPKKPLHLTAFLWLRGLP

SEQ ID NO: 23619 - DNA, 685 bp, Zea mays
  misc_feature: Ceres CLONE 1393998-F
  misc_feature: Encodes the peptide sequence at SEQ ID NO. 23620
  misc_feature (339)..(339): n is a, c, t, g, unknown, or other
aaagctggagctccccgcggtggcggccgctctagaactagtggatcccccgggctgcaggaattcgcacgagaccattacctagaacatcctaataaaacccacccatcacacgacaaaatccctcaccctcgtgagtcctgacgtcctcgcccgtgctcgcagttggtagggttctagccatggcgtggagcgccgccgccgtctccaggttcgcagccgcctccccacccgcggcacccatctccgtcaggcttggagccgccgcttctcgctcgtccctgtccttctccagtgggcgccgacgccccgtgggcgcgtccctctcgacctctgccnacgctgtaaaggaggctgttcagacagagaaggcaccaccagcactaggcccttatttctcaggcatcaaagcaaataatcttgtgtttgtttctgggagtcttggcttggatccccgagacagaaagttatctctgaaaatggtgaggagcaaactggagcagttatgaaaaactggccggaaattgaaaggtagggggcgtactattctcagttggaaaacaagatctggtggttgattgggggtttcctaagggaacgggtttttggaatatttccggggcaaacctggaaaaaaactacaaggggggcttcccctaaagcccgattgaaatggagccccctt

SEQ ID NO: 23620 - protein, 108 aa, Zea mays
  misc_feature: Ceres CLONE 1393998-F
  misc_feature (53)..(53): Xaa is any aa, unknown, or other
MAWSAAAVSRFAAASPPAAPISVRLGAAASRSSLSFSSGRRRPVGASLSTSAXAVKEAVQTEKAPPALGPYFSGIKANNLVFVSGSLGLDPRDRKLSLKMVRSKLEQL

SEQ ID NO: 23621 - DNA, 718 bp, Zea mays
  misc_feature: Ceres CLONE 1394002-F
  misc_feature: Encodes the peptide sequence at SEQ ID NO. 23622
  misc_feature (502)..(502): n is a, c, t, g, unknown, or other
  misc_feature (525)..(525): n is a, c, t, g, unknown, or other
  misc_feature (568)..(568): n is a, c, t, g, unknown, or other
  misc_feature (588)..(588): n is a, c, t, g, unknown, or other
  misc_feature (605)..(605): n is a, c, t, g, unknown, or other
aagctggagctccccgcggtggcggccgctctacaatagtggatcccccgggctgcaggaattcgcacgagaccattacctagaacatcctaatcgaaaaatcaccaccactgggtcttcagaccattagctttatctactccagagcgcagaagaacctgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtngcagctgcagggaacctgcggcngtggcagcaccccgatcctgggccagtgcgtcgagtttctgangcatcagtgcagcccgacgncgacgccctactgctcngctcagtgccagtcgttgcggcagcagtgtttgcagcagctcaggcaggtggagcccagcaccggtacaggcgatcttcgtgttggtcctcagtccatcctgagcagcagccg

SEQ ID NO: 23622 - protein, 83 aa, Zea mays
  misc_feature: Ceres CLONE 1394002-F
  misc_feature (19)..(19): Xaa is any aa, unknown, or other
  misc_feature (33)..(33): Xaa is any aa, unknown, or other
  misc_feature (40)..(40): Xaa is any aa, unknown, or other
  misc_feature (46)..(46): Xaa is any aa, unknown, or other
MPVPTAASKPVAAAGNLRXWQHPDPGPVRRVSXASVQPDXDALLLXSVPVVAAAVFAAAQAGGAQHRYRRSSCWSSVHPEQQP

SEQ ID NO: 23623 - DNA, 711 bp, Zea mays
  misc_feature: Ceres CLONE 1394003-F
  misc_feature: Encodes the peptide sequence at SEQ ID NO. 23624
  misc_feature (467)..(467): n is a, c, t, g, unknown, or other
  misc_feature (468)..(468): n is a, c, t, g, unknown, or other
  misc_feature (614)..(614): n is a, c, t, g, unknown, or other
aaactggagctccccgcggtggcggccgctctagaatagtggatcccccgggctgcaggaattcgcacgagaccattacctagaacatcctaatcgaaaaaattgaaaacagggccttggtcgagttaaaaaaaacgcgagtgaaacacactgacaccgcatacacgccaaccggtctaccgccttcttctcttgtctcgtcctcctcgcgactatggccgccgccgccgaggtagaccccagccccaacccgccgccaactacagcctccggcctctccaagaccaagacgcgggaggccgaccgccgccgaacgccgcggaggatgtccaagaagaacaagtccgtcactgaggctgatgccccagacgctgacggtggagcttccagctccgacggcgaggataacgccgatcccaaccacgaagcacaggggtgagtggagatagagtacgtgccgaagaagnncgagcttgacaaacctctcctgtatgatttcgagggcatcttcgagaaggtcacctttcaagacgctgctgcagcggcggccgaagatgataataaagacgagggtgctgttgatgccacaagaagggtcactggttgatgtgacnaccaccatatgatgggcagggggcaacaagaccagggcggaggcctttccataaaaagagaaactgaaaccccgataaaatgcagacccaaacagat

SEQ ID NO: 23624 - protein, 74 aa, Zea mays
  misc_feature: Ceres CLONE 1394003-F
MAAAAEVDPSPNPPPTTASGLSKTKTREADRRRTPRRMSKKNKSVTEADAPDADGGASSSDGEDNADPNHEAQG

SEQ ID NO: 23625 - DNA, 738 bp, Zea mays
  misc_feature: Ceres CLONE 1394005-F
  misc_feature: Translation starting site: 175
  misc_feature: SWISSPROT Homolog: EC 1.3.1.2 Dihydropyrimidine dehydrogenase (NADP(+))
  misc_feature (395)..(395): n is a, c, t, g, unknown, or other
  misc_feature (443)..(443): n is a, c, t, g, unknown, or other
  misc_feature (444)..(444): n is a, c, t, g, unknown, or other
  misc_feature (724)..(724): n is a, c, t, g, unknown, or other
aagctggagctccccgcggtggcggccgctctagaatagtggatcccccgggctgcaggaattcgcacgagaccattacctagaacatcctaatcaaaaatactccctcagattcttaccaaaacacaggagcccgtcggccgtcgcaaaaaaacaaaacaagaccaccgcaccatggaatcgctgacgcttcgcgcttcgacggccgcctcgccgctgcagcgacgccggctgctccccgggcggcagcgcgcgacgtacgtccgcgccacggcctccgccggcgagccggacctctccgtgcgcgtgaacgggctgcagatgcccaacccgttcgtgatcggggtcgggccaccgggcaccaactacaccgtcatgaagcgcgccttcgacgnaggctggggcgccgtcatcgcccagactgtgtcattggatgctgaaannagtatcacgttactcctccgtatgcaaagcttcgggcagaaccaaatggggctgccatggggcgcatcattggctgccagaacattgaactcatcagtgacaggcctctggaggacatgctgaatgagttcaagcagttgaagaagagtatcctgacaggatacttatcgggtcaattatggaggaagtacacaaagctgcatggcatgagcttatttgacgtgttgaaagtctggagtggatgctcttgaaataatttctcatggcaactggcatgccnaaaaaaaaaggggg

SEQ ID NO: 23626 - DNA, 730 bp, Zea mays
  misc_feature: Ceres CLONE 1394007-F
  misc_feature: Encodes the peptide sequence at SEQ ID NO. 23627
  misc_feature (255)..(255): n is a, c, t, g, unknown, or other
  misc_feature (266)..(266): n is a, c, t, g, unknown, or other
  misc_feature (269)..(269): n is a, c, t, g, unknown, or other
  misc_feature (272)..(272): n is a, c, t, g, unknown, or other
  misc_feature (375)..(375): n is a, c, t, g, unknown, or other
  misc_feature (400)..(400): n is a, c, t, g, unknown, or other
  misc_feature (407)..(407): n is a, c, t, g, unknown, or other
  misc_feature (434)..(434): n is a, c, t, g, unknown, or other
  misc_feature (468)..(468): n is a, c, t, g, unknown, or other
  misc_feature (469)..(469): n is a, c, t, g, unknown, or other
  misc_feature (478)..(478): n is a, c, t, g, unknown, or other
aagctggagctccccgcggtggcggccgctctagaactagtggatcccccgggctgcaggaattcgcacgagaccattacctagaacatcctaatcgaaaaatagcgaacaaacatcgagtacagtcggctaggtaatctggtggtacgacgacttggcggccaccagcagcaagtcgtcgtcgtcctcgagctcggcgcagcgggcagctgccgcactgctcgtggccgccgccgtggcggtgtccgtcctggntggtggcgcgncgncgntgtgcgacatgagcaacgagcagttcatgtcgtgccagccccgcggcggcaagacgacggacccgccggccgcgccgtcgcaggcgtgctgcgacgcgctggncggggcggacctcaagtggctgtgncgctacnagaaactcgcgtggatgggcgtctacnacatcgacccccagcgcggcatggagcttccggnncagtgcgtnctcgccacgccgcccgactgctagcagtgtgctagccagccaagcccaagcagaaggcccccggcattgctagctgtacgtgtctgtgtgtgcatctgcagcagggtgcagcaggggcccgtaccgacggggctctttcctctctcatctggcacgacctatctagaaggggggggggtcgactaataaaatggtcttgccccccgcgcctgggatgatggaacatggccccggatggcatttagggggggg

SEQ ID NO: 23627 - protein, 73 aa, Zea mays
  misc_feature: Ceres CLONE 1394007-F
  misc_feature (32)..(32): Xaa is any aa, unknown, or other
  misc_feature (40)..(40): Xaa is any aa, unknown, or other
  misc_feature (43)..(43): Xaa is any aa, unknown, or other
  misc_feature (52)..(52): Xaa is any aa, unknown, or other
  misc_feature (63)..(63): Xaa is any aa, unknown, or other
MSNEQFMSCQPRGGKTTDPPAAPSQACCDALXGADLKWLXRYXKLAWMGVYXIDPQRGMELPXQCVLATPPDC

SEQ ID NO: 23628 - DNA, 777 bp, Zea mays
  misc_feature: Ceres CLONE 1394008-F
  misc_feature: Encodes the peptide sequence at SEQ ID NO. 23629
  misc_feature (8)..(8): n is a, c, t, g, unknown, or other
  misc_feature (15)..(15): n is a, c, t, g, unknown, or other
  misc_feature (32)..(32): n is a, c, t, g, unknown, or other
  misc_feature (34)..(34): n is a, c, t, g, unknown, or other
  misc_feature (35)..(35): n is a, c, t, g, unknown, or other
gattcccnaaatacnggcgccaccaggaaaancnntcctaccccaacaaactggagctccaccgcggtggcggccgctctattatagtggatcccccgggctgcaggaattcgcacgagaccattacctagaacatcctaatcgaaaaacaaccatattattgagaccaacaagcaacatagaaagtggaatccagtagcaacaacagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcaccgttgttgtttcaacaatcgccagccctatctttggtgcagtcattgctacaaaccatcagggcacagcagctgcagcaactcgtgctacctgtgatcaaccaagtaactctggcaaacctttctccctactctcagcacaaaaattttcttccatccaacccaactgcctaccctgaaaccctgctggtttatttgcagccacaaattattaccatttccgccaggttagctaactgcctactctccagaaacaacaactttcttcccatttaaacaaattgggccgcaattgaaaccccgcttggcttattttgcggcaacgcaaataactaactacccttttaagccc

SEQ ID NO: 23629 - protein, 161 aa, Zea mays
  misc_feature: Ceres CLONE 1394008-F
MATKIFSLLMLLALSACVANATIFPQCSQAPIASLLPPYLPSMIASVCENPALQPYRLQQAIAASNIPLSPLLFQQSPALSLVQSLLQTIRAQQLQQLVLPVINQVTLANLSPYSQHKNFLPSNPTAYPETLLVYLQPQIITISARLANCLLSRNNNFLPI

SEQ ID NO: 23630 - DNA, 713 bp, Zea mays
  misc_feature: Ceres CLONE 1394012-F
  misc_feature (305)..(305): n is a, c, t, g, unknown, or other
  misc_feature (334)..(334): n is a, c, t, g, unknown, or other
  misc_feature (365)..(365): n is a, c, t, g, unknown, or other
aagctggagctccccgcggtggcggccgctctagaatagtggatcccccgggctgcaggaattcgcacgagaccattacctagaacatcctaatcgaaaatttatcacatgatgctcctcagctttattggctgacaattgtttttctggcatttgatgttttctttgtggtcttctgtattgctttggcttgtgtgattggaatcgctgtttgttgctgccttccgtgcattattggtatcttgtatgctgtaactgatcaggaggaggagcatctgaagatgacgtaaacaccttttcaaaancaaatttcgggacatgagtgatgcagacnagctagctgcccgcattgcagcaactgtggnttgaatgatgacaaaatgcgaaccaatccctcctgtcgaacatattcttttcggctgaggaatgaaagtgctgtatctggctatggccgaaccaagatggcgtggaactgcgtgagctcccttgcaacacccatttcactgcagctgaataaacaaggggcttcacctaaatgctacatgcccattggtgcaagttcacatcgtcaagagcaatctccacaaagaaaaggtctaggtcaataaagaaaaaaaataatatcttggcagcacatttcgggatgccccatcccagctgtgctcctaagtattgccactttgccaactggaggtgggataccctgctttgaa

SEQ ID NO: 23631 - DNA, 708 bp, Zea mays
  misc_feature: Ceres CLONE 1394016-F
  misc_feature: Encodes the peptide sequence at SEQ ID NO. 23632
  misc_feature (420)..(420): n is a, c, t, g, unknown, or other
  misc_feature (488)..(488): n is a, c, t, g, unknown, or other
  misc_feature (541)..(541): n is a, c, t, g, unknown, or other
  misc_feature (649)..(649): n is a, c, t, g, unknown, or other
aagctggagctccccgcggtggcggccgctctagaactagtggatcccccgggctgcaggaattcgcacgagaccattacctagaacatcctaatcgaaaaacaccgagaatcacaatacgaaacgaattaatccccaatcaacacagcaagtcagcaacaagcaaagcagcgacccgagagatggacgcgaggatgttcgggctggagaccccccgggtggcggcgctgcatcacctgctggacgtgcccgacggcgacaaggcgggcggcggcgccacgcgcacctacgtccgcgacgcgcgcgccatggcggccaccccggccgacgtcaaggagctcgcgagagcgtacgcgttcgtggtggacatgccggggctgagcacgggcgacatcagggtgcaggtggaggacgagcggntgctggtgatcagcggcgagcggcgccgggaggagcgcgaggacgcccagtacctgcgcatggagcgncggatgggcaagttcatgcgcaaagtcgtgctgccggacaacgccgacgtggnacaggtcgccgccgtgtgcagggacggcgtgctcacggtgaccgtcgagaagctgcccccgccggagccccagagccccagacatcgagattaaggtcgctgagtganaccgttgtccgagcagtgcagtgagctgggtgccacctgccggactctggtgaggagaa

SEQ ID NO: 23632 - protein, 150 aa, Zea mays
  misc_feature: Ceres CLONE 1394016-F
  misc_feature (49)..(149): Pfam Name: HSP20 Pfam Description: Hsp20/alpha crystallin family
  misc_feature (80)..(80): Xaa is any aa, unknown, or other
  misc_feature (120)..(120): Xaa is any aa, unknown, or other
MDARMFGLETPRVAALHHLLDVPDGDKAGGGATRTYVRDARAMAATPADVKELARAYAFVVDMPGLSTGDIRVQVEDERXLVISGERRREEREDAQYLRMERRMGKFMRKVVLPDNADVXQVAAVCRDGVLTVTVEKLPPPEPQSPRHRD

SEQ ID NO: 23633 - DNA, 739 bp, Zea mays
  misc_feature: Ceres CLONE 1394019-F
  misc_feature: Encodes the peptide sequence at SEQ ID NO. 23634
  misc_feature (451)..(451): n is a, c, t, g, unknown, or other
  misc_feature (599)..(599): n is a, c, t, g, unknown, or other
  misc_feature (712)..(712): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
aaactggagctccccgcggtggcggccgctctataactagtggatcccccgggctgcaggaattcgcacgagaccattacctagaacatcctaatcgaaaaagtcatttgtcattatctgtctctctccactgagattcaacacgttatcagcactttgctctccaccgagcggttaccgtcgacagcaatgtccatgcatccgtgcatccggcgtctgtcggacgaaaagcgattcaaagacaagttcatggagacgctgcttaggtatggctacagaggctagtacatgtctaatggctggacgctggacaacaacccgacaccactggaaggagatgatctcgctggagtctggcagtctggccacaaggagttgatctctactcagcaacagttgcaccacagcatctgtatcgtcggaggccgggactgcgtggccatggcgccgnccaacgactccgaccatgcacgcaccaccggctgcccgcgaacgagctgcagccgccgccgccggctacgtgctgccggcgccgctttggacaaccggcggccggcggcggtatgggcgtctttcccctccaacctgaacaaggtggngcgggccgctgctgctcagggagcggaaaaagaaccaaaaaccgcgaccacaacggaagcccaacaacaacggaaaaccggccccggcggaaatggggggcccccccgcgccnccnnnnnnnnnnnnttaaaaaaacccc

SEQ ID NO: 23634 - protein, 31 aa, Zea mays
  misc_feature: Ceres CLONE 1394019-F
MSMHPCIRRLSDEKRFKDKFMETLLRYGYRG

SEQ ID NO: 23635 - DNA, 719 bp, Zea mays
  misc_feature: Ceres CLONE 1394022-F
  misc_feature (358)..(358): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (398)..(398): n is a, c, t, g, unknown, or other
  misc_feature (527)..(527): n is a, c, t, g, unknown, or other
aagctggagctccccgcggtggcggccgctctagaactagtggatcccccgggctgcaggaattcgcacgagaccattacctagaacatcctaatcgaaaacctcccgcccgatacatttctcgtacatcgctctcgctctcgctctctctcctgctgtccacgaccgaccaaaggcgccgggcacagactcttcgtcggatccaagagaagctcgcgccctccccgaccatggtctcggcggataccatccgtacggctatcggcgtcatcggcaatggcaccgcccttgtgctcttcctctccccggtgtaagaatttatcgattctgcttctgcttgttattttttatctacaantcannnatataaaaaaaatataaaaactagtactacgcantccagctttctcctttataagaaatcaatggataaatttaaaaaaagcagagcatcaaaccaagaagaaaaactgatgtcacgaacttgacagttgacttttccgcgcaaccaaccaacaaccctacgnactggggtctgcttatggatacctacatgcatactaagaactccaatttgggacaatgggcccccggaggccccccttctgggggattgggaaaaagcggggggggaaacaaaacttcccaaatcccaacgggggaacctgttaaatggagggagggggggggtaaaaggtttgcccttggggcaccccaaa

SEQ ID NO: 23636 - DNA, 736 bp, Zea mays
  misc_feature: Ceres CLONE 1394023-F
  misc_feature: Encodes the peptide sequence at SEQ ID NO. 23637
aagctggagctccccgcggtggcggccgctctataccaatggatcccccgggctgcaggaattcgcacgagaccattacctagaacatcctaatcgaaaaaagatccaccaccccaccaaccaactactctcacagtctcacctcccgctcctgccccctccctctcgttctcttcctaaatggcggccgagtccgccaggccgccctcgccgccgcgcgactccggctgccccgcgggcgcgggagactccaccagctcccagctgaccgcgacctacctcggcgtcagcttcgcgctcttcctcgccacgctcccgtcgggcaccgcggcgcgccacgtggcctcgctccagtcgcggggccgcctcctcgcctcgcgcctgctggccgccgaggaccagctgcggcagctgcgcgcgcgccgccgcgaggacgcccgcgccaacgcccgcgccgccgagatcttcgcgggccaccgcgccgcctggatggaggccgagcgccgcctgcaggcccgcgccgccgccgccgcggacgaagacgcctccctccgggtgcatcttcgcgaagccgaggccgaagcccgctgcgctgcgcgccccgcgccgagggacttcaagcgcaaggccccctaagggaaagatcctggtcaccggttttcctccgggacaactcccggcgccggataaacccctacgagggacacatgatccccttaacacaaacaggtacaaa

SEQ ID NO: 23637 - protein, 151 aa, Zea mays
  misc_feature: Ceres CLONE 1394023-F
MAAESARPPSPPRDSGCPAGAGDSTSSQLTATYLGVSFALFLATLPSGTAARHVASLQSRGRLLASRLLAAEDQLRQLRARRREDARANARAAEIFAGHRAAWMEAERRLQARAAAAADEDASLRVHLREAEAEARCAARPAPRDFKRKAP

SEQ ID NO: 23638 - DNA, 698 bp, Zea mays
  misc_feature: Ceres CLONE 1394025-F
  misc_feature: Encodes the peptide sequence at SEQ ID NO. 23639
  misc_feature (414)..(414): n is a, c, t, g, unknown, or other
  misc_feature (564)..(564): n is a, c, t, g, unknown, or other
  misc_feature (596)..(596): n is a, c, t, g, unknown, or other
cgctctagtactagtggatcccccgggctgcaggaattcgcacgagaccattacctagaacatcctaatcgaaaaaatgtcgcgtgcggccactagatttttcctgacgcggtgtctgctcccacttcccctcctctcccccaggtggcggcagcggcggcggggtagcatttgtgctacgagggcttttgcaatggcggcttcggggttcggcggcggcgaggcgttccggctctcggccgcgccgggggccggcttactgaagctgcacaagggcgacatcaccctctggtccgtcgactgcgccaccgacgccatcgttaatgctgctaatgagcgaatgttaggtggcggaggtgttgatggagctatacatcaagctgctggaccagagctagtgcaagcatgccgganagttccagaggtcaaaccaggagtccgttgtcctactggagaagctaggattactcctgcttttgagcttcctgcctctcgggtgattcacactgttggccctatatatgatttggacagcatcctggagtgtcattaaagaaggctatngaaatagcttgaagcttgctaaggataatggncatcagtacatcgcattcctgctatatcctgggggggtttatcgttatcctcccaaggagcatcaaaaatagctgtttctacgcacaaaattttcagagata

SEQ ID NO: 23639 - protein, 119 aa, Zea mays
  misc_feature: Ceres CLONE 1394025-F
  misc_feature: SWISSPROT Homolog: EC 2.4.2.30 NAD(+) ADP-ribosyltransferase
  misc_feature (74)..(74): Xaa is any aa, unknown, or other
MAASGFGGGEAFRLSAAPGAGLLKLHKGDITLWSVDCATDAIVNAANERMLGGGGVDGAIHQAAGPELVQACRXVPEVKPGVRCPTGEARITPAFELPASRVIHTVGPIYDLDSILECH

SEQ ID NO: 23640 - DNA, 675 bp, Zea mays
  misc_feature: Ceres CLONE 1394026-F
  misc_feature: Encodes the peptide sequence at SEQ ID NO. 23641
  misc_feature (628)..(628): n is a, c, t, g, unknown, or other
cgctctagaactagtggatcccccgggctgcaggaattcgcacgagaccattacctagaacatcctaatcgaaaacatagagatagagatagacagctagcttcatcagtaggatgggcagcgacgaggaagcggcgctgctggtgccggcggtggaggagggttgccccgggtgcgtgatggagcggcggaaggcgagcagcaacggcaggatcccctacagggagctgttcttcgtcgccgccacctccctcgcctcagctttaccgatcacgtgcctcttccccttcttgtatttcatggtaagggacttccgcgtcgctgaaacagaggaagacatcggattctatgctggttttcttgctgcgtcgtacatggtgggcagaggcttctcttccatcttctggggcgtcatcgcagaccgcgttggacggaagcctgtcatcacgttttcgatactgtccgtggtcgtattcagcgcgctgtttggtctgagcacgacgtactggatggcgatcgccacgaggctcgtgctgggcgctctcaacgggctgctcgccccgataaggcgtactggcgtgaagtttgccagaccagcacaggcgcttggactctcgcttgtgacacnatgggctctgggtctcattggtggtcagctcttggagctactttcgc

SEQ ID NO: 23641 - protein, 187 aa, Zea mays
  misc_feature: Ceres CLONE 1394026-F
  misc_feature (172)..(172): Xaa is any aa, unknown, or other
MGSDEEAALLVPAVEEGCPGCVMERRKASSNGRIPYRELFFVAATSLASALPITCLFPFLYFMVRDFRVAETEEDIGFYAGFLAASYMVGRGFSSIFWGVIADRVGRKPVITFSILSVVVFSALFGLSTTYWMAIATRLVLGALNGLLAPIRRTGVKFARPAQALGLSLVTXWALGLIGGQLLELLS

SEQ ID NO: 23642 - DNA, 736 bp, Zea mays
  misc_feature: Ceres CLONE 1394031-F
  misc_feature: Encodes the peptide sequence at SEQ ID NO. 23643
  misc_feature (524)..(524): n is a, c, t, g, unknown, or other
  misc_feature (554)..(554): n is a, c, t, g, unknown, or other
  misc_feature (555)..(555): n is a, c, t, g, unknown, or other
  misc_feature (621)..(621): n is a, c, t, g, unknown, or other
  misc_feature (693)..(693): n is a, c, t, g, unknown, or other
aagctggagctccccgcggtggcggccgctctatactagtggatcccccgggctgcaggaattcgcacgagaccattacctagaacatcctaatcgaaaaatatccgcatccgctgcctccgcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacacttaaggactccaagacccttctcttcggtgacaagccggtcaccgtctttggcatcaggaaccctgaggaaatcccgtggggtgaggctggcgctgagtatgtcgtggagtccaccggcgtcttcactgacaagggacaggctgctgcacatctcaaggntggtgcaagaaggttgttatctctgccccnnagcaagatgcacccatgtttgttgttggtgtcaatgaggacaagtacacctcggatggtacattgnttccaatgctagctgcaccacaaactgccttgctcccctttgctaggtcattcatgacaacttcggcattgntgagggtttgatgacactgttcatgccatcactgccaccagaa

SEQ ID NO: 23643 - protein, 151 aa, Zea mays
  misc_feature: Ceres CLONE 1394031-F
  misc_feature (4)..(145): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
  misc_feature (116)..(116): Xaa is any aa, unknown, or other
  misc_feature (126)..(126): Xaa is any aa, unknown, or other
  misc_feature (148)..(148): Xaa is any aa, unknown, or other
MGKIKIGINGFGRIGRLVARVALQSEDVELVAVNDPFITTDYMTYMFKYDTVHGHWKHSDITLKDSKTLLFGDKPVTVFGIRNPEEIPWGEAGAEYVVESTGVFTDKGQAAAHLKXGARRLLSLPXSKMHPCLLLVSMRTSTPRMVHXFQC

SEQ ID NO: 23644 - DNA, 742 bp, Zea mays
  misc_feature: Ceres CLONE 1394039-F
  misc_feature: Encodes the peptide sequence at SEQ ID NO. 23645
  misc_feature (301)..(301): n is a, c, t, g, unknown, or other
  misc_feature (325)..(325): n is a, c, t, g, unknown, or other
  misc_feature (332)..(332): n is a, c, t, g, unknown, or other
  misc_feature (338)..(338): n is a, c, t, g, unknown, or other
  misc_feature (343)..(343): n is a, c, t, g, unknown, or other
  misc_feature (424)..(424): n is a, c, t, g, unknown, or other
  misc_feature (724)..(724): n is a, c, t, g, unknown, or other
  misc_feature (726)..(726): n is a, c, t, g, unknown, or other
aaagctggagctccccgcggtggcggccgctctataactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcaggaagggaggcggcgcccgatgggtgangcagtgaagggcatgctccacgancaggggncgacgncgtcncaagcgctgacggtggtgacgctgttcccgctggccggctgctgctggtgcttgtcgggctggcgctgacgccctccgggntggggttggccggggccaccccgttgtcctgaattaagccccgtggtcgtccccgcgggctgttaatggggaaggcggaatgggttccccccgccggggcggtggggtttcggggccttgtcccctccaggggctcccaaaaggggggggagggttcccggccccccgaaaataggggggggggccccccgaaggggggggggggcggggaaaccggccacaaaaaagggcgggggggccccccctcgggggggggcaaagaggccccccccggagaagaaaacccccccccttcttttnanaaaggggttctccata

SEQ ID NO: 23645 - protein, 68 aa, Zea mays
  misc_feature: Ceres CLONE 1394039-F
  misc_feature (32)..(32): Xaa is any aa, unknown, or other
  misc_feature (40)..(40): Xaa is any aa, unknown, or other
  misc_feature (43)..(43): Xaa is any aa, unknown, or other
  misc_feature (45)..(45): Xaa is any aa, unknown, or other
MADRDRSGIYGGAHATYGQQQQQEGRRRPMGXAVKGMLHXQGXTXSQALTVVTLFPLAGCCWCLSGWR

SEQ ID NO: 23646 - DNA, 734 bp, Zea mays
  misc_feature: Ceres CLONE 1394040-F
  misc_feature: Encodes the peptide sequence at SEQ ID NO. 23647
  misc_feature (546)..(546): n is a, c, t, g, unknown, or other
  misc_feature (606)..(606): n is a, c, t, g, unknown, or other
  misc_feature (734)..(734): n is a, c, t, g, unknown, or other
aaagctggagctccccgcggtggcggccgctctagaactagtggatcccccgggctgcaggaattcgcacgagaccattacctagaacatcctaatcgaaaaaccatctccagcggcttcttccaaagctccaactccgacgagaaccgccacacctcgaaatctcgaaggattttctgcggcgaaccccttcgtgacgtgacccaatgggagaggcctcgccgtcgatcgccaaggacgtcaccgagttgatcgggaacacgccgctggtgtacctcaacaaggtgaccgaggggtgcgtcggccgcgtcgccgccaagctcgagtccatggagccctgctccagcgtcaaggataggattggctacagcatgatcacggacgcagaggagaaagggctgattactccaggcgtgagtgttctgattgaaccaactagcggcaacacaggcattggactggcctttatggctgctgccaagggctacaaacttacactcacaatgcctgcctccatgagcatgggagaggaggatcatattgaanggcttttggtgctgaacttgtccttactgacccactcctgggaatgaaaggagctgtcangaaagcggaaagatacaagcaaagacaccaactcttacatcctcaacaatttgaaatccgctaacccaagattcctatgagactactgggcctgaaatctgaaagctacagcagaaaaattgatggcn

SEQ ID NO: 23647 - protein, 128 aa, Zea mays
  misc_feature: Ceres CLONE 1394040-F
  misc_feature: SWISSPROT Homolog: EC 2.5.1.47 Cysteine synthase
  misc_feature (114)..(114): Xaa is any aa, unknown, or other
MGEASPSIAKDVTELIGNTPLVYLNKVTEGCVGRVAAKLESMEPCSSVKDRIGYSMITDAEEKGLITPGVSVLIEPTSGNTGIGLAFMAAAKGYKLTLTMPASMSMGEEDHIEXLLVLNLSLLTHSWE

SEQ ID NO: 23648 - DNA, 717 bp, Zea mays
  misc_feature: Ceres CLONE 1394041-F
  misc_feature: Encodes the peptide sequence at SEQ ID NO. 23649
  misc_feature (486)..(486): n is a, c, t, g, unknown, or other
  misc_feature (598)..(598): n is a, c, t, g, unknown, or other
aaagctggagctccccgcggtggcggccgctctagaactagtggatcccccgggctgcaggaattcgcacgagaccattacctagagcatcctaatcgaaaactcacacaaccaagctcgatcgatctcactctcagctggtcgctcactcttgcagctccacccttcactcagtcttaggctcttagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgaggctgctgctcctgctgatcccgaggagcttcccgcggccgagcagcaggcagccgccgagcccgaggccgctgctcctgctggtgcgaggaggcccgcggcggncgatccggccgccgaggctgaggctgctgctcctgctggtcccgaagagactcccgcgggcgagcaggaggcagccgccgaggagggagctgctgctgctcctcctgctggngcccaggagcccgccgcggccgacccggtcgccgaggaagaggctgctgctcccgaagagctccccgcgaacaacccggagctcctgtcctggtggtccccaggagccgccgccggagg

SEQ ID NO: 23649 - protein, 155 aa, Zea mays
  misc_feature: Ceres CLONE 1394041-F
  misc_feature (79)..(79): Xaa is any aa, unknown, or other
MATAEVQTPTVVAAEEAPVVETPPPAVVPEESAPAEAEAEAEAEAAAPADPEELPAAEQQAAAEPEAAAPAGARRPAAXDPAAEAEAAAPAGPEETPAGEQEAAAEEGAAAAPPAGAQEPAAADPVAEEEAAAPEELPANNPELLSWWSPGAAAG

SEQ ID NO: 23650 - DNA, 734 bp, Zea mays
  misc_feature: Ceres CLONE 1394044-F
  misc_feature: Encodes the peptide sequence at SEQ ID NO. 23651
  misc_feature (477)..(477): n is a, c, t, g, unknown, or other
  misc_feature (597)..(597): n is a, c, t, g, unknown, or other
aaagctggagctccccgcggtggcggccgctctagaactagtggatcccccgggctgcaggaattcgcacgagaccattacctagaacatcctaatcgaaaaatataggggccatcagatccaagaagagggaagagcaccaaggaccttcggcgcccgttcaggatccacatcttcccgagcgagttcttggttgacctcttcctcttcggaccacctccaaggctcttggtgtagcttgccactctcaccaatcaagttttcatgtctgatctcgacattcagatcccaactgccttcgatcccttcgctgaggccaatgctggggactctggtgcggcagcagggtcaaaggactacgtacacgtgcgcatccagcagcgtaatggtcgcaagagcctgaccaccgtccagggatggaagaaggagttcagctacagcaagatcctcaaagatctcaagaaaagagtctgctgncatggtacagtggtccaggacccagaacttggacaggtcattcagctcccaggtgatcagaggaagaacgtctcgaatttcctcggtcaggccgggaattgtgaagaaggagcacatcangattcatggttttctgagcaccggcgggtccatagcaaaccacccctgcatgcaggcccagcttattatattatatatctggagtggagcatatctattctggtggggactggcagcaggcctagtacgcccgctgg

SEQ ID NO: 23651 - protein, 156 aa, Zea mays
  misc_feature: Ceres CLONE 1394044-F
  misc_feature (27)..(108): Pfam Name: SUI1 Pfam Description: Translation initiation factor SUI1
  misc_feature (71)..(71): Xaa is any aa, unknown, or other
  misc_feature (111)..(111): Xaa is any aa, unknown, or other
MSDLDIQIPTAFDPFAEANAGDSGAAAGSKDYVHVRIQQRNGRKSLTTVQGWKKEFSYSKILKDLKKRVCXHGTVVQDPELGQVIQLPGDQRKNVSNFLGQAGNCEEGAHXDSWFSEHRRVHSKPPLHAGPAYYIIYLEWSISILVGTGSRPSTPA

SEQ ID NO: 23652 - DNA, 745 bp, Zea mays
  misc_feature: Ceres CLONE 1394045-F
  misc_feature: Encodes the peptide sequence at SEQ ID NO. 23653
  misc_feature (360)..(360): n is a, c, t, g, unknown, or other
  misc_feature (385)..(385): n is a, c, t, g, unknown, or other
aaagctggagctccccgcggtggcggccgctctagaatagtggatcccccgggctgcaggaattcgcacgagaccattacctagaacatcctaatatcatcgctcgctcttctcttggtcttgcaactccagtgctgctcactgccactgccagcagatcgagctgctccgcctcactagccctcttgctttgctgctgcacctgcaagtctgcaaccgcgcacagagagatgtcgacggtgagccgtgcgtccctcgaccagaggctcgccctcgccaagcgctgctcccgagaggcgaccctcgccggagccaaggcggcaggggtggcgactatcgccctcccgatccccaccctgnccagcgcccgcatgctgccatgggncaaggccaacatcaaccccaccggccaggcgctcatcgtctccacgggggttgggatgggatacttcatccccggccaacaaaaagatcctgtcgcgtggcaaggggccacttctttcaagcaagccccctgagcacctcaagaacacctccttcccagggaaaccggcccgcccccacccgggttttcttcagggcggggaaaacggggccccccggcaagttaagtaacctaccctctttacagttccgaacgggcagggcaaagcccaccaccaagccccggaaataaatttaaaattttatcgaaccagggtttagctgcctaaaacacaccaacctggctaaaaataccaaaccg

SEQ ID NO: 23653 - protein, 95 aa, Zea mays
  misc_feature: Ceres CLONE 1394045-F
  misc_feature (11)..(94): Pfam Name: ENOD93 Pfam Description: Early nodulin 93 ENOD93 protein
  misc_feature (44)..(44): Xaa is any aa, unknown, or other
  misc_feature (52)..(52): Xaa is any aa, unknown, or other
MSTVSRASLDQRLALAKRCSREATLAGAKAAGVATIALPIPTLXSARMLPWXKANINPTGQALIVSTGVGMGYFIPGQQKDPVAWQGATSFKQAP

SEQ ID NO: 23654 - DNA, 719 bp, Zea mays
  misc_feature: Ceres CLONE 1394046-F
  misc_feature (294)..(294): n is a, c, t, g, unknown, or other
  misc_feature (330)..(330): n is a, c, t, g, unknown, or other
  misc_feature (334)..(334): n is a, c, t, g, unknown, or other
  misc_feature (335)..(335): n is a, c, t, g, unknown, or other
  misc_feature (363)..(363): n is a, c, t, g, unknown, or other
  misc_feature (370)..(370): n is a, c, t, g, unknown, or other
  misc_feature (371)..(371): n is a, c, t, g, unknown, or other
  misc_feature (385)..(385): n is a, c, t, g, unknown, or other
  misc_feature (466)..(466): n is a, c, t, g, unknown, or other
  misc_feature (483)..(483): n is a, c, t, g, unknown, or other
  misc_feature (484)..(484): n is a, c, t, g, unknown, or other
  misc_feature (497)..(497): n is a, c, t, g, unknown, or other
  misc_feature (524)..(524): n is a, c, t, g, unknown, or other
  misc_feature (529)..(529): n is a, c, t, g, unknown, or other
  misc_feature (541)..(541): n is a, c, t, g, unknown, or other
  misc_feature (542)..(542): n is a, c, t, g, unknown, or other
  misc_feature (547)..(547): n is a, c, t, g, unknown, or other
  misc_feature (622)..(622): n is a, c, t, g, unknown, or other
  misc_feature (680)..(680): n is a, c, t, g, unknown, or other
agagctggagctccccgcggtggcggccgctctagaactagtggatcccccgggctgcaggaattcgcacgagaccattacctagaacatcctaatcgaaaaatcttcaaaaactacccacggcccgtctcctcgacctccccgaaaccccacttctcggatcgagactagggttagggtttcgtcactcccgccccgattcgaaccaatccgcctaggcccccgccgcgccatggccgccggttccattgtggtggacttcccctccatgggcgccgccctctgcttccccanctcgaatcactcctccgagactccccgctcggtttnctcnntcgcgtctcccgcgccccggcccccggngccgccnngactcacaactttncacgcgtcttctcgcgcggtctcagcacctactcagacccgccgctcgaggtcgtctggttctttctcgcgctctcctttncacgacgccctgacgannctcgctcactgcntcaagctctctcccgcttcggcgcttnctcgnctgggggccgcnnagcgntcgcccctctcggccccgtggtttcggaggttttcactcaaataagccgggcagggagaccggaggccgtcctcngaggttgcctcagctaaatcaggatttggaggaagccgccccgcccctctgcaatganggcaccacccccaacccttgggggggggtggcggttttt

SEQ ID NO: 23655 - DNA, 742 bp, Zea mays
  misc_feature: Ceres CLONE 1394047-F
  misc_feature: Translation starting site: 220
  misc_feature: SWISSPROT Homolog: EC 1.4.1.2 Glutamate dehydrogenase
  misc_feature (436)..(436): n is a, c, t, g, unknown, or other
aagctggagctccccgcggtggcggccgctctagaactagtggatcccccgggctgcaggaattcgcacgagaccattacctagaacatcctaatcgaaaaaaccatcattgcaaaagcgaagcaaagcaatcggaattctctgcgatttctctagatctcgactaccccccactagttttggttcctcctttcgttcgagagagcgattctggtggcaatggcgaagagcgagggtccggcgatcgggatcgacctcggcaccacctactcgtgcgtcggcgtgtggcagcacgaccgggtggagattatcgccaacgaccaggggaaccgcaccacgccgtcctatgtcggcttcaccgacaccgagcggctcatcggcgacgctgccaagaacccaggtcgcatggacccccaccacaccgtcttcgatgccnagcggttgatcggcaggaggttctctgatccgtcagtgcagagtgacatgaagctatgggcggtcaagggcatcccaggggctggtgacaagccatgattgtagtggactacaagggccgaggagaagcagtttggctgctgaggagatctcctccatggtcctcatcaggatgagggagatggctgaagcctaccttgggtccaccatcaagaacgagggggggacagtgccggtctacttcacggattcggagaggaaggccaccaaggacggccggtggcattggggccctcaatgggatggg

SEQ ID NO: 23656 - DNA, 904 bp, Zea mays
  misc_feature: Ceres CLONE 1394049-F
  misc_feature (10)..(10): n is a, c, t, g, unknown, or other
  misc_feature (11)..(11): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (46)..(46): n is a, c, t, g, unknown, or other
  misc_feature (854)..(854): n is a, c, t, g, unknown, or other
ccgccacccnnacaccaccgcgcggcccccccccnnnccgggggcnggggcagagctggagctccccgcggtggcggccgctctagaactagtggatcccccgggctgcaggaattcgcacgagaccattacctagaacatcctaatcgaaaaacgccaaagatttcctcttccgcctgcgcttccctttgccccgctctcccccagcctcgctcgccatataatacgggccggccggccggccagctgggtccccgcggatgggctcggtctcgcggggctagggtttggtcggtcgcctcgccggcgtcgaggccgccagcgctgctagctagctctctcgcgttagggtcccccgaagcatggtggctgccacgctttctcgcgggccgtacgggggccgaagggcccacctttctgcgggagctcccccggggcggagaagagcggcccctgggcgctggttcgggggccccgagtcccagggtcggtctttcaaatcgggccccccgggaggtttaacccacgtacccgggtttttggggttggagtggccgcctcgggaaagctctaaataaaaaaaaaaacacccctctttgggcacgcgtggatggatattaattgggaccctgggaccccacccatggaaaagtcggcttatgtcgacaaaaaacacctggtaccacaacccctggttggggggcccgcccacaagtccctttcctcttccggaaggcacacctaaatatgggggtgaaaggggccacacacaatttctcaaaaaaaaatggcgccccccgggaggctccattcattcctcagaaaacccgcagaggatggcgcaaaataaaccncttataccccgcccctgggggtgccccccgcgcgaaatatcaaactaaac

SEQ ID NO: 23657 - DNA, 731 bp, Zea mays
  misc_feature: Ceres CLONE 1394051-F
  misc_feature: Encodes the peptide sequence at SEQ ID NO. 23658
  misc_feature (252)..(252): n is a, c, t, g, unknown, or other
  misc_feature (287)..(287): n is a, c, t, g, unknown, or other
  misc_feature (437)..(437): n is a, c, t, g, unknown, or other
aaagctggagctccccgcggtggcggccgctctagaactagtggatcccccgggctgcaggaattcgcacgagaccattacctagaacatcctaatcgaaaaaccttgtctacaagggttttccgctgtcttatcccttcgtccacgctccctgcagccgccgcccaaaccctagcaacccgtcctccgccatggccgacgaccactactcctctaagaggaagtacgacgacccctcgccgccgccgcggngcacggggttctcttcgggcccgccgcctgcctcngcgctcgcgggcggcgccccgtcgtacaacagcgtgccaccgccccccgatgagatccagctcgcgaagcagcgcgcgcaggagatcgcggcgcggatctttaaacgccgcagaggcaagcgtcctcgcgtcgacaacgcgacgatgacngcggcggctttcgtgtaggcctgggcaccactggtggcgggggcgcatcggcgggggaagactccggttcccgtcctctggcggggggggggcacggggctccaattccacattaatcttcccaaaaagcgcaccccagaacccccctttaggggggttccggggtccagcaaaaaattggaattcaaggtggggggggttgggggtttattttggaaaacccgggaaaacatttgggaaattccccttccccccgggggaaaaaattccgcgcccaaaaaacctgtaggtttt

SEQ ID NO: 23658 - protein, 87 aa, Zea mays
  misc_feature: Ceres CLONE 1394051-F
  misc_feature (21)..(21): Xaa is any aa, unknown, or other
MADDHYSSKRKYDDPSPPPRXTGFSSGPPPASALAGGAPSYNSVPPPPDEIQLAKQRAQEIAARIFKRRRGKRPRVDNATMTAAAFV

SEQ ID NO: 23659 - DNA, 747 bp, Zea mays
  misc_feature: Ceres CLONE 1394054-F
  misc_feature: Encodes the peptide sequence at SEQ ID NO. 23660
  misc_feature (363)..(363): n is a, c, t, g, unknown, or other
  misc_feature (406)..(406): n is a, c, t, g, unknown, or other
gagctggagctccccgcggtggcggccgctctagaactagtggatcccccgggctgcagtaattcgcacgagaccattacctagaacatcctaatcaaaaaaaaatcccaccacccttttccccttccaaccctcgggatctctccggcccgccatggaagtgttctactacctcgtgttcggcgcgctcgccgccatcgtggcggcgctggagctcgccaagtccggcaaggaccgcgtcgccacctccccggccttcaactcatttaagaacaactacatcctcgtttactccctcatgatgtctggggactggctgcaggggccctacgtgtactacctctacagccagtacggctttcnacaagggcgacattgggccggctctttcatcggcggcttcggntcctccatgctcttcggaaccatcgtcggatccctcgcggataagcaggggcggaaagaggggcgggtgtcacgaactggatcacctaactcctcaggttggatcaccaagcattcctcccaggaacaaagttctttatgattgggcggggcccttggggggaattgcccatttccgtgtttctttccagggttttgaggcgggggtccggggaaaaacaacaacaagaaaaggttttggtccccccagggggttggcaaaaaaatttctcccagggtttattttctttgggaaggggctaaaggggcatttttgtggctggccatattttgaaaaatttt

SEQ ID NO: 23660 - protein, 130 aa, Zea mays
  misc_feature: Ceres CLONE 1394054-F
  misc_feature (4)..(131): Pfam Name: DUF791 Pfam Description: Protein of unknown function (DUF791)
  misc_feature (70)..(70): Xaa is any aa, unknown, or other
MEVFYYLVFGALAAIVAALELAKSGKDRVATSPAFNSFKNNYILVYSLMMSGDWLQGPYVYYLYSQYGFXQGRHWAGSFIGGFGSSMLFGTIVGSLADKQGRKEGRVSRTGSPNSSGWITKHSSQEQSSL

SEQ ID NO: 23661 - DNA, 719 bp, Zea mays
  misc_feature: Ceres CLONE 1394055-F
  misc_feature (364)..(364): n is a, c, t, g, unknown, or other
  misc_feature (413)..(413): n is a, c, t, g, unknown, or other
  misc_feature (487)..(487): n is a, c, t, g, unknown, or other
  misc_feature (570)..(570): n is a, c, t, g, unknown, or other
aagctggagctccccgcggtggcggccgctctagaatagtggatcccccgggctgcaggaattcgcacgagaccattacctagaacatcctaatcgaaaataataaaggaggcacatcgataggttctttatctggaagtagcagcataagtaattcttccggtcctggtggggatgattcacatctttggcctcagttgccagcttgggagatactggaggctgttccatttgtggttgatgctgctcttactgcttgttcccatggaagactatttccacgtgaactgggcacaggcctgaaggatctggctgatttcctccctgcatctcttgctacaatagtaagctacttttccgctgnagtgacggcgggtgtctggaagcctgcatccatgaatggatcagattgncctagcccctctgtgaacctatccatggttgatgagcacatcaagaaaatcgtagctgctaccggttgtgatgntccaaagctagttacaggagggagctcttcaggtacacttccgttaccattggctgctttcgggagcctcacaatcacatacnagcttgacagggatcaaagtgtttcctcaccttgctgggcccagtctagagaactggctggaagctgcccttgggcaggatggcaatcgttgcagcactgggaacccaaagggtgaggcgatggagcgattttctaatattttcagctt

SEQ ID NO: 23662 - DNA, 748 bp, Zea mays
  misc_feature: Ceres CLONE 1394056-F
  misc_feature: Encodes the peptide sequence at SEQ ID NO. 23663
  misc_feature (508)..(508): n is a, c, t, g, unknown, or other
  misc_feature (536)..(536): n is a, c, t, g, unknown, or other
acaaagctggagctccccgcggtggcggccgctctagaactagtggatcccccgggctgcaggaattcgcacgagaccattacctagaacatcctaatcaaaaaaccggtcgcgaaccctcctcctccagccacgcctcgaaacggcgtcggggcctgcgcggcgagtccatggctgatcgcttcattcccaatgactttcctgacttcgtcgccgaggctgaggcctccgacggcgaggggcaccgccccgcagggcatcggggcctgctctcgcttccgtacaccaggctctccgaccacttcgtccgcgccgcgcgccgcctcaaggacaaggtggttgaggagacgtgggtgaaagccggacggaaggtgacggactacacgctctacacgggctctctcgggacagcgctgctgctgttcaagtccttccaggtcactggagaccgcggggacctcaccctcgccgctgatatcgtccgcgcgtgcgatgaatgcgtcgcggngcctggcgttcttgacatcatatgcggnaggggcggtgtctgccttcttgggggcgtgattgccagcattgcgatgatcagctgagggtcactcagtatctgagctcctttgatgagatacatccaccgagaaagtccaaatgagtgcctgtatgggagggcgggctatctgggggggcttgtttggtcctggaatagcatctcaggggagaagacgatccctctcagcacattaattct

SEQ ID NO: 23663 - protein, 140 aa, Zea mays
  misc_feature: Ceres CLONE 1394056-F
  misc_feature (113)..(113): Xaa is any aa, unknown, or other
MADRFIPNDFPDFVAEAEASDGEGHRPAGHRGLLSLPYTRLSDHFVRAARRLKDKVVEETWVKAGRKVTDYTLYTGSLGTALLLFKSFQVTGDRGDLTLAADIVRACDECVAXPGVLDIICGRGGVCLLGGVIASIAMIS

SEQ ID NO: 23664 - DNA, 708 bp, Zea mays
  misc_feature: Ceres CLONE 1394057-R
  misc_feature: SWISSPROT Homolog: EC 4.2.1.9 Dihydroxy-acid dehydratase
  misc_feature (450)..(450): n is a, c, t, g, unknown, or other
  misc_feature (495)..(495): n is a, c, t, g, unknown, or other
ccaattgggtaccgggccccccctcgaggtcgacggtatcgataagcttttttttttttttttttgagagactgaaaaggatgtgattgctcacaagcttaaacagacatattacgctcgattattcagcagcttctgtagcattgctaagctaatagaaaccggcattttattattatacctgccatacgcaaaccgcactatcatgaatcactctaacaggatggttgttcctggcaaacagcctttgattgaaaacacatcatgtgcacaacctaacagaatgtaacacagcctactcatcagtgacgcatcctctggacgctggagccacaagcttgatgtacttccaaagagctccactggtcgacttgtatggcggtggggtccatttcctccgcctttcttcgagctgctgttcggtaaggtcaacatcgattaccctcttanctacatcgatggtgatatatcaccactctggacaaggccaatggnaccaccttcctgtgcttcagggcatatgtgaccgacaacaatccatgtgaccctccagaaaatctacatctgtcagcagggcgcactcctttcaaaaacagcccccataatgcccttgttgggagcaacatttcggcatccctggccgcccttggcctttcccccggaaacaaaaaccttccctgaaattggcgggtttcgaaaaccggaaac

SEQ ID NO: 23665 - DNA, 745 bp, Zea mays
  misc_feature: Ceres CLONE 1394058-F
  misc_feature (345)..(345): n is a, c, t, g, unknown, or other
  misc_feature (378)..(378): n is a, c, t, g, unknown, or other
  misc_feature (379)..(379): n is a, c, t, g, unknown, or other
agagctggagctccccgcggtggcggccgctctagaactagtggatcccccgggctgcaggaattcgcacgagaccattacctagaacatcctaatcgaaaaacctcgcgtggcctcccgttctgacttcggagtccctcggtctcaacgactagttgagagctcgcggctccgttcgggcgaggggaggaggttcatgaggctgctgtaggctccgttgcagccgccgcgggcgggagtccgtgattttggacgccccaccgcggcaagatccggaagcgcgttggctgttgtgccgtgagtttcagtttcggtggtcgattgcttcagcctgctgagaagtangaggggcggccatggcggggtcgaggtttcggnntcgtcagtcggagaagggcgactccgcctccgcagcggcggcagcgggtgggaagcgcccaaaagagggacccgtacgaggtgctcggggtggcccgcaccgccaccgaccaggagatcaagagggcggtccgacgcatggggctccagtacatccggaacaagaatggggatgaccctggtgcatcaaaagggttccagggaggcccatttctcttattaattccgggaaaaccccgataaaaggggggaggaccaaccctccgggttttggggccatcaatcttaaaacccggaactgggggtgggcttttccaactcaaccctgggaaaccggggggtttggactctttttaagaaggtgggg

SEQ ID NO: 23666 - DNA, 694 bp, Zea mays
  misc_feature: Ceres CLONE 1394059-F
  misc_feature: Encodes the peptide sequence at SEQ ID NO. 23667
  misc_feature (462)..(462): n is a, c, t, g, unknown, or other
  misc_feature (617)..(617): n is a, c, t, g, unknown, or other
aaagctggagctccgcggtggcggccgctctagaactagtggatcccccgggctgcaggaattcgcacgagaccattacctagaagatcctaatcgaaaaaaccgacttccagttccactctcgcttccttccctccctccctcccacgcaaatggtggccgctcgcctccgcctcgcgctgctactctccgtctgcctctgctccgcgtgggcgcgcccacgcctcgagacggccatccgcctgccgtcgcagcgcgcggcggcggccgacgaaacggacgacggcgccgtcgggacccgctgggctgtgctcatcgcaggctccagcggctactacaactaccgccaccaggcggacatctgccatgcataccagatcatgaagaagggcggactcaaggatgagaacatcattgtcttcatgtacgatgacatcgcgcatagcccggagaatccgaggnctggtgtcatcatcaaccatccccagggtggcgacgtctatgctggggtgccaaaggattacactgggcgagatgtcaacgtcgacattttcttcgctgttctgcttggcacaaaatgctctcaggggtggatccggcaaggttgtggacagtgnccccgatgatcatatctttgtttctaagggaacatggggggtctgggtgtcttggaatgctacgtatcatatcttct

SEQ ID NO: 23667 - protein, 157 aa, Zea mays
  misc_feature: Ceres CLONE 1394059-F
  misc_feature (50)..(156): Pfam Name: Peptidase_C13 Pfam Description: Peptidase C13 family
  misc_feature: SWISSPROT Homolog: EC 3.4.22.34 Legumain
  misc_feature (104)..(104): Xaa is any aa, unknown, or other
  misc_feature (155)..(155): Xaa is any aa, unknown, or other
MVAARLRLALLLSVCLCSAWARPRLETAIRLPSQRAAAADETDDGAVGTRWAVLIAGSSGYYNYRHQADICHAYQIMKKGGLKDENIIVFMYDDIAHSPENPRXGVIINHPQGGDVYAGVPKDYTGRDVNVDIFFAVLLGTKCSQGWIRQGCGQXPR

SEQ ID NO: 23668 - DNA, 672 bp, Zea mays
  misc_feature: Ceres CLONE 1394061-F
  misc_feature (366)..(366): n is a, c, t, g, unknown, or other
  misc_feature (434)..(434): n is a, c, t, g, unknown, or other
  misc_feature (443)..(443): n is a, c, t, g, unknown, or other
  misc_feature (444)..(444): n is a, c, t, g, unknown, or other
  misc_feature (450)..(450): n is a, c, t, g, unknown, or other
  misc_feature (459)..(459): n is a, c, t, g, unknown, or other
  misc_feature (460)..(460): n is a, c, t, g, unknown, or other
  misc_feature (465)..(465): n is a, c, t, g, unknown, or other
  misc_feature (477)..(477): n is a, c, t, g, unknown, or other
  misc_feature (478)..(478): n is a, c, t, g, unknown, or other
  misc_feature (487)..(487): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (525)..(525): n is a, c, t, g, unknown, or other
  misc_feature (526)..(526): n is a, c, t, g, unknown, or other
  misc_feature (531)..(531): n is a, c, t, g, unknown, or other
  misc_feature (537)..(537): n is a, c, t, g, unknown, or other
  misc_feature (555)..(555): n is a, c, t, g, unknown, or other
  misc_feature (569)..(569): n is a, c, t, g, unknown, or other
  misc_feature (570)..(570): n is a, c, t, g, unknown, or other
  misc_feature (600)..(600): n is a, c, t, g, unknown, or other
  misc_feature (607)..(607): n is a, c, t, g, unknown, or other
  misc_feature (617)..(617): n is a, c, t, g, unknown, or other
  misc_feature (618)..(618): n is a, c, t, g, unknown, or other
  misc_feature (643)..(643): n is a, c, t, g, unknown, or other
  misc_feature (644)..(644): n is a, c, t, g, unknown, or other
  misc_feature (655)..(655): n is a, c, t, g, unknown, or other
aaagctggagctccccgcggtggcggccgctctagaactagtggatcccccgggctgcaggaattcgcacgagaccattacctagaacatcctaatcaaaagaactcctctcaggtcgagcctagggttagggtttcgtccctccggccccgattcgaaccaatccgcctcggcctccgccgcgccatggccgccggctccatcgtgggtggacttccctttcatggggcgccgccccttctggcttcccccaagccttcggatttctatttccctcccggggaaatcccccccccgggggggttttcttcggggggggggggggtttccaaaaaaggccccccccgcccccccgggggggggggnccccccccccccccccccccattttttttttttttccgggggggttttttttttttgggggggggggngtgtttttnngggggnccccccccnncccancccccccccggnncgggggggnaggggggggggggnnntttttttttttttttttttttnnggggnggcggncttctttcttttcctccncctcaaagccgggnnggggggggggggcggcaaaaaccccccacncccgggncccgcggggnnggggggcgggggacccccgaaaaanncccctcccccnccccatgcccggtcggc

SEQ ID NO: 23669 - DNA, 723 bp, Zea mays
  misc_feature: Ceres CLONE 1394063-F
  misc_feature: Translation starting site: 261
  misc_feature (573)..(573): n is a, c, t, g, unknown, or other
  misc_feature (608)..(608): n is a, c, t, g, unknown, or other
aagctggagctccccgcggtggcggccgctctagaactagtggatcccccgggctgcaggaattcgcacgagaccattacctagaacatcctaatcgaaaaatctagtcatctcgtctcaggttgcggccgaaccagagccccgtcccaactccaccacctctcttctctacggcgcgagcaagggcggcgccggccgcggcgtcggcgggaaccgggcctcgctctccccatctctccgatcacttctgtcctgtgaaaatggcggatgaactacgctcaacgtctgtgggtcagaagttccatgggcagtccgtgctgttgagcagaatctcttcctattccgccatgaacaaccctgtattcaacaatgcctattctgcttacaatgtgccccagaggtcatatcatgggatgaatgcaactgctggactctcatctgtcatggcaccatctcctgtctttgcttctgccccaaaagagaaaggcttttctggatttatgatcgactttatgatgggggggagtttctgctgctgtctccaagacagctgcagctccgattgagcgtgtncaggctttttgatcagaaccaggatgaaatgctcnagactggcaggctttctgaccctacaagggtattgggggactgctttggccgacatcaaaagaaggagggttttgtctcactggggagaggaaaccagctaatgtcatccgctcg

SEQ ID NO: 23670 - DNA, 706 bp, Zea mays
  misc_feature: Ceres CLONE 1394064-F
cgctctagaactagtggatcccccgggctgcaggaattcgcacgagacccttacatacaacatcctattcgaaaaattgatcgcgtattccgtcttctctctctctctaagccactgccagccacctctgagaccgtcgagaccaactcgccaagtaaattgtcttccgcccacctgactactcctcgacctcggactcggcgtcgcctccgtccgccggacgcgaaagatcatggcgccagagatgttattgaagagctccgccgcgaatatcatcgctctgccgactcccaacacgacgtttggctgagcgcaatgttctgatctccaggatcccatagcactccggcgtgatgccgggatccacgattaggtgtgcgaccgacgtgtcgtcgctttgataactgactatggaagatctatttttttgcatcagatataaatactgtttcacctttcctgtaagtgaacatccgatgtttatcagaccatgctgttctagttactagcttactattgctaatcattctttttctcctagctgagtgcattagcgtcaccatccatttgaataataggatactgatgcacggctcaaaagttatgcctaaactgcctttcttttgtgttggggggaccgaaacaaagtttggtgaacacttcacatgccatgtgactcagataagtgtcatagcattctttggca

SEQ ID NO: 23671 - DNA, 697 bp, Zea mays
  misc_feature: Ceres CLONE 1394066-F
  misc_feature: Encodes the peptide sequence at SEQ ID NO. 23672
  misc_feature (508)..(508): n is a, c, t, g, unknown, or other
  misc_feature (514)..(514): n is a, c, t, g, unknown, or other
  misc_feature (662)..(662): n is a, c, t, g, unknown, or other
aaagctggagctccccgcggtggcggccgctctagaactagtggatcccccgggctgcaggaattcgcacgagaccattacctagaacatcctaatcaaaaaacatccgctccccgccttccgcttccctaccccccgcatcacctaccaacgccgacaccatgggggccttcgcgaaggaggagcaccagttcctcgccgagctcggcctcgcgcagcgcaacccgggcgcgttcgcatgcggtgcgtggggcggctcaggtcccaccgtcacctccacgagcccgaccaacaatcaggtcatcgcagaggtcgtggaggcgtccgtgcacgactacgaggagggcatgcgcgcctgcttcgacgccgctaagacatggatggtgattcctgctccaaagcgaggagagatcgttaggcaaatcggtgatgcactgagagcaaagctccatcaccttggcaggcttgtgtcacttgagatggggaaaattcttcctgaagggatcgntgaggntcaggaaatcattgacatgtgtgattatgctgtgggactaagtcgccaactaaatggatccattataccatctgaacgaccaaacatatgatggatgggaggtgtggatccccctggaaggttatgggtgttataacggcatttattncccctggtgctgggctgggttggaatgcttggatt

SEQ ID NO: 23672 - protein, 147 aa, Zea mays
  misc_feature: Ceres CLONE 1394066-F
  misc_feature: SWISSPROT Homolog: EC 1.2.1.3 Aldehyde dehydrogenase (NAD(+))
  misc_feature (116)..(116): Xaa is any aa, unknown, or other
  misc_feature (118)..(118): Xaa is any aa, unknown, or other
MGAFAKEEHQFLAELGLAQRNPGAFACGAWGGSGPTVTSTSPTNNQVIAEVVEASVHDYEEGMRACFDAAKTWMVIPAPKRGEIVRQIGDALRAKLHHLGRLVSLEMGKILPEGIXEXQEIIDMCDYAVGLSRQLNGSIIPSERPNI

SEQ ID NO: 23673 - DNA, 726 bp, Zea mays
  misc_feature: Ceres CLONE 1394068-F
  misc_feature: Translation starting site: 249
  misc_feature: SWISSPROT Homolog: EC 2.1.1.43 Histone-lysine N-methyltransferase
  misc_feature (355)..(355): n is a, c, t, g, unknown, or other
  misc_feature (410)..(410): n is a, c, t, g, unknown, or other
  misc_feature (459)..(459): n is a, c, t, g, unknown, or other
  misc_feature (490)..(490): n is a, c, t, g, unknown, or other
  misc_feature (529)..(529): n is a, c, t, g, unknown, or other
  misc_feature (589)..(589): n is a, c, t, g, unknown, or other
aaagctggagctccccgcggtggcggccgctctagaactagtggatcccccgggctgcaggaattcgcacgagaccattacctagaacatcctaatcaaaaaggctgccgttcgcggaatctctcttcccactagcgacgactgggcgacctccgccgccacactaaaccctactccaggtgcccaggtctgcgtcgggcccttgccggcgacgagcacccgctagttacctctgtgcggtttccaagatggctcgccgtggattgatggaacaggacttaagcaaattggatgtgacaaagcttgacccactgtcacctgaaagtatctcacgccaagcaacaatcaatattgntaccatttggccatgtggctcatgggaagtctactgttgtgaaggctatatccgnagttcagactgttccggtcaagaatgagctggaacgtaacattactatnaagctgggctatgctaatgcaaaaatctacnaatgtgaggatgacagatgtcccacgaccaatgtgctancagggctatgggaagcggaaaagaagatacgcccctctatgtgagtgggcctgggatttnaaaaacactaagaatgagcctccctggaacatgtttctttttggttgattggccggggacaccaacattcttcatgggtaacatgcttaaatggagttgcttatcagggatggaccttcttttttttgatcgcaaga

SEQ ID NO: 23674 - DNA, 722 bp, Zea mays
  misc_feature: Ceres CLONE 1394069-F
  misc_feature: Encodes the peptide sequence at SEQ ID NO. 23675
  misc_feature (521)..(521): n is a, c, t, g, unknown, or other
  misc_feature (667)..(667): n is a, c, t, g, unknown, or other
  misc_feature (695)..(695): n is a, c, t, g, unknown, or other
aaagctggagctccccgcggtggcggccgctctagaactagtggatcccccgggctgcaggaattcgcacgagaccattacctagaacatcctaatcgaaaaagagctccaatggccgccgctctcccgcactcccgcctccacctcccgctccacacgcccagtcccacctcccgccgccgcccctgcccccgttcccgccgccgccttccctccttcgtcgccgtctcgcgcctccagaacaccaccgccgcgacccacccggtcctcccgcccccggctccgcccccctccgccgcgctcctcgccgccgagggcgcctccctcgcgccgcgccgagagcaccgcttcccaggctcggtctcctccccaacaagcaccgcctctgcctctaacgaggcggagtacgccgtcctgcttcgcgccctccaggtgcgccgcgccgtcgccgccgaggtgctcgttgccgcgctcggcggcggaaaggtcggcggcctgacctacatcaagaacctcacggngcggatggtggccgtttgtggacccgcgttgttgtcgaggccgcagccgatgaggcgggaccgccctgagctcgcccacatgtccttcaacgcccgtgcaaaggcgacatccaggagtcccgccttgtggagctttgtccagtggntcaagcacaactcgatgacatatcccangatcgcaaaagttggttgcacatggtc

SEQ ID NO: 23675 - protein, 203 aa, Zea mays
  misc_feature: Ceres CLONE 1394069-F
  misc_feature (137)..(137): Xaa is any aa, unknown, or other
  misc_feature (186)..(186): Xaa is any aa, unknown, or other
  misc_feature (195)..(195): Xaa is any aa, unknown, or other
MAAALPHSRLHLPLHTPSPTSRRRPCPRSRRRLPSFVAVSRLQNTTAATHPVLPPPAPPPSAALLAAEGASLAPRREHRFPGSVSSPTSTASASNEAEYAVLLRALQVRRAVAAEVLVAALGGGKVGGLTYIKNLTXRMVAVCGPALLSRPQPMRRDRPELAHMSFNARAKATSRSPALWSFVQWXKHNSMTYPXIAKVGCTW

SEQ ID NO: 23676 - DNA, 717 bp, Zea mays
  misc_feature: Ceres CLONE 1394073-F
  misc_feature: Encodes the peptide sequence at SEQ ID NO. 23677
  misc_feature (488)..(488): n is a, c, t, g, unknown, or other
  misc_feature (497)..(497): n is a, c, t, g, unknown, or other
aaagctggagctccccgcggtggcggccgctctagaactagtggatcccccgggctgcaggaattcgcacgagaccattacctagaacatcctaatcaaaaattttccaaatccgtctacgccctcacggacgcggtccaactagcctaacaaaccctagctagatttagaagaaaagtttgtccccaatccgaaccgactaggagctcgccgccgtgagatgtccgagtacgacgagcgctaccagggcaacgccgacatgcccgcagacgaaggcggctatccgcaggacgagtacgccgccgtcgccgcgcctgccgacgggggttcgccgcccgtagacagtaagccctccgggttctccgaccacgccgacggacgctcctcccagcaccagcatgagacacaatcacatgacggtggttcctcgaaatctcgagaaagggaccgagaacgcgataagggcaaggatagggagcgtgacaggnatcgtgggncgagataaggcgatgcaccgatacaggcataaggatcgtgaatgaagtgacagagaccgagatcgcgatctgctacacaggctacatcgagagcgcagcgagaaaaggcacaccgtgatcgttctgatgatcgtgaccgtcacgtgatggtcgtgaccgcatgcgtgatgatcgtgattcaagagatcagagatcgtgacacagatgatcatcgtaggaa

SEQ ID NO: 23677 - protein, 94 aa, Zea mays
  misc_feature: Ceres CLONE 1394073-F
  misc_feature (90)..(90): Xaa is any aa, unknown, or other
  misc_feature (93)..(93): Xaa is any aa, unknown, or other
MSEYDERYQGNADMPADEGGYPQDEYAAVAAPADGGSPPVDSKPSGFSDHADGRSSQHQHETQSHDGGSSKSRERDRERDKGKDRERDRXRGXR

SEQ ID NO: 23678 - DNA, 868 bp, Zea mays
  misc_feature: Ceres CLONE 1394077-R
  misc_feature: SWISSPROT Homolog: EC 2.7.11.1 Non-specific serine/threonine protein kinase
ccgattgggtaccgggccccccctcgaggtcgacggtatcgataagctttttcttttttttttttgtaaaaaaaactccataatagacagaaaacatccagaattctgcctgcctctttacaaatccctctaagaaacctactatattacctacacctacaaatggatgggaaaaaaaaaagagagatactctggcttataaaatccaatcactcaaactggttttacatgaggagcaggcttccccttccctgccgttttgccgcctttgttatccaagctccggctgcctggcctcttctgtaggtaatggttacctccttctttggtgtcctggagctgctttaacgctgtgaccacctcgtccatgctgggcctgtgcttggattccaccgagaggcattgcggggcaagcgccgcagccttttgcgccctggtaagggagtactgcccgcccagccgtgggtccaggatgcgaaatatgcgccgctggcttctcaggtatggcctagcccactccaccaggttgtgctccccgttggggcggttcttgtccagcgccggccgccctgacgggttttctgggagcaccaccccaagctttacacgtcgcttttggtggaaaaataacctgtccaaaggtattctgggagtgcaaacccctggagtcccccataccccttgtgggaacattgggtttttgtttggcgggggggaaacatccctttggccggccccaaaaaatagaagacgttttgaaaataaaaatttcccccctttcagaggggaaatataaaaagtgtttttgaaaaacccccggggaagaaaaattttccccccccccccccttgggaaaaaacccccggcc

SEQ ID NO: 23679 - DNA, 665 bp, Zea mays
  misc_feature: Ceres CLONE 1394077-F
  misc_feature (259)..(259): n is a, c, t, g, unknown, or other
  misc_feature (270)..(270): n is a, c, t, g, unknown, or other
  misc_feature (295)..(295): n is a, c, t, g, unknown, or other
  misc_feature (297)..(297): n is a, c, t, g, unknown, or other
  misc_feature (298)..(298): n is a, c, t, g, unknown, or other
  misc_feature (299)..(299): n is a, c, t, g, unknown, or other
  misc_feature (304)..(304): n is a, c, t, g, unknown, or other
aaagctggagctcaccgcggtggcggccgctctagaactagtggatcccccgggctgcaggaattcgcacgagaccattacctagaacatcctaatcgaaaactgctagtgctcagtcctcgccctctcgctttccgagggagcctttgcctttctcctccgcccgccagtcattaatggcggcgggatctccatccactcccacctcgcccccctcccactgctgctacttctaaaagcgctggtggcacggcaggcngtatccccggncgctagcgctgcgcgagagttgatngnnngatgntgatcaggcccccctcgctctcaggtttacgggggagcgatcggggaagccaacggggggtggggaacccaaaaagggaaaaccgcgccttttttccttttggcccccggtttttaaaaccctcctaattttaattcgcccgcgcggagaaaaaaaaaaaaggggccggggtaatttttccctttcccccgggccccgggtggagaattgggggggcccccccccccttttttaaaaaaaggggggtttttcccccgggggggggggccccgggggaaaaatggtggggggaaaaaataatttttaaaaagccccccgggggggcccccccccgggggggggggggccccattggggggaa

SEQ ID NO: 23680 - DNA, 767 bp, Zea mays
  misc_feature: Ceres CLONE 1394080-F
  misc_feature: Encodes the peptide sequence at SEQ ID NO. 23681
  misc_feature (267)..(267): n is a, c, t, g, unknown, or other
  misc_feature (277)..(277): n is a, c, t, g, unknown, or other
  misc_feature (313)..(313): n is a, c, t, g, unknown, or other
  misc_feature (357)..(357): n is a, c, t, g, unknown, or other
  misc_feature (453)..(453): n is a, c, t, g, unknown, or other
aaagctggagctccccgcggtggcggccgctctagaactagtggatcccccgggctgcaggaattcgcacgagaccattacctagaacatcctaatcgaaaaaaattaacctgtcccagccgcaccgatccaccccccctcggcctcggcctccctccggccatggaggtgttctactacgtcgtgttcggcgcgctggccgccgtcgtggcggggctcgagctcggcaagagcggcaaggaccgcgtcgccaccacctccgcattncactccttcnaagaacactacgtcctcgtctactccctcatgatgntcggggactggctgcagggcccctacgtctactacctctacagncagtatggcttcgacagggcgacatcgggcgcctcttcatcggcggctttcgatcctccatgctctttcgggacatcgtcggctccctcgccgaanaacagggcccgcaggagggcctgcggcacctattgaatcagttacatcttcggttggatccacaaagactcccccgggaaaaggttcctatggatcggccggatccctggggggatccccccctcggttggtttttcccccctttaaaatcctgggttcccccccaaaaaaaaaagaaagggttttcccccgggggggggtggcaaaaaatttcccaaaagcacctttctttggggaaagggttaattgccctttgattgggggtatttttcaaacctcttttggagaaaaattgggtttttcgccccgggccc

SEQ ID NO: 23681 - protein, 108 aa, Zea mays
  misc_feature: Ceres CLONE 1394080-F
  misc_feature (35)..(35): Xaa is any aa, unknown, or other
  misc_feature (39)..(39): Xaa is any aa, unknown, or other
  misc_feature (51)..(51): Xaa is any aa, unknown, or other
  misc_feature (65)..(65): Xaa is any aa, unknown, or other
  misc_feature (97)..(97): Xaa is any aa, unknown, or other
MEVFYYVVFGALAAVVAGLELGKSGKDRVATTSAXHSFXEHYVLVYSLMMXGDWLQGPYVYYLYXQYGFDRATSGASSSAAFDPPCSFGTSSAPSPXNRARRRACGTY

SEQ ID NO: 23682 - DNA, 719 bp, Zea mays
  misc_feature: Ceres CLONE 1394081-F
  misc_feature: Encodes the peptide sequence at SEQ ID NO. 23683
  misc_feature (703)..(703): n is a, c, t, g, unknown, or other
aaagctggagctccccgcggtggcggccgctctagaactagtggatcccccgggctgcaggaattcgcacgagaccattacctaaaacatcctaatcgaaaaaagtagacaacccagctctccagcggtccagcggtccagcctctcctagccgaggccaaaacccccataccaacacacacttcgcttctcgctgcctccgcggcggcgcgccgctccgctccgagccctcttcctcctcctcctctgcccgttcggtcgagaatgttctactcgcatcagcttctcgcgcggaaggcgccgctcggccagatatggatggcggcgacgctccactcgaagatcaaccgcaaacggctcgacaagctcgacatcatcaaaatctgtgaggaaattttgaacccctcggtgcccatggctctgaggctctctggaatcctcatgggtggcgtggtgatcgtgtacgagaggaaggtgaagcttctctacactgatgtctctcgggttctgactgagatcaacgaggcatgccgaatcaaaccggtcacagaccccaccggtcctccccaaggtaaaactcaaggcaagtatgaagcaagaacactgccagagatcaatatgggggggggacagcccatgtttttctcgaaggctgatggtgccaggtccgacgaatgggattggagatctggatgacagtatngtcaagtcatcttgag

SEQ ID NO: 23683 - protein, 143 aa, Zea mays
  misc_feature: Ceres CLONE 1394081-F
  misc_feature (1)..(115): Pfam Name: Rad21_Rec8_N Pfam Description: N terminus of Rad21 / Rec8 like protein
MFYSHQLLARKAPLGQIWMAATLHSKINRKRLDKLDIIKICEEILNPSVPMALRLSGILMGGVVIVYERKVKLLYTDVSRVLTEINEACRIKPVTDPTGPPQGKTQGKYEARTLPEINMGGGQPMFFSKADGARSDEWDWRSG

SEQ ID NO: 23684 - DNA, 754 bp, Zea mays
  misc_feature: Ceres CLONE 1394082-F
  misc_feature: Encodes the peptide sequence at SEQ ID NO. 23685
  misc_feature (207)..(207): n is a, c, t, g, unknown, or other
  misc_feature (217)..(217): n is a, c, t, g, unknown, or other
  misc_feature (223)..(223): n is a, c, t, g, unknown, or other
  misc_feature (496)..(496): n is a, c, t, g, unknown, or other
aagctggagctccccgcggtggcggccgctctagaatagtggatcccccgggctgcaggaattcgcacgagaccattacctagaacatcctaatcgaaaatctgggccccatgtgctaactgcctgtaaaccctaatcccgaatccctcccggcctcctccgtctcgcgctcgattcgaatccgagctccctatcctgctcctgctngtcccgctgncatggnagacaacgcggtcgaagagcccgagttgagcggtgcggcggagttcgcgccggtgctcgtcgccgcccacccacacggcaactccgtcgccgtcgccatcggggccgagctccgcgtgtttgatctcagggctggtcatccagtttcatgggcagatgatgggggtggccattctcattcagacgcattaaaagctatctgcttcagtgtgagtgggagctttgtttgcttcaggtggggatgacaaacttggtgaaggtttgaaagaatgantcgtgggcgtttcatccaaactataacttccggaaaaaagggtccagtgcatttgttaataacaaaccatgaccctgtatggtatcttttgaaaataaaatttggggttggttttgttacccccttttgcgaaaaaatagggaaaaacaagtttccattttaaaaaaaaaccctggggcaatttcttttggccctatttggcggatcctccctaaggatggagtttttcccccgaagggaggggtttttttttacttg

SEQ ID NO: 23685 - protein, 82 aa, Zea mays
  misc_feature: Ceres CLONE 1394082-F
  misc_feature (2)..(2): Xaa is any aa, unknown, or other
MXDNAVEEPELSGAAEFAPVLVAAHPHGNSVAVAIGAELRVFDLRAGHPVSWADDGGGHSHSDALKAICFSVSGSFVCFRWG

SEQ ID NO: 23686 - DNA, 702 bp, Zea mays
  misc_feature: Ceres CLONE 1394083-F
  misc_feature: Encodes the peptide sequence at SEQ ID NO. 23687
  misc_feature (286)..(286): n is a, c, t, g, unknown, or other
  misc_feature (462)..(462): n is a, c, t, g, unknown, or other
ggagctcaccgcggtggcggccgctctagaactagtggatcccccgggctgcaggaattcgcacgagaccattacctagaacatcctaatcgaaaaaagcgtgctagggtttcccccgtcttatcgcttcctcgttcccgcagccgccgcccaaaccctagcaaacccgtcctccgccatggccgacgaccactactcgtccaagcggaagtacgacgacccctcgccgccgccgcggagcacggggttctcttctggcccgccgcctggctcggcgcccgctggnggcgccccgtcgtacaacagcgttgcgccgccccccgatgagatccagctcgcgaagcagcgtgcgcaggagatcgcggcgcggatctttaaacgcgcagaggccaagcgccctcgcgtcgaacacggcgacgatgacgtcggcggcttcggtggaggaagttccctggttgccancggtggtgggtggtggtgcccccatcgggggcgaagaactgggctcctcgcctccggcggggggggggcatggggcttctatccccccggtatcttttccgagaagggcaccaaggacccataggggggacttcggggtacaagaaaaaaattgaaatcccaagggaaaggtttggggtaatattggaaaagctgggaaaaatattagggttccccacttcaaccgggagaaagatttag

SEQ ID NO: 23687 - protein, 135 aa, Zea mays
  misc_feature: Ceres CLONE 1394083-F
  misc_feature (95)..(95): Xaa is any aa, unknown, or other
MADDHYSSKRKYDDPSPPPRSTGFSSGPPPGSAPAGGAPSYNSVAPPPDEIQLAKQRAQEIAARIFKRAEAKRPRVEHGDDDVGGFGGGSSLVAXGGGWWCPHRGRRTGLLASGGGGAWGFYPPGIFSEKGTKDP

SEQ ID NO: 23688 - DNA, 706 bp, Zea mays
  misc_feature: Ceres CLONE 1394084-F
  misc_feature: Encodes the peptide sequence at SEQ ID NO. 23689
  misc_feature (262)..(262): n is a, c, t, g, unknown, or other
  misc_feature (319)..(319): n is a, c, t, g, unknown, or other
agagctggagctccccgcggtggcggccgctctagaactagtggatcccccgggctgcaggaattcgcacgagaccattacctagaacatcctaatcgaaaagacaaatcgacgatcgccgcttctcttggccattgtagagggagagagagagcgcgagcgacctaggtcagtcggtttcggttttgggcgtcagcttcagctatccgcgaccgcgacgatgggtctgcgcgtgggcgccacccgcgcagctccggccggngtgcgcgtgctcggcaggggcgccgcgcgcgtgacgccgcgaccgtgggctgctgtncgcggcaggagacgcttctccgtgcggatgtccgtcgcgaccacggagcccacaccaccatcggcgggggcgcctcggaggacaggcgctggaggctaggaactcccagacggtggtggcggccatcctcgggggtggcgccgggaacagggctcttcccgcttaccagacgcagggccaagccccgcggggcaatttgggggggcgtacagcttcatcgacgggccgatgaacaactgcataaacagcgggatcaacagggtctacatcctccggaggttcactcgaaatccctcaatccccacctctccagagctaccatttcagcaggggggggccatcggaaaacgattcgccaggttctaaaacaacccagaggccggaagg

SEQ ID NO: 23689 - protein, 65 aa, Zea mays
  misc_feature: Ceres CLONE 1394084-F
MGLRVGATRAAPAGVRVLGRGAARVTPRPWAAVRGRRRFSVRMSVATTEPTPPSAGAPRRTGAGG

SEQ ID NO: 23690 - DNA, 708 bp, Zea mays
  misc_feature: Ceres CLONE 1394085-F
  misc_feature: Translation starting site: 150
  misc_feature: SWISSPROT Homolog: EC 4.1.2.10 Mandelonitrile lyase
  misc_feature (290)..(290): n is a, c, t, g, unknown, or other
  misc_feature (297)..(297): n is a, c, t, g, unknown, or other
  misc_feature (422)..(422): n is a, c, t, g, unknown, or other
  misc_feature (524)..(524): n is a, c, t, g, unknown, or other
  misc_feature (525)..(525): n is a, c, t, g, unknown, or other
  misc_feature (527)..(527): n is a, c, t, g, unknown, or other
  misc_feature (708)..(708): n is a, c, t, g, unknown, or other
aaagctggagctccccgcggtggcggccgctctagaactagtggatcccccgggctgcaggaattcgcacgagaccattacctagaacatcctaatcgaaaacactaaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaaggacgcgcgctggcgcccagcgtgtcntactacnactacatcatcgtgggcggcggcacggccgggtgcccgctggccgccacgctgtcggagcgcttccgcgtgctgctgctggagcgcggcgcctcggcctacgacgacgaccgcatcggggacatncccgcttcgcgacacgctgtcggacacctccccgggctcgcccgcgcagggcttcgtgtcggaggacggcgtcatcacctcgcgcccggggttgctgggcgnngnaatctgcatcaacgcccgcttctacccgcgggccaaggaacactacgtgggggggccgccgggtggaacctgggccccccccggggcgggcataccggggggtggaagaacttggttggcgctccacccggagttggggcccctggggaagccccccctgcaaggcggccctgctccaagn

SEQ ID NO: 23691 - DNA, 668 bp, Zea mays
  misc_feature: Ceres CLONE 1394086-F
  misc_feature: Encodes the peptide sequence at SEQ ID NO. 23692
  misc_feature (396)..(396): n is a, c, t, g, unknown, or other
  misc_feature (453)..(453): n is a, c, t, g, unknown, or other
  misc_feature (538)..(538): n is a, c, t, g, unknown, or other
  misc_feature (560)..(560): n is a, c, t, g, unknown, or other
  misc_feature (561)..(561): n is a, c, t, g, unknown, or other
  misc_feature (615)..(615): n is a, c, t, g, unknown, or other
  misc_feature (640)..(640): n is a, c, t, g, unknown, or other
aagctggagctccccgcggtggcggccgctctagaactagtggatcccccgggctgcaggaattcgcacgagaccattacctagaacatcctaatcgaaaactacatgccaaatctggaggcaagagaaccgggagagggcgtgttgggttgctcgtcgtgatcccggacggcaatacctgcccttgcctacttgccactgcttgcgtacactgatgtccttgttcaatcccctctagaaagtagaaacattgcttaattggcttggctattgctgttagctccacacaaaagagagaaccggcggcgagctaggagctagccatggacggacacggcgcggtctcaccgtggagcgtgcttaggcgggcggcggctgtgctgctcctgtggttgncgtcgcaggtgctggagtgggcctggtgggcgccccggcgcgtgaaccgtgcgctgnaggcgcagggcctgaggggcacccggtaccgcctcctctgcggcgacctcatcgaggagcagcgtctccgcgcggcggccctggncaggccccgtcccgtgaatcgnncacacgacttcgtccctcgcgtcgcggcttttccttcaccgcggtctccagaanacgggaaagctctcgtttacatggntttgcgccgaccccaaaaggtctattcc

SEQ ID NO: 23692 - protein, 115 aa, Zea mays
  misc_feature: Ceres CLONE 1394086-F
  misc_feature: SWISSPROT Homolog: EC 1.3.3.9 Secologanin synthase
  misc_feature (25)..(25): Xaa is any aa, unknown, or other
  misc_feature (44)..(44): Xaa is any aa, unknown, or other
  misc_feature (72)..(72): Xaa is any aa, unknown, or other
  misc_feature (80)..(80): Xaa is any aa, unknown, or other
  misc_feature (98)..(98): Xaa is any aa, unknown, or other
  misc_feature (106)..(106): Xaa is any aa, unknown, or other
MDGHGAVSPWSVLRRAAAVLLLWLXSQVLEWAWWAPRRVNRALXAQGLRGTRYRLLCGDLIEEQRLRAAALXRPRPVNRXHDFVPRVAAFPSPRSPEXGKALVYMXLRRPQKVYS

SEQ ID NO: 23693 - DNA, 641 bp, Zea mays
  misc_feature: Ceres CLONE 1394093-F
  misc_feature: Encodes the peptide sequence at SEQ ID NO. 23694
  misc_feature (476)..(476): n is a, c, t, g, unknown, or other
  misc_feature (574)..(574): n is a, c, t, g, unknown, or other
tccccgcggtgggcggccgctctagaactagtggatcccccgggctgcaggaattcgcacgagaccattacctagaacatcctaatcgaaaaaacgaaccaaacataaattcagcccaccgctcctgctgctgctgcttcgaggacaggacggagggaactcacgcgcgagcaaagcaaagcacaagcagcaatggggatctgctgcggcaaggccaaggcggcggcaggggagcccgacgacgacgagggcctgggcttcccatggatgcacgacgacctgttccacagccacctgtgggccagcgccggcgtctccgtgcacaccaagcagggatggaagggcgccaaccaggacgccatgaccgtctgccaggacttcgccggccagaaaggccacatcctctgcggagtgttcgatggccacggccctcgtggccgggaagtcgctcgccacgtccgcgacaccctccccgntggaactagccgccgctctgaagccgagaaccggggacgaagatcccctccgcctcgagcgacgctccgaaagcctaaccctgacgaagatggctcangcgagaatggagaagaatgctcaggcaagaatggggatgcttccagcaccgccgatttggatccctc

SEQ ID NO: 23694 - protein, 149 aa, Zea mays
  misc_feature: Ceres CLONE 1394093-F
  misc_feature (95)..(95): Xaa is any aa, unknown, or other
  misc_feature (128)..(128): Xaa is any aa, unknown, or other
MGICCGKAKAAAGEPDDDEGLGFPWMHDDLFHSHLWASAGVSVHTKQGWKGANQDAMTVCQDFAGQKGHILCGVFDGHGPRGREVARHVRDTLPXGTSRRSEAENRGRRSPPPRATLRKPNPDEDGSXENGEECSGKNGDASSTADLDP

SEQ ID NO: 23695 - DNA, 641 bp, Zea mays
  misc_feature: Ceres CLONE 1394096-F
  misc_feature: Encodes the peptide sequence at SEQ ID NO. 23696
tggcggccgctctagaactagtggatcccccgggctgcaggaattcgcacgagaccattacctagaacatcctaatcgaaaacgaaaaattcgaaagatccctccaggaaagatttttcttccctcctccgacgccccagcccaccaacacactctataaagcagccctcagtcacacacagaacgcacaagcgcaagccgggcaagaaaactccgtaggccagtctgcgagttggatggccttcttcttggccctcgtgtgcatcctcatcttgctagccatcgcctcctacgtccagtacactcgctggcaaaaggggaaaggccgcttcggcggccatgggaggtctgctcccttgaagctgcctcctggctccatgggctggccttaccttggcgagaccctccagctttactcccaggaccccagcttcttcttcgcttccaaacagaagaggtacggcgagatcttcaagacgcaccttctgggttgcccgtgcgtgatgctggcgagcccggaggcggcgcggttcgtgctggtgacgcaggcgcacctgttcaagccgacctacccgcggagcaaggagcgcatgatcgggccgtcggctctcttcttccaccagggcgactaccacctccgc

SEQ ID NO: 23696 - protein, 135 aa, Zea mays
  misc_feature: Ceres CLONE 1394096-F
  misc_feature: SWISSPROT Homolog: EC 1.14.13.93 (+)-abscisic acid 8'-hydroxylase
MAFFLALVCILILLAIASYVQYTRWQKGKGRFGGHGRSAPLKLPPGSMGWPYLGETLQLYSQDPSFFFASKQKRYGEIFKTHLLGCPCVMLASPEAARFVLVTQAHLFKPTYPRSKERMIGPSALFFHQGDYHLR

SEQ ID NO: 23697 - DNA, 662 bp, Zea mays
  misc_feature: Ceres CLONE 1394102-F
  misc_feature: Encodes the peptide sequence at SEQ ID NO. 23698
aaagctggagctccccgcggtggcggccgctctatcactagtggatcccccgggctgcaggaattcgcacgagaccattacctagaacatcctaaaaaaaaactatcggatcttgcgaaggcatcgtcctcttcgtctccttcgtcgtcctatcttataatcgcatttcgaaatccccaaacggaagcatcgccactcttccgaacctgaacaatcaccaccgttattaagaagatgatgcgctgcgctgcaacgggcggcgggtgcgtcgcttcgtggagcggcgatcggagattgccggcggtcaacccctgcagcgtgcggatgccgacgggcaacgatgggtggtgcgccggcctgaggtcgcgggcggcggatctcgccggcctcgagatggccaacctgcgcggcggcgtcggggggctcttccgcgcgagcccgcgctacgggcgcttgcaagccacggcggcagttgaccctgaagatattccattggagaaggttcaagctaaatcctcaggacatgttctgccatatgttgccgctgctttgtttgggggctattctggctggttaccatcttggtgggggcaaatggggcacttgaatatctcgccaaggatcttgggattggttgaaaatgctgccttgcacgggcggcc

SEQ ID NO: 23698 - protein, 142 aa, Zea mays
  misc_feature: Ceres CLONE 1394102-F
MMRCAATGGGCVASWSGDRRLPAVNPCSVRMPTGNDGWCAGLRSRAADLAGLEMANLRGGVGGLFRASPRYGRLQATAAVDPEDIPLEKVQAKSSGHVLPYVAAALFGGYSGWLPSWWGQMGHLNISPRILGLVENAALHGR

SEQ ID NO: 23699 - DNA, 616 bp, Zea mays
  misc_feature: Ceres CLONE 1394108-F
  misc_feature: Encodes the peptide sequence at SEQ ID NO. 23700
gctctagaactagtggatcccccgggctgcaggaattcgcacgagaccattacctagaacatcctaatcaaaaaactcgatcagtcgcgtgtctaggtttcctctctcaccatagcggccgctctgtcgcccttcgttcacctctccttcctctcgtccctgcctgccagggagaggtgaagtcagaggcacggagcggcgcagagtagacgcccgtgaaccattgtaactgtccctgtcgtcgtcgtcgtcaacgaacccacacaaggaaaggatggagaagaagccgaccatcctcatgaacaggtacgagctcggtcgcacgctcgggcagggcaccttcgccaaggtgtaccacggccggaacctcgcgtccggcgagagcgtggccatcaaggtcatcgacaaggagaaggtgatgcgcgtccttatgatcgaccagatcaagcgcgagatctccgtcatgcgcctcgtccgccaccccaacgtcgtgcagctgcacgaggtgatggccagcaagagcaagatatacttcgccatgaagtacgtccggtgcggcgagctcttcgcccgcgtcgtctgcggtcgtctcaaggaggacgccgcgagaaggtat

SEQ ID NO: 23700 - protein, 114 aa, Zea mays
  misc_feature: Ceres CLONE 1394108-F
  misc_feature: SWISSPROT Homolog: EC 2.7.11.1 Non-specific serine/threonine protein kinase
MEKKPTILMNRYELGRTLGQGTFAKVYHGRNLASGESVAIKVIDKEKVMRVLMIDQIKREISVMRLVRHPNVVQLHEVMASKSKIYFAMKYVRCGELFARVVCGRLKEDAARRY

SEQ ID NO: 23701 - DNA, 625 bp, Zea mays
  misc_feature: Ceres CLONE 1394109-F
  misc_feature: Encodes the peptide sequence at SEQ ID NO. 23702
gctctagaactagtggatcccccgggctgcaggaattcgcacgagaccattacctagaacatcctaaaaaaaatcttatttcactgccagccctctgaaaaaaaaattaaaaaatgaggtcccagttccacccacctagagagccaaaagagccggcggtggccggcagccaaaacccacgttggattttgccgccgccgcctggagctaggggacaaggcaacgccggccggtgcaacatttatgcgtgtaccaggcagaccagcccggcagccacgcgtacacttctgccgcaaagctaaacgcgccactccgcggcaagctgctctgctgctcccaccagccaccgcaccgagtgccaatggcgactgcagcgagttcgacgccggcggcgcggcagcctactctggtctgcgcgtcactgaccgcgcgggtgccccgggagatggcagcggaggttgccgccgctgcggcgctcggtgccgacgtggcggagctccaggtcggctgcctcgacagcttcgagccatgcagggacctgcccgtgcttctcgcccagccccgctcgctccccgtcatcgtcacctacaggccgaattgggagggaggccagtacgcaggcgaa

SEQ ID NO: 23702 - protein, 88 aa, Zea mays
  misc_feature: Ceres CLONE 1394109-F
MATAASSTPAARQPTLVCASLTARVPREMAAEVAAAAALGADVAELQVGCLDSFEPCRDLPVLLAQPRSLPVIVTYRPNWEGGQYAGE

SEQ ID NO: 23703 - DNA, 760 bp, Zea mays
  misc_feature: Ceres CLONE 1394111-F
  misc_feature (15)..(15): n is a, c, t, g, unknown, or other
  misc_feature (17)..(17): n is a, c, t, g, unknown, or other
  misc_feature (21)..(21): n is a, c, t, g, unknown, or other
  misc_feature (22)..(22): n is a, c, t, g, unknown, or other
  misc_feature (31)..(31): n is a, c, t, g, unknown, or other
  misc_feature (39)..(39): n is a, c, t, g, unknown, or other
  misc_feature (41)..(41): n is a, c, t, g, unknown, or other
gggggtttgtgtgcntnttcnnccccccccnccacccananataaaaccccccgcaagagagaatttactccacggcgtgagccaccgctttaccaatactggatcccccgggctgcaggaattcgcacgagaccattacctagaacatcctaatcgaaaaagcctacatgcccccgcctcctgccctctgtacacatcctcgcctctccccaatagttcgctcgcgtgatggtggtgcgggagcagcggaacaaggattcgtcatcggccaccctgtgacaccccgacgacgcccccgcggcgcaacctgcaaacccggaggccgcagctccgacttcgtcggtcttcgaccgggtctgatcggcgctgtcacatgccgctacggacgacatccgtcagaatgacgggggccacagagaaggtggtggtgttcaggcaccacagagagagaggcccccgttaccctgattcacccggaccgactacaagaatgcaccgagcccatcaggataacggccgacagacgcccaccggataccccgccaattgggaaaggccaattccaccccatcccccacccggtgaagagagtgttaaatttactcccgaccactaacaggcaaccgcgcgacaaccctctcatccccgccaacccctagaaaaagtgcatgttccccccaccaccacaagacccactataaaagcaaaaacagacaacccgcctgcactgtcccactccaacacccccacccctcccca

SEQ ID NO: 23704 - DNA, 654 bp, Zea mays
  misc_feature: Ceres CLONE 1394114-F
  misc_feature (277)..(277): n is a, c, t, g, unknown, or other
  misc_feature (362)..(362): n is a, c, t, g, unknown, or other
  misc_feature (364)..(364): n is a, c, t, g, unknown, or other
  misc_feature (373)..(373): n is a, c, t, g, unknown, or other
cgctcagaactagtggatcccccgggctgcaggaattcgcacgagaccattacctagaacatcctaatcgaaaaagaaacactttacattagattttttgtatgaaacgcccgcaaccgacttgctcctcaagcctccctgcctgccagctcactcgccttcttcctcccattcccctcgaaccaaccagcagcgattcggatcaaaacgaaacgaaccaaaccaaccaactcgccaccctccaaagccgcagccccaatcccaccggcgggcaggnaggcagagcgcaccccgcgccatgtcagccacgtcgtcgttcacagcggtttatcccccccccagctgggggaggagggggaccncnacaaggtgntccaattcccggactgccctaggaaaaaactcccccccgccatggggggggaggggggccaaaaacgaaccgccacggatggttccccccccgagccctcaaaaatcttttctccaccccccccccccccgcatggccggcaccccccccatacgggcccccgccccaaaaggccctctacacgcgccaccaaacggggattccggggtgcccccacccctggggggattgtgtccccaccagccccccacctggggctcaacacctcccccggacaacac

SEQ ID NO: 23705 - DNA, 653 bp, Zea mays
  misc_feature: Ceres CLONE 1394115-F
aagctggagctccccgcggtggcggccgctctagaactagtggatcccccgggctgcaggaattcgcacgagaccattacctagaacatcctaatcgaaaaactgctcactgcaccgagccgagcgcaggttaggcgggcgcgcgatcaccgaagccgacgcggcgcccgcacgcgccaacggccgaacgcactctctctctctctctctctctctctctctctcccctctccgttgtgctccccgacccaaccctacgcgctcctgccgcccccccgcaggccgcagctacatctctcctcccacctcgccagtcgccaccgcgcggtgggagctcgctgaagtgcttccccccgctttgcggcagcgtcagctcagaccccttgcccgcgctctcgttgtctggcgggctcagctggtttggtcagcgtggcgaggttgtcctggccagatcctgctcccgcccgcgcacgactgggtgtgggcggtggattggctgcgcgggtcatcagatctatgccggagatctagggcgccaggtgccgaggtggaggccgtgagccggtggcgatcggagggccgaggacagggatggcgtggtggtccgggaaggtgtcgctcggcggcctgcaggacatcgctggagccgtcaa

SEQ ID NO: 23706 - DNA, 1599 bp, Zea mays
  misc_feature: Ceres CLONE 1394116
  misc_feature: Encodes the peptide sequence at SEQ ID NO. 23707
atcactagtcaccacttccccgcgctgccctcccactcccacacaccttctgctgcctctcgccgcggccgatgggctgcttccttggctgcttcgggggggccaaggagcgccgccgccgccgccgcaagcggtcgccgtcacagtcccccaacggccgtgctcgggccttgctgcgggttacgccgaacaaggttgatctggatggggaggccgtctccgccgccgcgccgctactagcgacgctcctcgagttgagggactccacggacgacatgtgcctggccctcgtgaagaagaaggtgacattcgaccccaacgtcaccacattcgaggcggccccgatcccggaggacgacggcgaggaagccgatccggaggatggtggggatagcagggagaaggggtggatgctggcgtcggagtgcgccaagtccgaggccttccccttgaaccacaggtacagcaagctcgccggcagcggcaacgtcagcgactacgaggacgccgaggaggacgaattcgaagacgaggaggaggaggacgacgacgacgaggaggatgaggaaggggaagacgggctcgatgagtgcgcgatcgacgacgacgaagacgagcatggcctcctcggcatcggacgcagcgaggaggatgcgtgcgagtcgctcttcctgtttccgtttgggaagatgtccagggattcgggcggccaggtagcggcgcccgtcgcgcccccggtgctcggctcggtagagaacttcaacctcacccggtggaaggaacccatggctgccgccgcgcccaagacctcggacaaggagaacgtcactgtggggcgggagaaccggatggacttcctcgcggaaccacccgcggtggcggccaacaggaaggaggagcagatgccggcggtctcggacaacagatacacccccagcacgccgagcaagcaggaggcctccgtggacgccagcctctccacgtggctcggttcctcggggacgcccgagagcaactcggtccggtcctactcgccgatcagccgggacgaacggccgatcctcggcgccctcaccgtggaggacatcaaggtgtcgtccgccaactcaacgcctcggaggtcgaggtccccgagcccgagtcccgatgacatgccgatcctggggacggtgggggcttactggaactgcagtgccaaggagtctgatccggtcacgagaggagggtttatgaggaccagaaccagatttggccaggtcaggtgagcagctttgtctcggtagtctgacttgactgttgtaatccatgtttgcttttcctagtataatcttctgttgaaataatggaacacctcccgctaggaggagagagagagggggggagggtaccgaacctgggtgggaatgcaaagatataaaagtctgtgtgagaatgcgagatcgtgaaaccagatagatttgtgtgatcatattctttcatatgtttgtaaacattacattgccatccatattctaggatggtgttttttttttgtagcttcaatgtcattctttttgtcaatatgatcgattgtttttgtgcaaaaaaaaaaaaaaaaaa

SEQ ID NO: 23707 - protein, 397 aa, Zea mays
  misc_feature: Ceres CLONE 1394116
MGCFLGCFGGAKERRRRRRKRSPSQSPNGRARALLRVTPNKVDLDGEAVSAAAPLLATLLELRDSTDDMCLALVKKKVTFDPNVTTFEAAPIPEDDGEEADPEDGGDSREKGWMLASECAKSEAFPLNHRYSKLAGSGNVSDYEDAEEDEFEDEEEEDDDDEEDEEGEDGLDECAIDDDEDEHGLLGIGRSEEDACESLFLFPFGKMSRDSGGQVAAPVAPPVLGSVENFNLTRWKEPMAAAAPKTSDKENVTVGRENRMDFLAEPPAVAANRKEEQMPAVSDNRYTPSTPSKQEASVDASLSTWLGSSGTPESNSVRSYSPISRDERPILGALTVEDIKVSSANSTPRRSRSPSPSPDDMPILGTVGAYWNCSAKESDPVTRGGFMRTRTRFGQVR

SEQ ID NO: 23708 - DNA, 650 bp, Zea mays
  misc_feature: Ceres CLONE 1394122-F
  misc_feature: Encodes the peptide sequence at SEQ ID NO. 23709
ggagctccccgcggtggcggccgctctagaactagtggatcccccgggctgcaggaattcgcacgagaccattacctagaacatcctaatcgaaaaacttggcgctagggtttcccccctctcatttcccctcctcctcccgctccccctggctccccaagcctcgacgcccggctagggttttgcctccttcccgccgccgctgtttcagcgagcgagaccgaggggtagagaaagagcggtgcttagccacccatgtcgctgcgtccgagcgagcgggtcgaggtacggcggaaccgctacaaggtggcggttgacgcggaggaggggcggcggcggcgcgaggacaatatggtggagatccgcaagagccgccgtgaggagagcctcctcaagaggcgccgtgaggggctccaagcccaggtccctgcccctccctccgtggtcgagaagaagcttgaaagcctctcagctatggttagtggggtttattcggatgataataaccttcagcttgaggccaccacacagttccgcaaattgctctctatagagaggagtccccccatcgaagaagttatcaaaacaggtgtagttccaagatttgtgcagtctctcaccagagaggatttcccccagctgcagtttga

SEQ ID NO: 23709 - protein, 131 aa, Zea mays
  misc_feature: Ceres CLONE 1394122-F
  misc_feature (4)..(92): Pfam Name: IBB Pfam Description: Importin beta binding domain
MSLRPSERVEVRRNRYKVAVDAEEGRRRREDNMVEIRKSRREESLLKRRREGLQAQVPAPPSVVEKKLESLSAMVSGVYSDDNNLQLEATTQFRKLLSIERSPPIEEVIKTGVVPRFVQSLTREDFPQLQF

SEQ ID NO: 23710 - DNA, 682 bp, Zea mays
  misc_feature: Ceres CLONE 1394126-F
  misc_feature: Encodes the peptide sequence at SEQ ID NO. 23711
  misc_feature (421)..(421): n is a, c, t, g, unknown, or other
  misc_feature (481)..(481): n is a, c, t, g, unknown, or other
  misc_feature (538)..(538): n is a, c, t, g, unknown, or other
  misc_feature (582)..(582): n is a, c, t, g, unknown, or other
  misc_feature (583)..(583): n is a, c, t, g, unknown, or other
tggagctccccgcggtggcggccgctctagaactagtggatcccccgggctgcaggaattcgcacgagaccattacctagaacatcctaatcgaaaaaccctgtccctttccccgcgccaccgccctctccgtcgccgccgttcgaccgagcgccgctcacccaccccacgagctcccgcgcgggttcatgtccatctctccacacgaacgcaccggaggagcctattacccgcgcccgcacaaccctagccctagtccccaacatggcagcgacagacgccgccacggccgccgctcccctccggcatccgtctcgccacccggcgccgctgcggaagctagcggacgggcggggtcggctcgagctcccacccagtgggttccagctattggagaatctattaatgctcccgaaaaggntagttggatttataataatctgggggaagagaatgatacatggtacacaagagggttggnaatggtttcagaatgccactcttcagaacaggggggaatttccggtttgcctgtaanataatttttgggctcaggttgggtcatatccctgagagaactannaatggggggaatccccttcagggtgaccattttgggcttcagggtccaactgggacgggggtaatgggaactcagaatagctggcagggaaaaacaaga

SEQ ID NO: 23711 - protein, 116 aa, Zea mays
  misc_feature: Ceres CLONE 1394126-F
  misc_feature (78)..(78): Xaa is any aa, unknown, or other
  misc_feature (98)..(98): Xaa is any aa, unknown, or other
MSISPHERTGGAYYPRPHNPSPSPQHGSDRRRHGRRSPPASVSPPGAAAEASGRAGSARAPTQWVPAIGESINAPEKXSWIYNNLGEENDTWYTRGLXMVSECHSSEQGGISGLPV

SEQ ID NO: 23712 - DNA, 654 bp, Zea mays
  misc_feature: Ceres CLONE 1394132-F
  misc_feature: Translation starting site: 165
  misc_feature (319)..(319): n is a, c, t, g, unknown, or other
  misc_feature (320)..(320): n is a, c, t, g, unknown, or other
tggagctccccgcggtggcggccgctctagaactagtggatcccccgggctgcaggaattcgcacgagaccattacctagaacatctaatcgaaaactcgaaccctctcgcgcttggcttgctttcactctccagggccccactcccacctcgccgccgcagccatggcgatcacagcgccaactcccgacatcctcggcgagcgccagtccggccaggacgtccgcacgcagaacgtgatggcttggcggggcggtggccaacatcgtcaaatcctccgctcggccccgttggtctcgacaagatgctagtggacgannattggtgatgttacaatcactaatgatggagcaccatacttagcaatggttggaagttgagcatccagccgccaagggttcttgttgagttggctgagctccaagatcgtgagggtaggagatggaaacttacttccgttgtcatcataggcggcagagttactcaagagaggcaatgatcttgtgaagaataagatccatcccacctctataatcagtggctacaggcttgctatgcgtgaagcctgcaaatatgtttgagaaaaagtagcaggcaagggttgacaacttggaaaagatcccttatcactctgcaaaactagcatgtcttcaa

SEQ ID NO: 23713 - DNA, 672 bp, Zea mays
  misc_feature: Ceres CLONE 1394133-F
  misc_feature: Encodes the peptide sequence at SEQ ID NO. 23714
  misc_feature (394)..(394): n is a, c, t, g, unknown, or other
  misc_feature (425)..(425): n is a, c, t, g, unknown, or other
  misc_feature (445)..(445): n is a, c, t, g, unknown, or other
  misc_feature (603)..(603): n is a, c, t, g, unknown, or other
  misc_feature (604)..(604): n is a, c, t, g, unknown, or other
  misc_feature (634)..(634): n is a, c, t, g, unknown, or other
tggagctccccgcggtggcggccgctctagaactagtggatcccccgggctgcaggaattcgcacgagaccattacctagaacatcctaatcgaaaaaccataggcacaggcacctctccccccctgcaagctcctccctttcgctcctcctgattcttgctctgtcagcccagaggcagagcaagcaagcatcggcggccatggcggcgccaggtcgagcggcgctcctggccgccgcgctcctgttcggcactttcttcccatccgcgtcctctgcgtcctcgtaccccgcaaggattgcgggcaggctcctgtccaccacggcgtcggcagtggccaagcagctgtggtcgctcaaatcggccgccaccaagacggcgacgacggcagtgnacggggcggccccatggtgaggtacgagggnggggtacgcggtgggacacnggtgttcgacggcagcaaagcttggggatcgagccgcacggccgtcgagatcacccccgccggcaaccctcctcgtgctcgactccatcaacagcaacatctacaggggtacaggctgccgttgtcaccatatagcagaccaaggctcccttgctgtnntctccaaaaggtttatctgggccatgtggnatggaagactgcgagaaagcaaggatgaaccatccctg

SEQ ID NO: 23714 - protein, 70 aa, Zea mays
  misc_feature: Ceres CLONE 1394133-F
  misc_feature (65)..(65): Xaa is any aa, unknown, or other
MAAPGRAALLAAALLFGTFFPSASSASSYPARIAGRLLSTTASAVAKQLWSLKSAATKTATTAVXGAAPW

SEQ ID NO: 23715 - DNA, 684 bp, Zea mays
  misc_feature: Ceres CLONE 1394136-F
  misc_feature: Encodes the peptide sequence at SEQ ID NO. 23716
  misc_feature (472)..(472): n is a, c, t, g, unknown, or other
  misc_feature (499)..(499): n is a, c, t, g, unknown, or other
  misc_feature (500)..(500): n is a, c, t, g, unknown, or other
  misc_feature (508)..(508): n is a, c, t, g, unknown, or other
aaagctggagctccccgcggtggcggccgctctagaactagtggatcccccgggctgcaggaattcgcacgagaccattacctagaacatcctaatcgaaaaatccgacccagtatccccgacaaagtcaatgcgatgcgtctcctccttgctctatcgactatcgtagccgattccccgttgcaagtaactaaaactaagtctcaagtctgcagagtaaccggagtagcatagcactagcaagcaatggccgctctcacttccgctctcctcttcgccgccctcctcgtggccgcccagtacgtgctccgcttgctccactccttcctgtgggtcccgttccgcctggaacgccgcttccggcggcagggaatccggtggccaccacgaagcctggtctccggtaacgcagccgactaccgcgacctgctagccgccgccaggtccgcgcccctctcctccttccgccacnaacggcgtcgtcgcccgcgccacgcgnncagtacgnggtcgggctggcgcggaacggcccgggcgttcctggaaaattgggttcgggcccgggcgggggggtttgttgatctccgacacggaacctccgtggaaggccgtgatgaccgactccccgggggggggctttttgaataaggggggccctccgggcggcaaaacaccccgctcgcg

SEQ ID NO: 23716 - protein, 133 aa, Zea mays
  misc_feature: Ceres CLONE 1394136-F
  misc_feature (76)..(76): Xaa is any aa, unknown, or other
  misc_feature (85)..(85): Xaa is any aa, unknown, or other
  misc_feature (88)..(88): Xaa is any aa, unknown, or other
MAALTSALLFAALLVAAQYVLRLLHSFLWVPFRLERRFRRQGIRWPPRSLVSGNAADYRDLLAAARSAPLSSFRHXRRRRPRHAXSTXSGWRGTARAFLENWVRARAGGFVDLRHGTSVEGRDDRLPGGGLFE

SEQ ID NO: 23717 - DNA, 669 bp, Zea mays
  misc_feature: Ceres CLONE 1394137-F
  misc_feature (320)..(320): n is a, c, t, g, unknown, or other
  misc_feature (544)..(544): n is a, c, t, g, unknown, or other
  misc_feature (579)..(579): n is a, c, t, g, unknown, or other
  misc_feature (639)..(639): n is a, c, t, g, unknown, or other
  misc_feature (653)..(653): n is a, c, t, g, unknown, or other
  misc_feature (654)..(654): n is a, c, t, g, unknown, or other
aaagctggagctccccgcggtggcggccgctctagaactagtggatcccccgggctgcaggaattcgcacgagaccattacctagaacatcctaatcgaaaaatctcccataatattttcagcattcaaaaacacaccaagcgaagcgcactagcaacgacctaacaccaatggctactaagatattagccctccttgcgcttcttgcccttttagtgagcgcaacaaatgcgttcattattccacagtgctcacttgctcctagtgccagtattccacagttcctcccaccagttacttcaatgggcttcgaacatccngccgtgcaagcctacaggctacaactagcgcttgcggcgagcgccttacaacaaccaattgcccaattgcaacaacaatccttggcacatctaaccctacaaaccattgcaacgcaacaacaacaacaacagtttctgccatcactgagcccacctagccgtggtgaaccctgtcacctacttgcaacagcagctgcttgcatccaacccacttggctctgggnaacgtagctgcataccagcaacaacaacagctgcnacaggtttatgcccagtgctcagtcactaagccatgggggaaccctgccgtctacctacnactactttcactgnnccccggtttgggggc

SEQ ID NO: 23718 - DNA, 667 bp, Zea mays
  misc_feature: Ceres CLONE 1394141-F
  misc_feature: Encodes the peptide sequence at SEQ ID NO. 23719
  misc_feature (376)..(376): n is a, c, t, g, unknown, or other
  misc_feature (384)..(384): n is a, c, t, g, unknown, or other
  misc_feature (385)..(385): n is a, c, t, g, unknown, or other
  misc_feature (400)..(400): n is a, c, t, g, unknown, or other
  misc_feature (513)..(513): n is a, c, t, g, unknown, or other
  misc_feature (567)..(567): n is a, c, t, g, unknown, or other
  misc_feature (571)..(571): n is a, c, t, g, unknown, or other
  misc_feature (578)..(578): n is a, c, t, g, unknown, or other
  misc_feature (601)..(601): n is a, c, t, g, unknown, or other
  misc_feature (620)..(620): n is a, c, t, g, unknown, or other
gctggagctccccgcggtggcggccgctctagaactagtggatcccccgggctgcaggaattcgcacgagaccattacctagaacatcctaatcgaaaaaatcaactcgtttctctccgattgctcctccgagtccgagactccgttctctcccgcatccaccgccgtctcatccccaatccgagcaacgcctcccctcgcctccaaaaccctacccctcctgtcaccggcgggggcatgaaccggtgatcgcttacctggtctcgtctgtctgcgcacgcgcgaggtcagtgagtgagcattgcggtggtccgatcgcccgcggggggccatggcgtctggtggcgggatcgggcgggggcaaagcgcggggggnccgggggnnttgaagacttacttncagacccccgaggggcggcacaagctgcagtacgagaagacgcactccccccgccgtcgtgcactacaacccacacggcaagaccgtcgccccagatgacggtggcatatttngagggagaagcagcaaggccagggttccacgccttcacaccaagtgctggtaangggnaatgcgntctgcagctgcgagactgctggnaactgggaatggtagccgnacacttaacttcggaagcagggacccaccagggctgtctcagagcag

SEQ ID NO: 23719 - protein, 55 aa, Zea mays
  misc_feature: Ceres CLONE 1394141-F
  misc_feature (18)..(18): Xaa is any aa, unknown, or other
  misc_feature (23)..(23): Xaa is any aa, unknown, or other
MASGGGIGRGQSAGGPGXLKTYXQTPEGRHKLQYEKTHSPRRRALQPTRQDRRPR

SEQ ID NO: 23720 - DNA, 702 bp, Zea mays
  misc_feature: Ceres CLONE 1394143-F
  misc_feature: Encodes the peptide sequence at SEQ ID NO. 23721
  misc_feature (371)..(371): n is a, c, t, g, unknown, or other
  misc_feature (391)..(391): n is a, c, t, g, unknown, or other
  misc_feature (402)..(402): n is a, c, t, g, unknown, or other
  misc_feature (435)..(435): n is a, c, t, g, unknown, or other
  misc_feature (446)..(446): n is a, c, t, g, unknown, or other
  misc_feature (457)..(457): n is a, c, t, g, unknown, or other
  misc_feature (466)..(466): n is a, c, t, g, unknown, or other
  misc_feature (467)..(467): n is a, c, t, g, unknown, or other
  misc_feature (521)..(521): n is a, c, t, g, unknown, or other
  misc_feature (596)..(596): n is a, c, t, g, unknown, or other
  misc_feature (597)..(597): n is a, c, t, g, unknown, or other
  misc_feature (619)..(619): n is a, c, t, g, unknown, or other
  misc_feature (666)..(666): n is a, c, t, g, unknown, or other
aaagctggagctccccgcggtggcggccgctctagaactagtggatcccccgggctgcaggaattcgcacgagaccattacctagaacatcctaatcgaaaacatagagatagagatagacagctagcttcatcagtaggatgggcagcgacgaggaagcggcgctgctggtgccggcggtggaggagggttgccccgggtgcgtgatggagcggcggaaggcgagcagcaacggcaggatcccccacagggagctgttcttcgtcgccgccacctccctcgcctcagctttaccgatcacgtgcctcttccccttcttgtatttcatggtaagggacttccgcgtcgctgaaacagaggaagacatcggnattctatggctggttttctntgctgcgtcgntacatgggtggggcagaggcttctcttccatcntttctggggcngtcatcgcagnaccggcgtnntggacggaagcctgggtcatcacgttttcgataacctggtccggtggtcgtatnccagcggccgctggtttggcttggagcacgaccgtacttgggatgggcgatcgcccacgagggctcggtgctggnngcgctctcaacggcctgctcgncccggataaaggggtaactggggcgttggaagtttgccagacccagncaccaggcgcttgggactctcgcttgtgaacacgga

SEQ ID NO: 23721 - protein, 184 aa, Zea mays
  misc_feature: Ceres CLONE 1394143-F
  misc_feature (84)..(84): Xaa is any aa, unknown, or other
  misc_feature (88)..(88): Xaa is any aa, unknown, or other
  misc_feature (99)..(99): Xaa is any aa, unknown, or other
  misc_feature (106)..(106): Xaa is any aa, unknown, or other
  misc_feature (109)..(109): Xaa is any aa, unknown, or other
  misc_feature (127)..(127): Xaa is any aa, unknown, or other
  misc_feature (153)..(153): Xaa is any aa, unknown, or other
  misc_feature (160)..(160): Xaa is any aa, unknown, or other
  misc_feature (176)..(176): Xaa is any aa, unknown, or other
MGSDEEAALLVPAVEEGCPGCVMERRKASSNGRIPHRELFFVAATSLASALPITCLFPFLYFMVRDFRVAETEEDIGILWLVFXAASXHGWGRGFSSIXSGAVIAXPAXWTEAWVITFSITWSGGRXPAAAGLAWSTTVLGMGDRPRGLGAGXALNGLLXPDKGVTGALEVCQTQXPGAWDSRL

SEQ ID NO: 23722 - DNA, 629 bp, Zea mays
  misc_feature: Ceres CLONE 1394145-F
  misc_feature: Encodes the peptide sequence at SEQ ID NO. 23723
  misc_feature (495)..(495): n is a, c, t, g, unknown, or other
  misc_feature (577)..(577): n is a, c, t, g, unknown, or other
tggagctccccgcggtggcggccgctctagaactagtggatcccccgggctgcaggaattcgcacgagaccattacctagaacatccaatcgaaaaatcgatctattctcgtctgaagcaattcgcccctgtcgtgagcagaaccctacagctcgtattcgcctcatctcgcagcagcagcagaagaacaagggtatggcgaaggatgggggtcccgactggaacggcctgctcaagtggagcctcgcccacggcgacggcaccaacccgccgcgtgctctcagcgaggaagacagaagatggttcatggatgctatgcaagccaacacggtagatgttgtgaagaggatgaaggagatcactcaggtgatgaaaactccagaagatgtcttgcagtctcagggcgtgacccctgagaacatcgaagatatgttggatgagctacaggagcatgttgaatccattgacatggcaaatgatctacattctattggntgggctggatcctctactttggtacttgaaaaattcagatgctggcatccgagcaagggcagcagaaagtggtagtacattngtgcagaataatccccagagtcagcaaacttgtcatggaaatccagtggcta

SEQ ID NO: 23723 - protein, 124 aa, Zea mays
  misc_feature: Ceres CLONE 1394145-F
MAKDGGPDWNGLLKWSLAHGDGTNPPRALSEEDRRWFMDAMQANTVDVVKRMKEITQVMKTPEDVLQSQGVTPENIEDMLDELQEHVESIDMANDLHSIGWAGSSTLVLEKFRCWHPSKGSRKW

SEQ ID NO: 23724 - DNA, 841 bp, Zea mays
  misc_feature: Ceres CLONE 1394146-F
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
ggggggtgcccnnnnncnnnntccccgtcctcccccnnnaaccaaccaacacaaagatggagctccaccgcggtggcggccgctctagaatagtggatcccccgggctgcaggaattcgcacgagaccattacctagaacatcctaatcgaaaaatagggttctaagcctcggccgtttcttcgtatccacagctcccgccgccgcggaccagggcgtcactctaccgggttccggcgtctccccgcacccggagcgcggcatccgtggcggagcagaccggagcgggctttcttgaggggagccggggtgtttctctgttccaacagccccaccacggtaaccaaacctgggaggggcaggaaacagattctgtgaggaccattgcgccttgggtttcaagacccccaagggaacgccatttgaaggaaccctaacattgaataggagggggtcccattcacccggcaactggggcctaataagggggctcggcattcattcgcccgggtaccgttggcccccggggggctaaagcatggaaactaggcaccccttccctctggttccgtaagggaaacttattctttaccccttctccgtccagcgaagtcccccgagagggtcattgccggaagggggacctcttcccaaggctttccgcctgggggcaccatttttcaccacagtgcttccccgtcgtcccgacggaacgggagataccttggccgcctctttttggcgccaagtcgcccagggccccgctcggccgaaaggacctggtccagcgtcccagtggggggcgccataggcttatctcccctggcacggcttcccaagcg

SEQ ID NO: 23725 - DNA, 688 bp, Zea mays
  misc_feature: Ceres CLONE 1394147-F
  misc_feature (286)..(286): n is a, c, t, g, unknown, or other
  misc_feature (493)..(493): n is a, c, t, g, unknown, or other
  misc_feature (494)..(494): n is a, c, t, g, unknown, or other
  misc_feature (551)..(551): n is a, c, t, g, unknown, or other
  misc_feature (552)..(552): n is a, c, t, g, unknown, or other
  misc_feature (573)..(573): n is a, c, t, g, unknown, or other
  misc_feature (618)..(618): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
ctggagctccccgcggtggcggccgctctagaactagtggatcccccgggctgcaggaattcgcacgagaccattacctagaacatcctaatcaaaaagaggcaaagccgttagccaatctgctgttgcgtgttgcaccgatcaacgtcggttcccagcgcttgctcgtcaagcgtgtcctgctgctgttctctgctcctgcttgccgcgagagctcctctcgctcatctacccaaggtccgacagcaacgacttcgtcgagctgctatgggagaacggccaggcnggtggtgcacgggaggaggaagcagcatccccaggccgccttcccgcccttcacctgcggcgcggccagcagcagtagagctcaagaaaaccagccgggtactaccgagcggggtctcgcttgttcaagacgggaggcctcttcgccgacttctcgtccggcctagacgccgcccgtggggcaacggtggacctttgacgacaccgnntgccctggatccactgccccatccggtcggaggaagacagcgccgcacccgcactgnncctttgcgcggagggctcaangcccagatttttcttctcggagctccatgggcagcggcgtttagnaaaaggggggggggggnnnaaagacaaaacctcagccctcttggccaccacccggtccagcacaacagaa

SEQ ID NO: 23726 - DNA, 681 bp, Zea mays
  misc_feature: Ceres CLONE 1394149-F
  misc_feature: Encodes the peptide sequence at SEQ ID NO. 23727
  misc_feature (223)..(223): n is a, c, t, g, unknown, or other
  misc_feature (333)..(333): n is a, c, t, g, unknown, or other
  misc_feature (681)..(681): n is a, c, t, g, unknown, or other
ggagctccccgcggtggcggccgctctagaatagtggatcccccgggctgcaggaattcgcacgagaccattacctagaacatcctaatcgaaaaagcacctccattcccagccacgagacgacgaaaccctagcctccctccccctctctcaccaggccaccacctcgccggaacccggcgcctcgaaggagcacgggatcatcggccgccgtcggccgcgnctgcggaggagcggtgtaagatgttgaacggcggcggcggcggccagaagaagcggacacgaagatcgagccctatcggcaccgcgtaaagaccgaccccaagttcttcnacaagtcgtggcggaagctccatgacgccatccgcgagatctacaagcacaacgccagcggtctctccttcgaggagctctacaggaatgctaataacatggtattgaaccaggttggtcctcagctctatgagaaactcacggaaaacaggaaagagcatcttgaagagaggcgcacatgtatagaggctgctcaagggggtttgttccctggaaagagtggccgcggaaaagggaaaggcccataacaaggggattggacaagggaataaaaagaaatcccggaagggaataggggacagggacctaaaaatttccccaattaataaaagaagaaaacccctgtcn

SEQ ID NO: 23727 - protein, 49 aa, Zea mays
  misc_feature: Ceres CLONE 1394149-F
MVLNQVGPQLYEKLTENRKEHLEERRTCIEAAQGGLFPGKSGRGKGKGP

SEQ ID NO: 23728 - DNA, 657 bp, Zea mays
  misc_feature: Ceres CLONE 1394150-F
  misc_feature: Encodes the peptide sequence at SEQ ID NO. 23729
  misc_feature (383)..(383): n is a, c, t, g, unknown, or other
  misc_feature (409)..(409): n is a, c, t, g, unknown, or other
  misc_feature (420)..(420): n is a, c, t, g, unknown, or other
  misc_feature (424)..(424): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (499)..(499): n is a, c, t, g, unknown, or other
  misc_feature (502)..(502): n is a, c, t, g, unknown, or other
tccccgcggtggcggccgctctagaactagtggatcccccgggctgcaggaattcgcacgagaccattacctagaacatcctaatcgaaaagacttatttcgagagaggagtacgttttaagccggtgctccatgtgtcccgtcccgtgtcccgtcccgtctacgttttaagctgcgagcgagatctgctttcacagcgtggctgaccagcagatccgtcgttgccggaacccacgctcgccggctgcgaatgcatctgtagcctgctcttcgtccacacggacaattggacgagctagactctgcgtcgccggcgatggggtgctccttctcagggctgaacgcactgtacgacaccgtcggcggtcgggggtggtgacgtnctgggttaacgactaccacttccggntgctccgcagnctcnggcgatgccggccctggggnnnctcgtcggtcttctcccgtcagggatgtcgtcgccgccgcaaccgcctccganggnacgggttgggtcagagcccggcgcctcagggattcgcgggaagaaagggatcgacccatcacacatctcagctgacgggacatatgttctcaagaaagttcttgttcagagtgatcagcacttagagcttgttcagcaggaagatccgagtgtcc

SEQ ID NO: 23729 - protein, 76 aa, Zea mays
  misc_feature: Ceres CLONE 1394150-F
  misc_feature (6)..(6): Xaa is any aa, unknown, or other
  misc_feature (24)..(24): Xaa is any aa, unknown, or other
  misc_feature (25)..(25): Xaa is any aa, unknown, or other
MPALGXLVGLLPSGMSSPPQPPPXXRVGSEPGASGIRGKKGIDPSHISADGTYVLKKVLVQSDQHLELVQQEDPSV

SEQ ID NO: 23730 - DNA, 620 bp, Zea mays
  misc_feature: Ceres CLONE 1394151-F
  misc_feature: Encodes the peptide sequence at SEQ ID NO. 23731
tggagctccccgcggtggcggccgctctagaactagtggatcccccgggctgcaggaattcgcacgagaccattacctagaacatcctaatcgaaaacccccacagaaccgtctccccagcccggcgcctcacggtcgcaatttattgcttgcgcaccgcctcgccgctttggcgtggggcgtttgcctgtgtggcgctgggcatgtgccgtgcccgtggcttgcttcgtcgtgctcactagtcacgagagagggaggaggctctgcttctgctgccgcttcttcttctcctgctgctcttccggagataagcagggggccgggacagctgactagctgagaggcatggggatggacgccggcggcggcaagctgccgtacagctacgccggccagcaggacggcggtaagctggtgaagagcgtcagccgcgtggagccgcgcaggttcggtctgggcctcgtggcgggcttcctcgtcgtcacctgcgcctacttctccaccgccaagttcgacgccatccagatcgccatgaccagccgacccgtctccagcaatgcggctggcgtcggagtcggctcgctgggagtggacgccgccgccgccgacacctccaaggc

SEQ ID NO: 23731 - protein, 91 aa, Zea mays
  misc_feature: Ceres CLONE 1394151-F
MGMDAGGGKLPYSYAGQQDGGKLVKSVSRVEPRRFGLGLVAGFLVVTCAYFSTAKFDAIQIAMTSRPVSSNAAGVGVGSLGVDAAAADTSK

SEQ ID NO: 23732 - DNA, 627 bp, Zea mays
  misc_feature: Ceres CLONE 1394152-F
  misc_feature (206)..(206): n is a, c, t, g, unknown, or other
  misc_feature (208)..(208): n is a, c, t, g, unknown, or other
  misc_feature (277)..(277): n is a, c, t, g, unknown, or other
  misc_feature (278)..(278): n is a, c, t, g, unknown, or other
  misc_feature (339)..(339): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
aagctggagctccccgcggtggcggccgctctagaactagtggatcccccgggctgcaggaattcgcacgagaccattacctagaacatcctaatcaaaaatcgcacatattattgagaccaactagcaacatagaaagacaatagtgtaccaacaatggcagccaaaaattttgcctccttatgctccttggtctttctgcaagngntgctacggcgaccattttcccgcatgctcgcaagctctataattctcttcttcccccgtactctacagnngtgtcttcggatgggaaacccactcttctccccctacgatcaacaggggatcgagggggantaagatttaaaaactgttgggcggaaactaagccttttaaaaagtacccttggggtttttggggaaaaaaaaggggaaaaaaacaaaatttggggaaaacttttgttcccaccccaaaaannnnttctctcccccccaaaggggggaagtctttttttagaaaaaaaaaaaatatttgggggggggggtgccccccccaattttttttcccaaaaaaaaaaaaaaaccctctctttttaaaaaaaaaaaaaccaccgccccccggggggggggccccccctttaccaa

SEQ ID NO: 23733 - DNA, 648 bp, Zea mays
  misc_feature: Ceres CLONE 1394157-F
  misc_feature: Encodes the peptide sequence at SEQ ID NO. 23734
  misc_feature (380)..(380): n is a, c, t, g, unknown, or other
  misc_feature (648)..(648): n is a, c, t, g, unknown, or other
tggagctccccgcggtggcggccgctctagaactagtggatcccccgggctgcaggaattcgcacgagaccattacctagaacatcctaatctaaaactcttcgtcgccctatcttataatcgcatttcgaaatccccaaacggaggactcgccactcttccgaacctgaacaatcaccaccgttattaagaagatgatgcgctgcgctgcaacggacggtggctgcgtcgcttcgtggagcggtgattggagattgccggcgcacaacccctgcagtgtgcggatgccgacgggcaacgatggatgttgcgccggcctgaggtcgcggacggtgtatctcgtcgacctcgagatgaccaacctgcgcggcgaagtacgnggagctcttccgcgcgagcccgcgctacgggcgcttgcaagccacgccggtagttgaccctgaagatattccattggagaagctcaagttagatcctcaggactgttctgacatatgctgccgttgcttgattggggctcattcgggttgctcaccatctgggagggatcaaggcctactttgaatacctccggaagaatcttggaattgttgaaagggtgacctggcagggttgccggaaaagcccacccttgccggaagtacctcn

SEQ ID NO: 23734 - protein, 80 aa, Zea mays
  misc_feature: Ceres CLONE 1394157-F
MMRCAATDGGCVASWSGDWRLPAHNPCSVRMPTGNDGCCAGLRSRTVYLVDLEMTNLRGEVRGALPREPALRALASHAGS

SEQ ID NO: 23735 - DNA, 687 bp, Zea mays
  misc_feature: Ceres CLONE 1394158-R
  misc_feature (262)..(262): n is a, c, t, g, unknown, or other
  misc_feature (353)..(353): n is a, c, t, g, unknown, or other
acaattggggaccgggccccccctcgaggtcgacggtatcgataagcttttttttttttttttttagtaaagcgcgtgtttataaatttatacagcataccacagtagtacatcacacgcatacatacatacatacttattcatgaatcatgaaatagaatggagtaaaccataccaaaaatctttccactgaacatacaaaccctccctacgaccacgagaggggagggggaatatccagtggaaaaacacacgcacacanacacaggacaggtcggagacaaatgaaaacgtaccggaacgtgcaccgtttgttgcgcgaacacaagacgcggccacgcggaccaacaaanctgctgcgagagtgcatgcgcatctccagcagcgaaacaatctcgcgaacgaacggccgaccggccggcctatgtaacaatccctagcttaacttggtcactctggtggtggtggtggtggtggtaccagtgccagtactacgtagtagagcagtgtaattaagccgagcaattaaccgacggttggattattctttcccttaacctgaagctacgacgacgcgcgcacgaaagaatctagtctctactgatcgatcacatctcctctcctgcttgacgaccgtcccttccttcctgttcctggccaaacccaaccagggttcccccccttggg

SEQ ID NO: 23736 - DNA, 656 bp, Zea mays
  misc_feature: Ceres CLONE 1394159-F
aagctggagctcaccgcggtggcggccgctctagaactagtggatcccccgggctgcaggaattcgcacgagaccattacctagaacatcctaatcgaaaaacacacccggaccccggttctgcgtttgtccctgcggtctgtggccctgcctcttctcgtatcacgttcccctcgacgcgagaggtctctctctctctctctctcctctgtggtgacgactgggcgcccgcacccctggcagccgacgccgaccagtacccgtgcggcccttcggcaggtcttcttcgcgctcttcgacggagacgagccgcaccaggtgtacaggtacacacccactcgcagaccttaactgcgcccacaccagcgactggctgtcctgctgctttctgctcatcatgctgccggagcattgatgtgaactttaggatctcggtacgaccactgcgatgaactaagtgtgctcagtccatgttgcaaggacagcgcatgatactgcgattagactcggcaacgtcatcaaggactgcccctgatttgacccgggctgaagaggatccttctgagaatattatatgggggataaacgcctgcatggagaggggccccacaacgaagacaaggtcctggttctgatcaatagccccccgagaacaa

SEQ ID NO: 23737 - DNA, 672 bp, Zea mays
  misc_feature: Ceres CLONE 1394164-F
  misc_feature: Encodes the peptide sequence at SEQ ID NO. 23738
  misc_feature (337)..(337): n is a, c, t, g, unknown, or other
  misc_feature (387)..(387): n is a, c, t, g, unknown, or other
  misc_feature (419)..(419): n is a, c, t, g, unknown, or other
  misc_feature (489)..(489): n is a, c, t, g, unknown, or other
  misc_feature (491)..(491): n is a, c, t, g, unknown, or other
  misc_feature (541)..(541): n is a, c, t, g, unknown, or other
  misc_feature (562)..(562): n is a, c, t, g, unknown, or other
  misc_feature (572)..(572): n is a, c, t, g, unknown, or other
  misc_feature (608)..(608): n is a, c, t, g, unknown, or other
  misc_feature (672)..(672): n is a, c, t, g, unknown, or other
aagctggagctccccgcggtggcggccgctctagaactagtggatcccccgggctgcaggaattcgcacgagaccattacctagaacatcctaatcaaaaaaggtcgagcctagggttagggtttcgtccctccggccccgattcgaaccaatccgcctcggcctccgccgcgccatggccgccggctccatcgtggtggacttcccttccatgggcgccgccctctgcttccccagcctcgattcactcctccgcgactccgcctcgggcttcctcgctgccgtctccaacgccccagcccccggcgcagccgacctcaccaactttcaccgcgtncttctcgcgcgtcctcagcgcctacccggaccacgggctcgagaggtggntctggttcttctccgcgctctccttccacgancggtcccgacgacctccgctccctgctccagctcctctccgccttcaccgcctcctcgcccggcaccggncnagccgcttgccttctcgccccctggtcgtttccgagctcttccagccganaagcccgcgcagggagacggnaccctcctcngtggaagccgtcctcagctacatcagcatctgcagnaaccgctctgcccctcttttcgaccgtgggcgcccaccgcagacgctgtgagcctgctgcccgn

SEQ ID NO: 23738 - protein, 165 aa, Zea mays
  misc_feature: Ceres CLONE 1394164-F
  misc_feature (71)..(71): Xaa is any aa, unknown, or other
  misc_feature (82)..(82): Xaa is any aa, unknown, or other
  misc_feature (105)..(105): Xaa is any aa, unknown, or other
  misc_feature (106)..(106): Xaa is any aa, unknown, or other
  misc_feature (122)..(122): Xaa is any aa, unknown, or other
  misc_feature (133)..(133): Xaa is any aa, unknown, or other
  misc_feature (145)..(145): Xaa is any aa, unknown, or other
MAAGSIVVDFPSMGAALCFPSLDSLLRDSASGFLAAVSNAPAPGAADLTNFHRVLLARPQRLPGPRAREVXLVLLRALLPRXVPTTSAPCSSSSPPSPPPRPAPXXPLAFSPPGRFRALPAXKPAQGDGTLLXGSRPQLHQHLQXPLCPSFRPWAPTADAVSLLP

SEQ ID NO: 23739 - DNA, 672 bp, Zea mays
  misc_feature: Ceres CLONE 1394165-F
  misc_feature: Encodes the peptide sequence at SEQ ID NO. 23740
  misc_feature (322)..(322): n is a, c, t, g, unknown, or other
  misc_feature (375)..(375): n is a, c, t, g, unknown, or other
  misc_feature (458)..(458): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (569)..(569): n is a, c, t, g, unknown, or other
  misc_feature (607)..(607): n is a, c, t, g, unknown, or other
tccccgcggtggcggccgctctagaactagtggatcccccgggctgcaggaattcgcacgagaccattacctagaacatcctaatcgaaaaaaaaggttcgagacgcgcaccgccagccgatacgaatccgacgagctcgatcgctccacttccccgatcgcacgccaatcagcaccagccaccgtggcgatgacggaggaggcggaggcgaaggcgaagggcaacgcggcgttcgcggccggccgtttcgaggaggctgtccagcacttcagcgacgccatcgcgctcgcgcccgacaaccacgtcctctactccaaccgnctcggcggcgtacgcgtcgctctggcgctacgcggaggcgctagatgacgccnagcggaccgtggcgctgaaagccggactgggccaagggctactcccgcctcggcgccgcgaccttggggcctcggtgacgggnccaagggccgtcgaggcttacgaagaaagggcttgcgctcgagccgtccaatgaggcgctcaaatccgggctcgcacagggcgcgccagtccgcatgnnngccgagaaaantccgggtgggcttcccgggcctggacgccgtttgggcngaatgttcccagggccctgagcttatggaagacaagggtccgcgggcgaccccccaccagcgcgg

SEQ ID NO: 23740 - protein, 59 aa, Zea mays
  misc_feature: Ceres CLONE 1394165-F
  misc_feature (4)..(37): Pfam Name: TPR_2 Pfam Description: Tetratricopeptide repeat
MTEEAEAKAKGNAAFAAGRFEEAVQHFSDAIALAPDNHVLYSNRLGGVRVALALRGGAR

SEQ ID NO: 23741 - DNA, 658 bp, Zea mays
  misc_feature: Ceres CLONE 1394166-F
  misc_feature: Encodes the peptide sequence at SEQ ID NO. 23742
  misc_feature (325)..(325): n is a, c, t, g, unknown, or other
  misc_feature (436)..(436): n is a, c, t, g, unknown, or other
  misc_feature (490)..(490): n is a, c, t, g, unknown, or other
  misc_feature (496)..(496): n is a, c, t, g, unknown, or other
  misc_feature (522)..(522): n is a, c, t, g, unknown, or other
  misc_feature (559)..(559): n is a, c, t, g, unknown, or other
  misc_feature (560)..(560): n is a, c, t, g, unknown, or other
tggagctccccgcggtggcggccgctctagaactagtggatcccccgggctgcaggaattcgcacgagaccattacctagaacatcctaatcgaaaactagttttaagttaagcccccttctctctcacctcgatgcggcttgccaaccgccgatctgcccggccaaggattgttgagctcgccgcgggctaggtttccttccgtccaccatgacggggccaggctcagctccgacccaaacaccccctccagaacccaagcataacgcccgccgccccgtcctcctcctggggccgccactcctaagccgtcgccgttgccctncctcttgggcgtatccaacaacccgttgccccgccgcttcatccgccttctctttggaacaaggccctccattctccgctcctcgccacctcctgacgcagcttacgaacnaaccggcgcggacgcacaccatggttttctatggatggcccattcgctcccggnggcggntactgctcccgaggcatggtcctacngtctccgcgcttgacgcgcacgccgccgccggttggnngctgggaaaaaataatttctcgctcgcaatagcgcaccacggcgattcgaattcggcccggagtttctggctcggccttcccccgagcgatctaaggc

SEQ ID NO: 23742 - protein, 67 aa, Zea mays
  misc_feature: Ceres CLONE 1394166-F
  misc_feature (12)..(12): Xaa is any aa, unknown, or other
  misc_feature (14)..(14): Xaa is any aa, unknown, or other
  misc_feature (35)..(35): Xaa is any aa, unknown, or other
MVFYGWPIRSRXRXLLPRHGPTVSALDAHAAAGWXLGKNNFSLAIAHHGDSNSARSFWLGLPPSDLR

SEQ ID NO: 23743 - DNA, 680 bp, Zea mays
  misc_feature: Ceres CLONE 1394167-F
  misc_feature: Encodes the peptide sequence at SEQ ID NO. 23744
  misc_feature (368)..(368): n is a, c, t, g, unknown, or other
  misc_feature (509)..(509): n is a, c, t, g, unknown, or other
  misc_feature (573)..(573): n is a, c, t, g, unknown, or other
  misc_feature (574)..(574): n is a, c, t, g, unknown, or other
  misc_feature (680)..(680): n is a, c, t, g, unknown, or other
tggagctccccgcggtggcggccgctctagaactagtggatcccccgggctgcaggaattcgcacgagaccattacctagaacatcctaatcgaaaaacggatcaaaatcgaatccaacgctactgcctagggtttcctctgcatttcccctaccacaccccgcgccgcccacccatggccgccgcagacgcgtccgccgagaccgccgccatcgcgcggcgcctggcctcctgcaacaccggcacccgggagcgcgcgctccgctacctcctctccgaatttctgccggcctccgcgccgcgcctctccgccaccgacctcctcaagctctggaagggcatcttcttctgcttctggcacgccgacnagccgctctaccagagctccgtcgcctcgcctccgccgtctccgtcccgccgtcccccgacgatggtgccgccttcctcgccgcctacctcaccacgctccgccgcgagtggccccacagtcgacgtccaccgcctcgacnagttctacctcctcaaaccgccggttcctccaccacgccttcctgcttctccatgctaactctnncggcccccgagtacctttccagggggtcgtgtcccgtccttggtcagaacagggcctggctccccgggaagccccgacacgtcgccgcggcccaactgccgggggn

SEQ ID NO: 23744 - protein, 130 aa, Zea mays
  misc_feature: Ceres CLONE 1394167-F
  misc_feature (9)..(131): Pfam Name: Nop52 Pfam Description: Nucleolar protein,Nop52
  misc_feature (65)..(65): Xaa is any aa, unknown, or other
  misc_feature (112)..(112): Xaa is any aa, unknown, or other
MAAADASAETAAIARRLASCNTGTRERALRYLLSEFLPASAPRLSATDLLKLWKGIFFCFWHADXPLYQSSVASPPPSPSRRPPTMVPPSSPPTSPRSAASGPTVDVHRLDXFYLLKPPVPPPRLPASPC

SEQ ID NO: 23745 - DNA, 643 bp, Zea mays
  misc_feature: Ceres CLONE 1394170-F
  misc_feature: Translation starting site: 336
  misc_feature (180)..(180): n is a, c, t, g, unknown, or other
  misc_feature (200)..(200): n is a, c, t, g, unknown, or other
  misc_feature (302)..(302): n is a, c, t, g, unknown, or other
tccccgcggtggcggccgctctagaactagtggatcccccgggctgcaggaattcgcacgagaccattacctagaacatcctaatcgaaaaatcacttatcatccccatccgcacctctctccatctccctgctcctccgccttcttcttgatccagccaagccagggatcgccatgtcnggactcggaggagcaccacnttcgaatcgaaggccgacgccggagcgtccaagacctacccgcagcaggctggcaccgtccgtaagaacggcttcatcgtcatcaagaaccgccctgcaggnttgtggagttttctacctcaaagactggtaagcatggtcatgccaaatggcacttttggtggcataaatatattcaacgggaaaaagctccaagaatatggtcccttcgtcaaaaaaattgggaaaattccggagtgggaaaccgaactggggtatccgcttgattgaaatatcaaagggagggatttggggaccttccttacctccgaggggaaccctaaagggggtcttaaaacccccaatggaggaatccttgggggccaaaaaaaggaaaggttttaaaaggggaaaaggaccgggggaaaaaaagtttctttttctttccgaaaacaaaaacctcc

SEQ ID NO: 23746 - DNA, 665 bp, Zea mays
  misc_feature: Ceres CLONE 1394171-F
  misc_feature: Encodes the peptide sequence at SEQ ID NO. 23747
  misc_feature (429)..(429): n is a, c, t, g, unknown, or other
  misc_feature (477)..(477): n is a, c, t, g, unknown, or other
  misc_feature (481)..(481): n is a, c, t, g, unknown, or other
  misc_feature (494)..(494): n is a, c, t, g, unknown, or other
  misc_feature (498)..(498): n is a, c, t, g, unknown, or other
  misc_feature (512)..(512): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (557)..(557): n is a, c, t, g, unknown, or other
ggagctccccgcggtggcggccgctctagaactagtggatcccccgggctgcaggaattcgcacgagaccattacctagaacatcctaatcgaaaaaaagtttcgaacaaaagtccacaaatccccttcgccgtctccggcgagccccgcccctcatcgccgccgcgccaaagagacagtgagaggggggatggatcagtccatcagaaccgcatgcgagttcctctcgtcggtgctaaaccacgctgagtcctcgtcccgcgagctcgccgacgccgtctcccaacgccccgtccacctcgagatggcgaggacctcgttcctgcagaagctggagcacagggtggtaggcgtcgcccgccgacttgcagcacatcgagtccatcgccctcgacacgtcttccttcgaggagctcctcggcacttgcngtgaggcgctcaaagtctacgcgcggccacgcgacgccctcaagtcgnactncgcttcctttggntacnagcccccggagacnaaaacccggaatnnnaatggggttgggaaaaaggggaattttccnaaaaatttttaaaaccttgaataaaatgcctaaagggggggcgggtaaaggggtacgggtcgttttaacggggggttagacccccccggggtggatggtcccttttgg

SEQ ID NO: 23747 - protein, 79 aa, Zea mays
  misc_feature: Ceres CLONE 1394171-F
MDQSIRTACEFLSSVLNHAESSSRELADAVSQRPVHLEMARTSFLQKLEHRVVGVARRLAAHRVHRPRHVFLRGAPRHL

SEQ ID NO: 23748 - DNA, 632 bp, Zea mays
  misc_feature: Ceres CLONE 1394178-R
  misc_feature (632)..(632): n is a, c, t, g, unknown, or other
ccgggccccccctcgaggtcgacggtatcgataagcttttttttttttttttttggtgtgaaaaataacttgattaaaagaagctgtgtctttgacattttggttgatgctctttgaaggtgccaagatctctcagtggaggtccctgtttctgcttgcctttggacaaaggaagctggggagggagaaaaggggtgactgactcagttcctttgacacaattgacaataaacaataaaggcagccgccctatgaacttcaacttctcccaggaaaagggcctcaaggcattcacattccacaaggaaaatcgctccgatatgatctgaatcgccacggtatgatctgactactctgattgcgtacacaaagtctctgctatgaagacttcaggcttttcaggaattcaggcaccacctgaccgcagtctgcaagaagctgagccagaggttttgcaacagaagcatcagtgttacagaatatgctatgcacttcgcctccaatcacatgaagagcagccccagtgaggatctcaatgtattcgtccactgaaggaggcagatccaccaccagcacggtttcgaattcctctacatctgtcactgacatgttctcccggtctttcacaatgn

SEQ ID NO: 23749 - DNA, 651 bp, Zea mays
  misc_feature: Ceres CLONE 1394178-F
  misc_feature: Encodes the peptide sequence at SEQ ID NO. 23750
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (566)..(566): n is a, c, t, g, unknown, or other
  misc_feature (567)..(567): n is a, c, t, g, unknown, or other
  misc_feature (585)..(585): n is a, c, t, g, unknown, or other
  misc_feature (594)..(594): n is a, c, t, g, unknown, or other
  misc_feature (597)..(597): n is a, c, t, g, unknown, or other
  misc_feature (628)..(628): n is a, c, t, g, unknown, or other
  misc_feature (629)..(629): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
ggagctccccgcggtggcggccgctctagaactagtggatcccccgggctgcaggaattcgcacgagaccattacctagaacatcctaatcgaaaagtaagagaggattttgctaggtttttgcccccaaccgcccaactgcgcgtgctcctgccgacctcccacccctcactcccggnnngggtggcggctgtctcgccgaagcgacccagccgatatggcgaagggcgacgacgcgctggcgcggaagcgcaaccgtgtgcgccgcaagcgcctccgtagcagcgagaacgctgtttccgcgcgtgtcgcggcgatcatcgcctccaagcaccgccgcaagtcggggaagcgccgcgcctgcgaggggatgtgcttctcgctccccacgcccgacgacccgttcaacgagcgccatggcaggaagcacaagctcgatgacgagccggccgacgacacagccgccgaacgcgctgaggacagcggcaaccccaagaagaagggcgcgaaaaacaaaagcagcagccgggggcaaaggatggcgccgaggcgaagccgaaggcggnnccgcgagagggagagggnggcggaggnggncccgcggggaaatccaaacggccggcccagnnccgggggggnnnggcccccacc

SEQ ID NO: 23750 - protein, 144 aa, Zea mays
  misc_feature: Ceres CLONE 1394178-F
  misc_feature (117)..(117): Xaa is any aa, unknown, or other
  misc_feature (123)..(123): Xaa is any aa, unknown, or other
  misc_feature (126)..(126): Xaa is any aa, unknown, or other
  misc_feature (127)..(127): Xaa is any aa, unknown, or other
  misc_feature (137)..(137): Xaa is any aa, unknown, or other
  misc_feature (138)..(138): Xaa is any aa, unknown, or other
  misc_feature (141)..(141): Xaa is any aa, unknown, or other
  misc_feature (142)..(142): Xaa is any aa, unknown, or other
MAKGDDALARKRNRVRRKRLRSSENAVSARVAAIIASKHRRKSGKRRACEGMCFSLPTPDDPFNERHGRKHKLDDEPADDTAAERAEDSGNPKKKGAKNKSSSRGQRMAPRRSRRRXRERERXAEXXPRGNPNGRPXXGGXXPP

SEQ ID NO: 23751 - DNA, 665 bp, Zea mays
  misc_feature: Ceres CLONE 1394182-F
  misc_feature: Translation starting site: 295
  misc_feature: SWISSPROT Homolog: EC 3.2.1.4 Cellulase
  misc_feature (264)..(264): n is a, c, t, g, unknown, or other
  misc_feature (265)..(265): n is a, c, t, g, unknown, or other
  misc_feature (363)..(363): n is a, c, t, g, unknown, or other
  misc_feature (396)..(396): n is a, c, t, g, unknown, or other
  misc_feature (456)..(456): n is a, c, t, g, unknown, or other
tggagctccccgcggtggcggccgctctagaactagtggatcccccgggctgcaggaattcgcacgagaccattacctagaacatcctaatcgaaaagaggaggcagtgcggagacgggagccagtggccagtgacagtgagcggcgacgttccagtgtccactgtccagtaggcgagcgaggaggtggtccattggcccggcatggctcgtctccgctgcgtcttcgtcgtcttcgtcctgctctcgtctgccctccgccttnncagcgacgcattggcctcccgggggcaccatggcccccgccgcacacgactacagggacgcgctcgtcaagtcatcctcttcttcgagggccagcggntcggcaagctggcgccgtcgcagcgcgtgtccntggcgcagggactcgggactctccgacggcactccggccaggtggaccctggtgggcggntaccacgacgctggtggacacgtccaggtccgggttcccgatggcgttcaccatgacaatgctggcggggaacgtgttgaaattttccggcctcatgaagtcggaagtgcacaccgcccaggacgccgtccggttggggcgccaaataacttgttaagggccacggggcaccgggacccatttaatgtgcgggtgggggacgcgaccaa

SEQ ID NO: 23752 - DNA, 661 bp, Zea mays
  misc_feature: Ceres CLONE 1394183-F
  misc_feature: Translation starting site: 297
  misc_feature: SWISSPROT Homolog: EC 2.7.1.90 Diphosphate--fructose-6-phosphate 1-phosphotransferase
  misc_feature (323)..(323): n is a, c, t, g, unknown, or other
  misc_feature (324)..(324): n is a, c, t, g, unknown, or other
  misc_feature (410)..(410): n is a, c, t, g, unknown, or other
  misc_feature (524)..(524): n is a, c, t, g, unknown, or other
  misc_feature (530)..(530): n is a, c, t, g, unknown, or other
  misc_feature (559)..(559): n is a, c, t, g, unknown, or other
  misc_feature (589)..(589): n is a, c, t, g, unknown, or other
ggagctccccgcggtggcggccgctctagaactagtggatcccccgggctgcaggaattcgcacgagaccattacctagaacatcctaatcgaaaaaatcgaaaccaacagtgaatcagccggcgccgcagcatgcctgtacctctcggctctcgctcttatccccacccacctcgctttctcccctctacaagaaagcgaccaccgctgtgaatcagcagagctgcagtgagagcaagtgagaggatcagaggaggcatccgtgaccaaagatcgagtagccaagaagaagagagatgaacgccgacttcggcgcgcccagnngagctcgcgggaggcctgcagcagcggcgggccctgtaccagccccgcctcccgccatgcctccagggaccgacggtaagggcggnagtacggtgacgcgaccacaaccatcgatcccaccggtgcccaagccgtcgcgcaggccttcccgcacacctttggccagccgctcgtcaagcttcgtcgcgccggccgccggngccggnggccgttgaagagcgcacccgatcagggngggggcgtggtgttctcctgggaaggagtncgccgggaggccaccaacgtcgcctgggggctccttgacgcacttaaagcctacattcctcagagcttgctc

SEQ ID NO: 23753 - DNA, 659 bp, Zea mays
  misc_feature: Ceres CLONE 1394184-F
  misc_feature: Encodes the peptide sequence at SEQ ID NO. 23754
  misc_feature (478)..(478): n is a, c, t, g, unknown, or other
tggagctccccgcggtggcggccgctctagaactagtggatcccccgggctgcaggaattcgcacgagaccattacctagaacatcctaatcaaaaaacgacgtcactagtagagccgtagagggcaagaggcgacggaatgacggagcggcaggtggcggagctgggccccgggacggcgtgctgcggctggaaccactgtggccgccgcctcgccgctggcgccgtcgatggctccgtctccgtctatgactcccagccgccaccctcgttcaagtggcaggcccatgagcaagccattgtgaatgtcgtctggcttcctccagagtatggggatgctatagcttgtgtttgtgctgatgccccactgtctttggggggaggaggttgctgctgatgatcaccttccaacctggagaaattgaaaaatcttcgaggatggcacctctcatatactaaatgtactttttgaattacntctgggaattctgaaaagtgttactgcatactcagatgccccagtcaaggtctacgagctcttggattcattgaaatagacaaggggcagcttcaggcagagtccccaaccttactggtcccattccctagtttggaaaaccctgcatggccttcggcatccttagccgggacccccagaa

SEQ ID NO: 23754 - protein, 85 aa, Zea mays
  misc_feature: Ceres CLONE 1394184-F
MTERQVAELGPGTACCGWNHCGRRLAAGAVDGSVSVYDSQPPPSFKWQAHEQAIVNVVWLPPEYGDAIACVCADAPLSLGGGGCC

SEQ ID NO: 23755 - DNA, 652 bp, Zea mays
  misc_feature: Ceres CLONE 1394186-F
  misc_feature: Encodes the peptide sequence at SEQ ID NO. 23756
  misc_feature (231)..(231): n is a, c, t, g, unknown, or other
  misc_feature (245)..(245): n is a, c, t, g, unknown, or other
  misc_feature (346)..(346): n is a, c, t, g, unknown, or other
  misc_feature (392)..(392): n is a, c, t, g, unknown, or other
  misc_feature (564)..(564): n is a, c, t, g, unknown, or other
  misc_feature (578)..(578): n is a, c, t, g, unknown, or other
  misc_feature (623)..(623): n is a, c, t, g, unknown, or other
  misc_feature (642)..(642): n is a, c, t, g, unknown, or other
tccccgcggtggcggccgctctagaactagtggatcccccgggctgcaggaattcgcacgagaccattacctagaacatcctaatcaaaaagaagctctaaaataatctcttcccgacgtctctggaaggtcagcatctgaacccaggtagcctccagcgctggagacgtgccgtactcaaaccctagccaccaatggcagccggcggcggggctccgtgggcggagcgcngcgcgggtggtggngacgcagatccgcaacaggttccgcgtggcgcccgtggaccaccggtcgctgtggctgcgggcggacggtcgtgtcgccactgaggcggtccggcggtggncggatcgcgctcggggctgctgcagaggggccggagcgcggatcgnaactccacatcgacggagacatcacctgaggggggggcaaagccttcgtccagcgttttgagattctacagaaagagagtgggcaaagaaagtaatgggattgaaaactctggtattttccggtcgcgttcagcgatgggctgctccctcttatgggaaaaggaggctaggnttttaggccgggcnctacctccagggcggcgtcctgggcgcaaacaagcttcctcccgncctaaccgggccaaacccnaacggcaggc

SEQ ID NO: 23756 - protein, 44 aa, Zea mays
  misc_feature: Ceres CLONE 1394186-F
  misc_feature (13)..(13): Xaa is any aa, unknown, or other
MAAGGGAPWAERXAGGGDADPQQVPRGARGPPVAVAAGGRSCRH

SEQ ID NO: 23757 - DNA, 664 bp, Zea mays
  misc_feature: Ceres CLONE 1394187-F
  misc_feature: Translation starting site: 166
  misc_feature (235)..(235): n is a, c, t, g, unknown, or other
  misc_feature (385)..(385): n is a, c, t, g, unknown, or other
  misc_feature (386)..(386): n is a, c, t, g, unknown, or other
  misc_feature (575)..(575): n is a, c, t, g, unknown, or other
tggagctccccgcggtggcggccgctctagaactagtggatcccccgggctgcaggaattcgcacgagaccattacctagaacatcctaatcgaaaaatcttgctctgaacgcattcctcccatctcccaagacctcctcagacccgagaagcgcagctgcggccatggacgccaccggcactggagctggagggaaggcgaagaagggagcggccggtcgcaaggccggctgcncgaggaagaagtcggtgacgaggtccgtgaaggccgggctccagttccccgtcggccgcatcgggcgctacctcaagaagggccgctacgcgcagcggcgtcggcagcggtgcccccgtctaccatcgcgggccgtcctggagtacctcnnccgctgaggtcctggagctcgccggcaacgctgccaaggacaacaagaagacgcgcatcgtcccgcgccacgtgctgctggcgatccgcaacgacgaggagctcgggaagctgcttaccggcgtgaccatcgcccacggggggcgtgttgcccaacatcaacccggtcctgctgcccaagaagacggcnggagaaggggtccagcggcgggagcgaggaggccaagtcccccaagaaggccgcccagtccccccagaaggcataggggtttggagggg

SEQ ID NO: 23758 - DNA, 636 bp, Zea mays
  misc_feature: Ceres CLONE 1394188-F
  misc_feature: Translation starting site: 498
  misc_feature (376)..(376): n is a, c, t, g, unknown, or other
  misc_feature (396)..(396): n is a, c, t, g, unknown, or other
  misc_feature (535)..(535): n is a, c, t, g, unknown, or other
aagctggagctccccgcggtggcggccgctctagaactagtggatcccccgggctgcaggaattcgcacgagaccattacctagaacatcctaatcgaaaagacaccttctccgttcccgacgactcccgtgagcgtggagcggcgactaggcgaggccatggcctccggcatcggctccggccagcagcaacccccagcgccggcggcagatgctgacccgggagccgtcggcgacaagctcgtcttcgaagcgccgcctcagcccgtgagggaggactacgtccagaacgccgtcaagtttctctcccaccccaaggtcaggggcctcccccgtcgtctacaggcgatccttcctcgagaagaaggccttagcnaccgaggagatcgacgaggnctttcccgaagggttcctgatcctcaacccagcactacggctaccacttctccgcagcagcaggtcaacagcagaatccattcccgtcggggtgcaagcttatgcgccagcacaacctgtgcacccagcaacgcttggnccctgtcgtccttccacgcagccaagggtttagctggtacaagcattcctggtgcaggctctttggtttgggttttgtgctaacgctgctgtctttatcaa

SEQ ID NO: 23759 - DNA, 648 bp, Zea mays
  misc_feature: Ceres CLONE 1394189-F
  misc_feature (291)..(291): n is a, c, t, g, unknown, or other
  misc_feature (301)..(301): n is a, c, t, g, unknown, or other
  misc_feature (399)..(399): n is a, c, t, g, unknown, or other
tggagctccccgcggtggcggccgctctagaactagtggatcccccgggctgcaggaattcgcacgagaccattacctagaacatcctaatcgaaaaacaagtcccaactcccaaccaccgccagccgtccgctctccgcaagcgcgaccttccggccagatccgccgcgtcgcgccgacgagcggtccttctgcctagtttctccgcccagcgagcggcgggttcctcggagattcccgctggccgcggggatccatttgtgactgctcgcgttgcgcctgggatctggntttgggacgnaggagtgaaacgcgacggtgatcgtgcgaggtgggacgcatcagtgctctgtcctggggctccgtctcttcttcggctgcagatctggaagggtttcnttggtatccgtcgctacgatctgtcccagtcagagcacctgcatcatctcgggtcgggccatggaaactctgctcattctcggaggagcgcaacccgcagctccaccacttctcgggtcgccggaaaaagggcgttagcagcggcccctcagcccactcccagttaccctgcgggcaactggccgggggttcccctccgggatccccggcgggattcctggcgtccccgccccgggagagggtttcact

SEQ ID NO: 23760 - DNA, 661 bp, Zea mays
  misc_feature: Ceres CLONE 1394190-F
  misc_feature: Encodes the peptide sequence at SEQ ID NO. 23761
  misc_feature (337)..(337): n is a, c, t, g, unknown, or other
  misc_feature (481)..(481): n is a, c, t, g, unknown, or other
  misc_feature (482)..(482): n is a, c, t, g, unknown, or other
  misc_feature (562)..(562): n is a, c, t, g, unknown, or other
ggagctccccgcggtggcggccgctctagaactagtggatcccccgggctgcaggaattcgcacgagaccattacctagaacatcctaatcaaaaccagatccctcttccctctccgctcccccacgtcatctagtcgccgcccccgctcaccgattgtcctctgctgtggagcgagcaagcagcggcgaagcgatggaggaggagatcagaaaggagttccagagtaacggcttctccatcggaggagccggccccgaggacgccgcccagatcctctccacgctgctgacctactgcatcaactacaagatgagccccgcggatctcgtctcaanactgggaggtctactacctcaataggcaattggatggcttagagctcgaaagctcgtatccttgattggttttctgtcacaccttcaaaatgaagttaaagacaggataataaaagaagaagctaaccttcacatttactcccnngtaaacgatgttgacatgctcttaagcaatcaccatgtagatgaagcagcattccatgacacaccaggctatgaacaggnaaaggcacctgaaggatcatctatctctgagttaactccctcgggcaagtgacagacatcatcccagcagagtggcaaacaaatggctgatcgtattac

SEQ ID NO: 23761 - protein, 55 aa, Zea mays
  misc_feature: Ceres CLONE 1394190-F
  misc_feature (48)..(48): Xaa is any aa, unknown, or other
MEEEIRKEFQSNGFSIGGAGPEDAAQILSTLLTYCINYKMSPADLVSXLGGLLPQ

SEQ ID NO: 23762 - DNA, 657 bp, Zea mays
  misc_feature: Ceres CLONE 1394195-F
  misc_feature (384)..(384): n is a, c, t, g, unknown, or other
  misc_feature (404)..(404): n is a, c, t, g, unknown, or other
  misc_feature (419)..(419): n is a, c, t, g, unknown, or other
  misc_feature (587)..(587): n is a, c, t, g, unknown, or other
  misc_feature (657)..(657): n is a, c, t, g, unknown, or other
tggagctccccgcggtggcggccgctctagaactagtggatcccccgggctgcaggaattcgcacgagaccattacctagaacatcctaatcgaaaaaccgcatcgcctcgccgctgttccccgcaacctatcgacccaatctcgtccgacccggcgcgtcgtcccctccagatctccgtcgccctctccaggtagcagaaactgttctgctgcattctgacaaagtggagggcttaggagcttctgcttcttttatgtctgaacaatctttgctttatttgggattgttgggagagtactctcgtgcaactaggaaaaggcacaaggttccgtcccactgcatggcgtcagagactggtctggttttcttgttctgatttggncatttgctggtgctcaaagnccggcttggtttccntcgaaggatcagcatctaactcttgattgtgggactttgtcgcatctgatatcaacttcataaatctttatcccagatggcgctgcaaaacattggtgcttcaaacaagggatgatgccttctacaggtacaagatgcccagatgataccaagatagaaggccgtggntaatgtatcaagaaaaatgttggggaacatgtgacatagaaaaggacttgccagccagcttctacacacn

SEQ ID NO: 23763 - DNA, 676 bp, Zea mays
  misc_feature: Ceres CLONE 1394196-F
  misc_feature: Encodes the peptide sequence at SEQ ID NO. 23764
  misc_feature (397)..(397): n is a, c, t, g, unknown, or other
  misc_feature (398)..(398): n is a, c, t, g, unknown, or other
  misc_feature (422)..(422): n is a, c, t, g, unknown, or other
  misc_feature (431)..(431): n is a, c, t, g, unknown, or other
  misc_feature (432)..(432): n is a, c, t, g, unknown, or other
  misc_feature (458)..(458): n is a, c, t, g, unknown, or other
  misc_feature (535)..(535): n is a, c, t, g, unknown, or other
  misc_feature (536)..(536): n is a, c, t, g, unknown, or other
  misc_feature (598)..(598): n is a, c, t, g, unknown, or other
tggagctccccgcggtggcggccgctctagaactagtggatcccccgggctgcaggaattcgcacgagaccattacctagaacatcctaatcgaagtatctgaccacgtcacacgacaccaccaccagccctccccttcatcaattggagcacggcgcccgttcattcccctcttctccgctgcttgcctccggctccccaattccacgagatctccaattccaccgcgtcgtctctgcatccggaccccataccccgatcgatccctaaggcccatggttttctccgccgccgcgtcgcctctagtagccaccgctgctgactctgcttcctcctgcgtcgcccacctccgctgctgctgtcgcgttagttggctgccgttgttgaagacgcgaannctctttaggggttcgcgatttctncgctgatcnnggtcgaagaattggtaaagctatggnatctctcgcggccccacatcgtcggaccctctcgctcgggctcccactctcacggtcacgcccacgcccacgctcgnnaggcacgcggtagccgcgccgctgcgcctggtccaaagaacccggaggaagcgaaaacggancggcgtcgtgggccggagaggcccaaccgggaaagggtataaaaaaggaaagggggcaaaccagcatttctcccctcc

SEQ ID NO: 23764 - protein, 50 aa, Zea mays
  misc_feature: Ceres CLONE 1394196-F
  misc_feature (41)..(41): Xaa is any aa, unknown, or other
MVFSAAASPLVATAADSASSCVAHLRCCCRVSWLPLLKTRXLFRGSRFLR

SEQ ID NO: 23765 - DNA, 648 bp, Zea mays
  misc_feature: Ceres CLONE 1394198-F
  misc_feature: Translation starting site: 198
  misc_feature: Pfam Name: TPR_2 Pfam Description: Tetratricopeptide repeat
  misc_feature (329)..(329): n is a, c, t, g, unknown, or other
  misc_feature (332)..(332): n is a, c, t, g, unknown, or other
  misc_feature (333)..(333): n is a, c, t, g, unknown, or other
  misc_feature (335)..(335): n is a, c, t, g, unknown, or other
  misc_feature (336)..(336): n is a, c, t, g, unknown, or other
  misc_feature (409)..(409): n is a, c, t, g, unknown, or other
  misc_feature (410)..(410): n is a, c, t, g, unknown, or other
  misc_feature (412)..(412): n is a, c, t, g, unknown, or other
  misc_feature (427)..(427): n is a, c, t, g, unknown, or other
  misc_feature (433)..(433): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (507)..(507): n is a, c, t, g, unknown, or other
  misc_feature (508)..(508): n is a, c, t, g, unknown, or other
  misc_feature (517)..(517): n is a, c, t, g, unknown, or other
  misc_feature (518)..(518): n is a, c, t, g, unknown, or other
  misc_feature (593)..(593): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
tggagctccccgcggtggcggccgctctagaactagtggatcccccgggctgcaggaattcgcacgagaccattacctagaacatcctaatcgaaaaatcaaacccccggacatttctggtcgcaccctcctccggccctcccagccgctaagccctctggaaccttcgagagctcgatcggatcggagcccctgccatggccgacgaggcgaaggcgaagggtaatgcggcgttctcagccggccgcttcgagggaggcgcgcggcacttcacggacgccatcgcgctcgccccggggcaccacgtcctctactccaacccggtcggnggnngnntcgctcactccaccggtactccgacgctctcgccgacgcgcagaagaaccgtcgagctcaaggctgactgggnncnaggggctactcccgnctcggnggcgactcnnnnnnnntcggtggggggnnnnnnnnnngggggggnnnngggnnnngggaaaggggcttgggggnncgcccccgnnacggaggggcccaggggggggggcccgaggacacccaaaaaggccccccgcccgccccccggggggggggggggngnnnnnnnnccccaaaaacnnnggggaggaggggccccgggccccccaaaaaggg

SEQ ID NO: 23766 - DNA, 645 bp, Zea mays
  misc_feature: Ceres CLONE 1394201-F
  misc_feature: Encodes the peptide sequence at SEQ ID NO. 23767
  misc_feature (443)..(443): n is a, c, t, g, unknown, or other
  misc_feature (447)..(447): n is a, c, t, g, unknown, or other
  misc_feature (564)..(564): n is a, c, t, g, unknown, or other
  misc_feature (569)..(569): n is a, c, t, g, unknown, or other
  misc_feature (577)..(577): n is a, c, t, g, unknown, or other
  misc_feature (607)..(607): n is a, c, t, g, unknown, or other
  misc_feature (610)..(610): n is a, c, t, g, unknown, or other
tggagctccccgcggtggcggccgctctagaactagtggatcccccgggctgcaggaattcgcacgagaccattacctagaacatcctaatcgaaaaacttccccatcccgcttgctccgtgccgtggtctccgaggtcggggttcctttccgatttgatccgcccagctggaaaacgaaaatcgctgatgggttttggaaggaaagtcgtcatttcttggtgaggtttccgtttctggatcgactggctgatcgatcgtactagccgccatgggcgtcgtcgtgcatcccggccggcggcatccggctgccggacctggagatggtcaaggccgcgccgccgccgccgccgccccgcccggcgcactcagcggcgtcctccacgctctcggaggcgtccaactcgtccccagcctcctcgtcgtcgttggcgtcgctgtcgntcangcgcccgcgcacgccgcggaagcggcccagccagacggacaacgagggggcggcgctgctcgcgtccatgtacccctccgtattccccgtcgccaggggctgggggggccccgaggnggggnccaccccnccctcctcggcctcgcctccgcgcttgggnganacccggtcctggctccgacctcctccctccggtct

SEQ ID NO: 23767 - protein, 107 aa, Zea mays
  misc_feature: Ceres CLONE 1394201-F
  misc_feature (41)..(41): Xaa is any aa, unknown, or other
  misc_feature (42)..(42): Xaa is any aa, unknown, or other
  misc_feature (81)..(81): Xaa is any aa, unknown, or other
  misc_feature (83)..(83): Xaa is any aa, unknown, or other
  misc_feature (96)..(96): Xaa is any aa, unknown, or other
MVKAAPPPPPPRPAHSAASSTLSEASNSSPASSSSLASLSXXRPRTPRKRPSQTDNEGAALLASMYPSVFPVARGWGGPEXGXTPPSSASPPRLGXTRSWLRPPPSG

SEQ ID NO: 23768 - DNA, 659 bp, Zea mays
  misc_feature: Ceres CLONE 1394202-F
  misc_feature: Encodes the peptide sequence at SEQ ID NO. 23769
  misc_feature (349)..(349): n is a, c, t, g, unknown, or other
  misc_feature (372)..(372): n is a, c, t, g, unknown, or other
  misc_feature (378)..(378): n is a, c, t, g, unknown, or other
  misc_feature (659)..(659): n is a, c, t, g, unknown, or other
tggagctccccgcggtggcggccgctctagaactagtggatcccccgggctgcaggaattcgcacgagaccattacctagaacatcctaatcgaaaaacctcatggctcacgcgaataccacacccacaccacaccacacctcacggcgtccattcattcccgtctcgtcttccgctgcttgcctccaactccccccgcgtcgtctcgtgcttcccaatcaccatagagccggttgatccccaaaggcccatggttttctccgacgccgcgtcgcctctcgtagccaccgccgctgactctgcttcctcctgcgtcgcccacctcccctgctgctgtcgcgtaagttgntggccgttgttgttgaagaccgnaagctncgagggttcgtgattcttcgccgaatcggttcgggaactggtaagctatggatctctcgcggcccgcatcgtcagacctctcgctcgggctgcactctcatgcccacgcccacgctcgcgtgcatgcggcagccgcgccgctgcgcctgttcgacgacgcgaagccggagcgcctcgtgggccggggaggccgacgcggagaaggacgacgggggacggtggcgaccagcacttctccctcctcgggcactccctctgcgtcaagcgcccgcgccgcgcgn

SEQ ID NO: 23769 - protein, 78 aa, Zea mays
  misc_feature: Ceres CLONE 1394202-F
MDLSRPASSDLSLGLHSHAHAHARVHAAAAPLRLFDDAKPERLVGRGGRRGEGRRGTVATSTSPSSGTPSASSARAAR

SEQ ID NO: 23770 - DNA, 649 bp, Zea mays
  misc_feature: Ceres CLONE 1394204-F
  misc_feature: Encodes the peptide sequence at SEQ ID NO. 23771
  misc_feature (96)..(96): n is a, c, t, g, unknown, or other
  misc_feature (232)..(232): n is a, c, t, g, unknown, or other
  misc_feature (252)..(252): n is a, c, t, g, unknown, or other
  misc_feature (259)..(259): n is a, c, t, g, unknown, or other
  misc_feature (272)..(272): n is a, c, t, g, unknown, or other
  misc_feature (296)..(296): n is a, c, t, g, unknown, or other
tggagctccccgcggtggcggccgctctagaactagtggatcccccgggctgcaggaattcgcacgagaccattacctagaacatcctaatcgaanaacgaaatcaacccaaaccctagcatcccctttgctcgagggagacgaagatggcgccgaagaagaagacgagtggcgacggcgtggtaaaatcgccagctgacgagttcgcaaagccggcggacgacacgaaggnatcgccagccgagttcgccnaaacggnttaccttgtggcngggcggcggacgaaaacccggggnctactccggttctggagatgacgcccctgtccgggggggaacaagccgcccgcattcccaccggtggccggggtggaagggtttattttctaagccggggattgtctttctccgcgggggattttaaagacgcgttctggatttgtcggcccccgcgggggggttaaaaaaaggggcaccatctttttttccccccaggggattttgagaaattttcttggggccgcgggggtgagtaacccccaccgggggaccccccctggttttttctcgggggggaaaaaaaaaatttttttttcccccccccccccgggggggggggcccgacctaatggggaaaaaaagggtgtgaa

SEQ ID NO: 23771 - protein, 56 aa, Zea mays
  misc_feature: Ceres CLONE 1394204-F
  misc_feature (29)..(29): Xaa is any aa, unknown, or other
  misc_feature (36)..(36): Xaa is any aa, unknown, or other
  misc_feature (38)..(38): Xaa is any aa, unknown, or other
MAPKKKTSGDGVVKSPADEFAKPADDTKXSPAEFAXTXYLVAGRRTKTRGLLRFWR

SEQ ID NO: 23772 - DNA, 676 bp, Zea mays
  misc_feature: Ceres CLONE 1394205-F
  misc_feature: Encodes the peptide sequence at SEQ ID NO. 23773
  misc_feature (345)..(345): n is a, c, t, g, unknown, or other
  misc_feature (427)..(427): n is a, c, t, g, unknown, or other
  misc_feature (441)..(441): n is a, c, t, g, unknown, or other
  misc_feature (573)..(573): n is a, c, t, g, unknown, or other
  misc_feature (585)..(585): n is a, c, t, g, unknown, or other
  misc_feature (586)..(586): n is a, c, t, g, unknown, or other
  misc_feature (604)..(604): n is a, c, t, g, unknown, or other
aaagctggagctccccgcggtggcggccgctctagaactagtggatcccccgggctgcaggaattcgcacgagaccattacctagaacatccctaatcaaaaaagcaaccacttctgctctgcatcccgtctgggcctctgcatttgcttggctgctgctcccttctcccaccgaccaactcgatcccgcgccatggatcgcgccgaccccgcgcggggccgccttgccgtgctctcctcccacctccgtggtgcaggggccgaggaggcggcggggctggagaggtcgccggtatccgcgccggcgcccgggccccgcgccggcgcgcttgccgtgatgaacgnaaggaccgggaagcggcacgacgtccaggtctccgaagacggcaccgtgcgccccaccgacttcaagaagattaccactggnaaggacgacaaggntcttaagatttatgatcctggttaccttaacactgcccctggtcgctcgtcatctgctacatcgatgggagatgagggaatccttccgctataggggttatcaaatcgaagtattggctgaaagcagctcgnttttggtgaggnngcctacctttttagtggnatggggaacttgcctactcagagtcaattggaaggggctggaaatttgctattttccaagcattctggtgtc

SEQ ID NO: 23773 - protein, 113 aa, Zea mays
  misc_feature: Ceres CLONE 1394205-F
  misc_feature: SWISSPROT Homolog: EC 2.3.3.1 Citrate (Si)-synthase
  misc_feature (51)..(51): Xaa is any aa, unknown, or other
  misc_feature (83)..(83): Xaa is any aa, unknown, or other
MDRADPARGRLAVLSSHLRGAGAEEAAGLERSPVSAPAPGPRAGALAVMNXRTGKRHDVQVSEDGTVRPTDFKKITTGKDDKXLKIYDPGYLNTAPGRSSSATSMGDEGILPL

SEQ ID NO: 23774 - DNA, 682 bp, Zea mays
  misc_feature: Ceres CLONE 1394212-F
  misc_feature (208)..(208): n is a, c, t, g, unknown, or other
  misc_feature (221)..(221): n is a, c, t, g, unknown, or other
  misc_feature (237)..(237): n is a, c, t, g, unknown, or other
  misc_feature (238)..(238): n is a, c, t, g, unknown, or other
  misc_feature (240)..(240): n is a, c, t, g, unknown, or other
  misc_feature (242)..(242): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (248)..(248): n is a, c, t, g, unknown, or other
  misc_feature (307)..(307): n is a, c, t, g, unknown, or other
  misc_feature (534)..(534): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (609)..(609): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (615)..(615): n is a, c, t, g, unknown, or other
  misc_feature (617)..(617): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (655)..(655): n is a, c, t, g, unknown, or other
  misc_feature (663)..(663): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
aagctggagctccccgcggtggcggccgctctagaactagtggatcccccgggctgcaggaattcgcacgagaccattacctagaacatcctaatcaaaaaacggtttgcgtataaataagtagtcagtcgctcatcttgttccttgtgaacatcgcagtgctgtagcctccttcgtcttgagcgagcatggagatgtcagccatggnagaagcctcccanggggggatggaaaagnngnangnnngnctccaaaacctttcccgttcattctcctaaaacggaaattccaagaagggggccccccnttcgggttttccggcaaaattgatttctggccctcccccgagggggtttccttggacaaaaggttttttcacccggggccccctcaatttggggaagtgggttttccaatttccggggcaaatttaaaaggcgggggttcccccaaaaccccccccctggggggttctccaaaaaaacccccccgggccccgggggaaccccctcccaaaaggacccccgtcggggnaaaaaaaacccctcccccgggggaaaaaaaaacccccgccggggggggccccgggggnnnnnnaaaaaannnncncnnntntncttctccnnnnnccccccccccccccccccccccgggngggggggnggggggccccccnnnnncg

SEQ ID NO: 23775 - DNA, 663 bp, Zea mays
  misc_feature: Ceres CLONE 1394221-F
  misc_feature (211)..(211): n is a, c, t, g, unknown, or other
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (260)..(260): n is a, c, t, g, unknown, or other
  misc_feature (285)..(285): n is a, c, t, g, unknown, or other
  misc_feature (288)..(288): n is a, c, t, g, unknown, or other
  misc_feature (314)..(314): n is a, c, t, g, unknown, or other
  misc_feature (341)..(341): n is a, c, t, g, unknown, or other
tggagctccccgcggtggcggccgctctagaactagtggatcccccgggctgcaggaattcgcacgagaccattacctagaacatcttaatcgaaaaagaaataggcgcgcgtgccgcctcggccgctcgctcctctggttaatcccccctcgccacgactcgcagccatcccttcacattatccgcgcgcgcgcgagcgagcggacgtancgtgtgggtagcgtcgccgtgcggacggtctcttggtgnnncgtgcggncgcgtggacgtgcgtggccgccgcnggnaaaggaaggccctcccgttggttggncctcgggggaaaatggcggtccacggnggaaaggggggggttcggggggggtccctctttgccctgggttttttttgggggtcggcttctggttgaacggcttcggttaaagggcattatgaagggttacctttttacaaccaagggttttaaaggtggagaaaaaaaggggggccggcaagcaaaaaatggtcaagttctcccaaaggcacttggggaaaattacccacaaaatggttttggtgtaagaaaggggggccccctggtggaaaaaaagagggaaccccggggggtttggtggaataatggcaaaaattttggggggggggggggcaaacaaccccacccg

SEQ ID NO: 23776 - DNA, 648 bp, Zea mays
  misc_feature: Ceres CLONE 1394222-F
  misc_feature: Encodes the peptide sequence at SEQ ID NO. 23777
aaagctggagctccccgcggtggcggccgctctagaactagtggatcccccgggctgcaggaattcgcacgagaccattacctagaacatcctaatcgaaaaattttcgactttcgagcgcagaaacgagagggccggagcagccgcagtcccggcgatcccgccgccggtcgccctcatacttcctcgtcactgccttcgtttctctttccaacaatcaagatgagccgtggcggtagcgcgggtggtggtcaaagttctctgggttacctctttggaagcggtgagccccccaaaccagcagtgggcaccagctgtaagtgctccacctggctgctgcaggtgctccacctgctgagaaaccacctgctgcaaagcctgatggcaccagtcagattggctggctggggttaccagccaaaccaataactaccaaaggggcccgacggtcaggaacaccgggaaactttcctttaacggacccgtcctttcgaaaccagggcccagcttgggcttcccggggggggggggccctttcccggggggaaaaaacccgggtttggggggggaaaactgggaggggccctctccacccagggtataattcccccccccccagttgggggggcgggaagtgggttttttttt

SEQ ID NO: 23777 - protein, 68 aa, Zea mays
  misc_feature: Ceres CLONE 1394222-F
MSRGGSAGGGQSSLGYLFGSGEPPKPAVGTSCKCSTWLLQVLHLLRNHLLQSLMAPVRLAGWGYQPNQ

SEQ ID NO: 23778 - DNA, 709 bp, Zea mays
  misc_feature: Ceres CLONE 1394225-F
  misc_feature (261)..(261): n is a, c, t, g, unknown, or other
  misc_feature (295)..(295): n is a, c, t, g, unknown, or other
  misc_feature (297)..(297): n is a, c, t, g, unknown, or other
  misc_feature (298)..(298): n is a, c, t, g, unknown, or other
  misc_feature (300)..(300): n is a, c, t, g, unknown, or other
  misc_feature (304)..(304): n is a, c, t, g, unknown, or other
  misc_feature (624)..(624): n is a, c, t, g, unknown, or other
tggagctccccgcggtggcggccgcttctagaactaagtggatcccccgggcttgcaggaattcgcacgagaccattacctaagaacattcctaatcgaaaaacactacaatactgctgcgcgctagcggtagcgcttcgcgcttcccacttcgcaccacagcacgccaccgctgctgccggctcctccccgcgctcgcattgcgatttgcgacctagcgcgagggtacccgggggtggtgcgcgtgctccgtgatccggnaacgccgcgagatgccggggggcgggaaaggcgncnntncccnccccgaagcacgacgaactcacgccgcaccccgtcaaggaccagcttccctgggggtctcctactgcatcaccagcccctcccccgtgggctggaggcggtccttcctgggggttccaaaataatctgggccaggcttgggaaccaattgggaatcttaacaaactgggacttgtttcccaaaaatggggagggaaaacatggggggccaaagggggggggtattccgaaaatttggttgttctgtgtgaaggattcaacaacccctcctggggaagatttctttggggaacactgtttccccgggagggatacgggggntcctaaaccccttttggtctcggccaaccattttcaaaaatcccttgggggggagggttttggttattgggaccctaatccccca

SEQ ID NO: 23779 - DNA, 634 bp, Zea mays
  misc_feature: Ceres CLONE 1394226-F
  misc_feature (274)..(274): n is a, c, t, g, unknown, or other
  misc_feature (294)..(294): n is a, c, t, g, unknown, or other
  misc_feature (340)..(340): n is a, c, t, g, unknown, or other
  misc_feature (383)..(383): n is a, c, t, g, unknown, or other
  misc_feature (384)..(384): n is a, c, t, g, unknown, or other
  misc_feature (389)..(389): n is a, c, t, g, unknown, or other
  misc_feature (391)..(391): n is a, c, t, g, unknown, or other
  misc_feature (536)..(536): n is a, c, t, g, unknown, or other
  misc_feature (559)..(559): n is a, c, t, g, unknown, or other
  misc_feature (572)..(572): n is a, c, t, g, unknown, or other
  misc_feature (573)..(573): n is a, c, t, g, unknown, or other
tccccgcggtggcggccgctctagaactagtggatcccccgggctgcaggaattcgcacgagaccattacctagaacatcctaatcaaaaagttagtagttcaccagagttcacacaaaaatcacaagcaagcagtcgcgtgtgtagctcgcaacaatggcgacgaaccccggcctcttcaccgagtggccgtggaagaagctcggcaacttcaagtacctgctgctggcgccgtgggtggcgcacggcggctaccaagggcgaccaagggggntggagggcggccgacctggnggtacgtggccatcctcccgtcgctgctcctccgggcgctgacaanccagggcgtggatcaccgcgtcccgcctgcagagcgcgcgcgnncggcngncaggtcgtggaccgcggcatcgagttcgagcaggtggaccgcgagcgcaactgggacgaccagatcctgctcagcggcatcctcctgtacctggctcacctaaccctggcggggggccagaccctgcgggtggggcgggcggacnccccccgctcttcgcctggttgncgcccgccccctnnaggtcttttaaaacgggttgaccccccgcttcacaaccattccctcaatccggtaacactc

SEQ ID NO: 23780 - DNA, 653 bp, Zea mays
  misc_feature: Ceres CLONE 1394228-F
  misc_feature: Encodes the peptide sequence at SEQ ID NO. 23781
  misc_feature (361)..(361): n is a, c, t, g, unknown, or other
tggagctccccgcggtggcggccgctctagaactagtggatcccccgggctgcaggaattcgcacgagaccattacctagacatcctaatcaaaaaacctcagtagtagcaggacgtatctagagccatttctacacgagatagagattaataaaaataggagcggagagagaggggcaggaaataaacgaggatctcaaccacacgcaacacaagaagctgacgaagggctaatcccccggaacccgttaacgctgtgggagtgtgagcccacccggccacccgtttcggctaatctaccgctcgccttctcccatcgccatgcctgccgcttcctggtccgcgcccaccacctccttcngggccggcgccggagccggcatggttgtcctagaaggaccaaggcggcgcctttacccatcaggacgcttccccgccgagtgcttctcaacgcagctggagaagctgccatgggtgctgctgatgaccgtatgcatggattaggatgacatcaaggaactctgcatgatgtaatatgccgacgacgcttctattcactcacaggaagtgcaagaccagggtagtcgtgtttggtgaccgggcaaggatccctgaaacataggagtggtcacatgatgctatgatcatcagaa

SEQ ID NO: 23781 - protein, 60 aa, Zea mays
  misc_feature: Ceres CLONE 1394228-F
  misc_feature (14)..(14): Xaa is any aa, unknown, or other
MPAASWSAPTTSFXAGAGAGMVVLEGPRRRLYPSGRFPAECFSTQLEKLPWVLLMTVCMD

SEQ ID NO: 23782 - DNA, 742 bp, Zea mays
  misc_feature: Ceres CLONE 1394232-F
  misc_feature (20)..(20): n is a, c, t, g, unknown, or other
  misc_feature (23)..(23): n is a, c, t, g, unknown, or other
ccggctggagcttcttgcgntgncggccgctctagtactagtggatcccccgggctgcaggaattcgcacgagaccattacctagaacatcctaatcgaaaaagaccatagtcatctcatccctcccaactccgctgctacgccttcttctacatcgcaatcacgcgcccgtccggctctcccccttctccctcgccctcacgcgctcacgccctcacctcagtcctcatcgctctcggccgcctgcttaaaccctccgctcgaaccggaacccaaccgagaacagatccaaaacgcaagccgaaccatgtctcgtggcgcggactccggcctcgccgctaggatggctgctctctcctcttgcgcggccgccccgggggggggggggggcgtcctcctcctcatcaacccgccccccccgtaacgtggggcccgcgcgccgcgaccccccccaccggagcgccccccgcatcttgcccccggccccggcgccacccgcgctacctgctccgtgctgccgtccccctcctctcgccccgccagacccggcagccgccgccccgccgtaggcagctgacccccgccaccacctcacgaaacgttcgcagcggcggcccgcccacccgacgatctcgggacggcagggccggacggcgcgcagaaccgcgatgatgccctcgccccccctccagacgtttcttctttacgttggatgtctctgtagctcagccgcgacacatcg

SEQ ID NO: 23783 - DNA, 650 bp, Zea mays
  misc_feature: Ceres CLONE 1394233-F
  misc_feature: Pfam Name: eIF-5_eIF-2B Pfam Description: Domain found in IF2B/IF5
  misc_feature (402)..(402): n is a, c, t, g, unknown, or other
  misc_feature (547)..(547): n is a, c, t, g, unknown, or other
  misc_feature (576)..(576): n is a, c, t, g, unknown, or other
  misc_feature (605)..(605): n is a, c, t, g, unknown, or other
  misc_feature (611)..(611): n is a, c, t, g, unknown, or other
tggagctccccgcggtggcggccgctctagaactagtggatcccccgggctgcaggaattcgcacgagaccattacctagaacatcctaatcgaaaaaccgcatcgcctcgccgctgttccccgcaacctatcgacccaatctcgtccgacccggcgcgtcgtcccctccagatctccgtcgccctctccaggtagcagaaactgttctgctgcattctgacaaagtggagggcttaggagcttctgcttcttttatgtctgaacaatctttgctttatttgggattgttgggagagtactctcgtgcaactaggaaaaggcacaaggttccgtcccactgcatgcgtcaagagactggtctggttttcttgttctgatttgtcatttgctggtgtcaaagnccggcttggtttcctcgaaggatcagcatcttactctggattgtggactttgtcgcatctgatatcaacttcataaatctttatccaagatggcgctgcaaaaacattggtgctcaaaaacagggatgatgccttctacaggtancagatgcccagaatgattacccagatagnaaggcccggtggtaatggtatccaagacnaatggntgtgaacatggttgacataacaaaagcacttgccaggcc

SEQ ID NO: 23784 - DNA, 673 bp, Zea mays
  misc_feature: Ceres CLONE 1394236-F
  misc_feature: Encodes the peptide sequence at SEQ ID NO. 23785
  misc_feature (316)..(316): n is a, c, t, g, unknown, or other
  misc_feature (359)..(359): n is a, c, t, g, unknown, or other
  misc_feature (497)..(497): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (558)..(558): n is a, c, t, g, unknown, or other
  misc_feature (561)..(561): n is a, c, t, g, unknown, or other
  misc_feature (602)..(602): n is a, c, t, g, unknown, or other
aagctggagctccccgcggtggcggccgctctagaactagtggatcccccgggctgcaggaattcgcacgagaccattacctagaacatcctaatcgaaaaacagcgaaccacccatggccctcgccaccactgccgtctccctccaccttttcctcacccggcccgcctccgtgctccgcgtaggccgcggcctcccatgcctcctcctccgagccacttcgtccacctccgcctccccggacttcaacatcaccttcgcggagcccgcgccgtccaaaaaggccccgtccgcgcagccgctggtcccgtggatncgtccgcggggaggacggcaagccccgcctcagcacctccccngccgccggacgtaatccaggccatcgcgctccgcggaggcggagggccaagaaggcccgccaagaaggaaaccctcagggcaaaaaatgggggcgaggttgcccgcggcccgccgcggctgcttccaatgccagcgtncaggggcaaaggaaaggaagcccgccccgaccgtgccgcccaagttctccaggnnnnnccnggnaggttttacaatgagaatatcagggagcggtagccgcaagntctcgccaaggtctttgccccccgcaagagtgccatcaagagggaccagtggagactcactttccagggga

SEQ ID NO: 23785 - protein, 76 aa, Zea mays
  misc_feature: Ceres CLONE 1394236-F
  misc_feature (18)..(18): Xaa is any aa, unknown, or other
  misc_feature (36)..(36): Xaa is any aa, unknown, or other
  misc_feature (37)..(37): Xaa is any aa, unknown, or other
  misc_feature (38)..(38): Xaa is any aa, unknown, or other
  misc_feature (39)..(39): Xaa is any aa, unknown, or other
  misc_feature (53)..(53): Xaa is any aa, unknown, or other
MGARLPAARRGCFQCQRXGAKERKPAPTVPPKFSRXXXXGFTMRISGSGSRKXSPRSLPPARVPSRGTSGDSLSRG

SEQ ID NO: 23786 - DNA, 673 bp, Zea mays
  misc_feature: Ceres CLONE 1394243-F
  misc_feature (351)..(351): n is a, c, t, g, unknown, or other
  misc_feature (360)..(360): n is a, c, t, g, unknown, or other
  misc_feature (403)..(403): n is a, c, t, g, unknown, or other
  misc_feature (418)..(418): n is a, c, t, g, unknown, or other
  misc_feature (462)..(462): n is a, c, t, g, unknown, or other
  misc_feature (512)..(512): n is a, c, t, g, unknown, or other
  misc_feature (513)..(513): n is a, c, t, g, unknown, or other
ggagctccccgcggtggcggccgctctagaactagtggatcccccgggctgcaggaattcacacgagaccattacctagaacatcctaatcgaaaaaacccagtgtgcgcacttcaccccccctctcggtctcaccctcctggcgacgactgggcggccgaacggccgtcgccgccgccccacgccaggtttcaaagtcttcgtcaggcccttctccggcgactcgagcaccacagggtgacaaggatagctttctcgggtcactgaaggaagacatcttctcgacgcggtagaccttctgacggttggctggttgtgctataagtgttcaaggggtggattaggaccggnaaactctgntactgaggggagggtcaaaagtgtcaagagagcttgttccagnatggatgaaggtcanggaagtttaggtattggtgccacatggtgtcaggagggtgatanatcctatgccccgagatgaagtgccaggctgcgaaagggcgggttttttnnaaggaaatggactcccgagacttcgaggcagctgccaaacgcgagggtctgatcgctccgtctctctcttggctccactgctgcttgggaatgaagggggggttcccccgcgcaaatcaagattcggggagggaggccatgggttgaagttgatgcccac

SEQ ID NO: 23787 - DNA, 786 bp, Zea mays
  misc_feature: Ceres CLONE 1394244-F
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (20)..(20): n is a, c, t, g, unknown, or other
  misc_feature (22)..(22): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (56)..(56): n is a, c, t, g, unknown, or other
ggtggggtgtgggnnnnccncnacggcatctcacacaaacnnnnccggggnnnngntaagagtggggctccccgcggtggcggccgctctataactaggggatcccccgggctggaggaattcgcacgagaccattacctagaacatcctaatcgaaaaaatataggatggtctgccggctccaaggttcccaagcgcccaaggcagcggagagagctagctccctcctcctcctcaggtagcgagcgagcggagcgagcgagctcctctgcccctctggcaacctggcctccccttctccgctgcaggaccgccggttgacgactgctccaccagtactgggcgcgcccgcgctgcctacccttacctagccagagcgcgggcgcgcgagagggagaaagacccaggcaggggaggagatcgaatcgatcgatcgatcgagatagaggggctttccctccacattggcagaggagaccctgggccccttccccttggccatccctaggtaaacctcaacctcgggtggaaggggggccccctttccccccggcgggccgaagtttgcaccgcccgggtgcccgcacaccaccccgcccgcccgcgcttcccacgccgccccccccgggacgggggccggcccccggcagccgcctcgcccccctcgtgggacgcttaataaccgccccggcgccgagcccccgacgcgcgggaagcctaactctccccccccccattgcgcccgcgcccccgcactctccaatgaaaccaaacagcggcgcggcc

SEQ ID NO: 23788 - DNA, 649 bp, Zea mays
  misc_feature: Ceres CLONE 1394249-F
  misc_feature: Encodes the peptide sequence at SEQ ID NO. 23789
  misc_feature (398)..(398): n is a, c, t, g, unknown, or other
  misc_feature (476)..(476): n is a, c, t, g, unknown, or other
  misc_feature (477)..(477): n is a, c, t, g, unknown, or other
  misc_feature (490)..(490): n is a, c, t, g, unknown, or other
  misc_feature (516)..(516): n is a, c, t, g, unknown, or other
  misc_feature (539)..(539): n is a, c, t, g, unknown, or other
  misc_feature (579)..(579): n is a, c, t, g, unknown, or other
  misc_feature (580)..(580): n is a, c, t, g, unknown, or other
  misc_feature (612)..(612): n is a, c, t, g, unknown, or other
  misc_feature (613)..(613): n is a, c, t, g, unknown, or other
  misc_feature (649)..(649): n is a, c, t, g, unknown, or other
aagctggagctccccgcggtggcggccgctctagaactagtggatcccccgggctgcaggaattcgcacgagaccattacctagaacatcctaatcgaaaaagggaagccgcaggcagcatctgcatctctcgcccacctccgctccgcctactgctgctggtggtagggaggcggagaaggaggcccttgcgcccgcccgccggccggatcagagccgtagcaaccaccacccatggcggacgtgcacgaacctttggtgcgccgtaagaggaagaaggttttggtggactacttggtgaagttccgatggatcctcgtgatcttcgtggtccttcctatttcaactctgatctacttcaacatcttcctgggtgacatgtggtccgccatgaagtncgagaagaagcgccagaagcagcacgacgagaacgtgcagaaggtcgtgaagcggctcaagcagaggaacccgagaanngacgtcttgtttngcacggcaggaagccctggatcgctngtggcatgcgcaacgtggactancagcgtgcgaggcatttcgaggtcgacctttcttccttcnnggacatcctgagatcgacaaagaggagatggnntgcaagtcgagccccttgtcaacatgggtcagatan

SEQ ID NO: 23789 - protein, 118 aa, Zea mays
  misc_feature: Ceres CLONE 1394249-F
  misc_feature (55)..(55): Xaa is any aa, unknown, or other
  misc_feature (81)..(81): Xaa is any aa, unknown, or other
  misc_feature (86)..(86): Xaa is any aa, unknown, or other
  misc_feature (102)..(102): Xaa is any aa, unknown, or other
  misc_feature (116)..(116): Xaa is any aa, unknown, or other
MADVHEPLVRRKRKKVLVDYLVKFRWILVIFVVLPISTLIYFNIFLGDMWSAMKXEKKRQKQHDENVQKVVKRLKQRNPRXDVLFXTAGSPGSLVACATWTXSVRGISRSTFLPSXTS

SEQ ID NO: 23790 - DNA, 653 bp, Zea mays
  misc_feature: Ceres CLONE 1394250-F
  misc_feature: Encodes the peptide sequence at SEQ ID NO. 23791
  misc_feature (417)..(417): n is a, c, t, g, unknown, or other
  misc_feature (430)..(430): n is a, c, t, g, unknown, or other
  misc_feature (433)..(433): n is a, c, t, g, unknown, or other
  misc_feature (434)..(434): n is a, c, t, g, unknown, or other
  misc_feature (449)..(449): n is a, c, t, g, unknown, or other
  misc_feature (469)..(469): n is a, c, t, g, unknown, or other
  misc_feature (470)..(470): n is a, c, t, g, unknown, or other
  misc_feature (504)..(504): n is a, c, t, g, unknown, or other
  misc_feature (576)..(576): n is a, c, t, g, unknown, or other
  misc_feature (633)..(633): n is a, c, t, g, unknown, or other
  misc_feature (634)..(634): n is a, c, t, g, unknown, or other
  misc_feature (653)..(653): n is a, c, t, g, unknown, or other
aagctggagctccccgcggtggcggccgctctagaactagtggatcccccgggctgcaggaattcgcacgagaccattacctaagaacatcctaatcgaaaaaggctggatttgagcctgtttagcagcgctatccgcttggcccaattcgtctactgctcctccagctcctccgctgcgccgccggtcgccgcccgacaccgccgaagaagagcagacgccgagtccaggacgtcgccgcggggctcggggaacgcggtgttgccatcgcgaggaaggtcggaagttcgctgttcgcccgccggatcggcaccgtcgccaccgcccatggcaaccgtcgcccccgtcgtctccgacctcgtcgacttcctcaacgcgtcgcccaccgcctttcacgccgttgacgaggcgaagcgncggctgaaggcgncgnngttcgtgcagctgtncgagcgggaggagtgggcgnntctcgagcccgggcgcaagtacttcttcacacgncaccactccactattgtcgcttttgcccatcgcgcaaaatacgttggctggcaatggggtccacatcatcgntgcacacactgacagccctttgctgaagctcagcctgtctccagggtaacaaagagnntaccttggagttgggttan

SEQ ID NO: 23791 - protein, 86 aa, Zea mays
  misc_feature: Ceres CLONE 1394250-F
  misc_feature: SWISSPROT Homolog: EC 3.4.11.21 Aspartyl aminopeptidase
  misc_feature (35)..(35): Xaa is any aa, unknown, or other
  misc_feature (36)..(36): Xaa is any aa, unknown, or other
  misc_feature (41)..(41): Xaa is any aa, unknown, or other
  misc_feature (48)..(48): Xaa is any aa, unknown, or other
MATVAPVVSDLVDFLNASPTAFHAVDEAKRRLKAXXFVQLXEREEWAXLEPGRKYFFTRHHSTIVAFAHRAKYVGWQWGPHHRCTH

SEQ ID NO: 23792 - DNA, 641 bp, Zea mays
  misc_feature: Ceres CLONE 1394251-F
  misc_feature: Translation starting site: 345
  misc_feature (433)..(433): n is a, c, t, g, unknown, or other
  misc_feature (519)..(519): n is a, c, t, g, unknown, or other
  misc_feature (618)..(618): n is a, c, t, g, unknown, or other
tggagctccccgcggtggcggccgctctagaactagtggatcccccgggctgcaggaattcgcacgagaccattacctagaacatcctaatcgaaaaacacacaaaccgccgccgccgctaccttcaccactgcggactgcaccagctgcccgccgactactccgtttctcttcctagtacattgccgcgtcgaaggcgaggtcctcagcagcgccggcggactccgctcgcacgccatactcagcctactccgtcttcccctgtctagcagacaccctcttcccctctccactcccaatcttatcgtcgcctccctcgacgtcgctgctgcctccacttcaccatggcgcttcacgccccggtcctcgttctgaaggactcgctgaagcgggagtctggcgcgaaggttcaccaagccaacatccaggcggncaaggctgtcgctgacatcatacgcactacattgggtcccagatccatgctgaaaatgcttctggatgctagtggaggtattgtgnttactaatgatggtaatggcattttgagggaaatagacattgcacccctgctggccagtctatgatcgaactaagtcgtacacaggatgaagaaagtgntgatggcactacttctgtcatgg

SEQ ID NO: 23793 - DNA, 664 bp, Zea mays
  misc_feature: Ceres CLONE 1394252-F
  misc_feature (569)..(569): n is a, c, t, g, unknown, or other
aaagctggagctccccgcggtggcggccgctctagaactagtggatcccccgggctgcaggaattcgcacgagaccattacctagaacatcctaatcgaaaagcgtttctttaccctaagcttttagctggtccaacgaaaggcacacagcccgacagccgccgctgtttcttcatcttcctcgcagcgccggcgctccttcttccgctccctctccgattcgcgctcggcacgcaggcgacggcggcggcgctcgtgctcgggctctcagcgacggcgggcagacccagactgcggtgtgcggcgtcagcggtcccccttccgcctgtcaccaatcgactcgcgctctcgcctccggtcctccgacacaccgaccggtcgccctgggtgcacgcctcccgctcgcatctggactccagtgaaacctgccgacggcgctcgatacccggaggctgcactggcgcgccgatgtgcgaccgacagagaaagcgtgaggcagcagccggcgcctgcttcgggtagcgcttatacctcactatgaatcattaaccgtcgcattagctcttcgngccgctagagcgtgagcattaaggcccattcatgaaccctggaattggcgaaatgtccgaaaactaggcaggggattgggtggttacgctatggc

SEQ ID NO: 23794 - DNA, 662 bp, Zea mays
  misc_feature: Ceres CLONE 1394253-F
  misc_feature: Encodes the peptide sequence at SEQ ID NO. 23795
  misc_feature (460)..(460): n is a, c, t, g, unknown, or other
  misc_feature (526)..(526): n is a, c, t, g, unknown, or other
  misc_feature (545)..(545): n is a, c, t, g, unknown, or other
  misc_feature (572)..(572): n is a, c, t, g, unknown, or other
  misc_feature (573)..(573): n is a, c, t, g, unknown, or other
  misc_feature (662)..(662): n is a, c, t, g, unknown, or other
aaagctggagctccccgcggtggcggccgctctagaactagtggatcccccgggctgcaggaattcgcacgagaccattacctagaacatcctaatcgaaaaagatttggatgtggactagatgcttaaggtgtgaacgtgaaagtggggtccccagatcatcacgaagggtgataatgtcagctgaagcacactacctttcatttgggaagttccttgaacttagtttttcaagccactcaaccgctagaaggctgccaatatgcgggcattcactcaatacggattgtctgcgctttttttgggttgggctccaaagttgcaatgttccagtattcctcagtcgaaatttacaatgcctgcaaaccacagcctactcttgagattcacaaccccgatatgcacaaagatgccccaaggttgctgccctcgtgtttcgtgctctgattggtgagtcttncatgagagctgattcccagtatatagaggtgaaacagcttttgatttattcttttgttaatttggnggcacatatagaggtgaancagcttattaaaggatgatccttgtanncatcagagtttcatacatagatgaaacgatattgtgattctctcagtggtggcttcatgagcaagcatcattcaccttggtcactaaan

SEQ ID NO: 23795 - protein, 90 aa, Zea mays; identical to SEQ ID NO: 11994
  misc_feature: Ceres CLONE 1394253-F

SEQ ID NO: 23796 - DNA, 663 bp, Zea mays
  misc_feature: Ceres CLONE 1394258-F
  misc_feature (320)..(320): n is a, c, t, g, unknown, or other
  misc_feature (321)..(321): n is a, c, t, g, unknown, or other
  misc_feature (438)..(438): n is a, c, t, g, unknown, or other
  misc_feature (494)..(494): n is a, c, t, g, unknown, or other
  misc_feature (518)..(518): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (589)..(589): n is a, c, t, g, unknown, or other
aagctggagctccccgcggtggcggccgctctagaactagtggatcccccgggctgcaggaattcgcacgagaccattacctagaacatcctaatcgaaaatcttcaagggcacagccgcgcggccaccaccaacaccacctggccccgtccttcctttcttgtgttgccgctaggccatacacacacgacgtcgctgctccgcatggccaacgccaatggctcgtccaccggtgcaggccatagcgacctcgtcagggccatttcgcacgagcagcaccaggcgttcatggcctccgtgccccgggccgcaccgggcgnngtgaatgtgcaccaccagcagcacttccaccaataccccgccggcttgatcccagcgccggtggcactgccggttcacgccaccggtggtgtcgtcacagacgtctccgtactccgncccagatcgcggtgccgccgccgccgccaccactcatcgcatctccagaacaccgnctgcactccctggccgcctacggnatgctaccagctggactattctccatatgggcaacgctgctgcgccttcgcagcagcacacatcannnaantaaggggtttttgctgactggggaacgcacagcaatggcgctcatgtccttggctcatgcccacctagtttttg

SEQ ID NO: 23797 - DNA, 664 bp, Zea mays
  misc_feature: Ceres CLONE 1394262-F
  misc_feature (1)..(1): n is a, c, t, g, unknown, or other
  misc_feature (294)..(294): n is a, c, t, g, unknown, or other
  misc_feature (295)..(295): n is a, c, t, g, unknown, or other
  misc_feature (317)..(317): n is a, c, t, g, unknown, or other
  misc_feature (370)..(370): n is a, c, t, g, unknown, or other
  misc_feature (423)..(423): n is a, c, t, g, unknown, or other
  misc_feature (433)..(433): n is a, c, t, g, unknown, or other
  misc_feature (599)..(599): n is a, c, t, g, unknown, or other
  misc_feature (632)..(632): n is a, c, t, g, unknown, or other
  misc_feature (639)..(639): n is a, c, t, g, unknown, or other
  misc_feature (645)..(645): n is a, c, t, g, unknown, or other
  misc_feature (647)..(647): n is a, c, t, g, unknown, or other
naaagctggagctccccgcggtggcggccgctctagaactagtggatcccccgggctgcaggaattcgcacgagaccattacctagaacatcctaatcgaaaagtccgccccccgccaccaccgcactcccatccagatgggagtgcgcaagaggagctttcggcattccggtctcgctcgaccaaccggatccccgtgagagtccccacccacaccccgagggcggcgtcgggtcgtcggggacagctgatttcacaagacgagccggcgagccggccggcatttcgtcgtcnngatggcgccggcctcctcctcntccgccgggcgtcgcgtgcctcgtcctgctcctgctctggctccctcgccggngcctccgcggggcacggctcgttccaaggctaggcgtgctctgtcagatgacnatgggagcgntatagtggcgcgatgggcgggaggttgctcgccgacgctgcgactccagcgaacaactctcttgtgctggctgcggcgagggactcacggagcgaccccttcgccaccttacgcgtacagcggcggctggaacattagcgacgagcactactgggcttccggaggnaacaccgcggtgccctcttcctcatgggcgggnttggggnttcgcngntttccgcgtcgtcatgg

SEQ ID NO: 23798 - DNA, 664 bp, Zea mays
  misc_feature: Ceres CLONE 1394264-F
  misc_feature: Encodes the peptide sequence at SEQ ID NO. 23799
aagctggagctccccgcggtggcggccgctctataactagtggatcccccgggctgcaggaattcgcacgagaccattacctagaacatcctaatcaaaaatcagatccctcccgcagtctcgcgcgctctcccccacccacccaccccctatccatccatccatcccacctcctgctccacatcctcccctccgcccaccaacgcagcagcagccagcagccccgccacttcccccctcgccgcttgcgatggcggtcacgcgcgtcgccgtggccgccgccctctcggcggccccgatctcctcccgccgccaccgggttgccctcccctccgcctgccgccttctccccgcctcggccacctgctgcaacagccgcgcggcgatgtctctgcaggccgccgccgccgcacctgccgccggcgcggtcgatgaggagactcctgcctcctcccctccgtcagatgctagcaagggggtggagaacctggtgatcatcggctctgaccagccggttaccccgctgccatctacgccgcccgggcgaacctgaagcctgtcctgtttgaaagaggccaaaatggggcggggcccccgacggccagctgaatgaccaccaccgaggtggaaaaatttcccggaaatccccggacggaataaccgg

SEQ ID NO: 23799 - protein, 100 aa, Zea mays
  misc_feature: Ceres CLONE 1394264-F
MAVTRVAVAAALSAAPISSRRHRVALPSACRLLPASATCCNSRAAMSLQAAAAAPAAGAVDEETPASSPPSDASKGVENLVIIGSDQPVTPLPSTPPGRT

SEQ ID NO: 23800 - DNA, 687 bp, Zea mays
  misc_feature: Ceres CLONE 1394265-F
  misc_feature: Encodes the peptide sequence at SEQ ID NO. 23801
  misc_feature (316)..(316): n is a, c, t, g, unknown, or other
  misc_feature (317)..(317): n is a, c, t, g, unknown, or other
  misc_feature (366)..(366): n is a, c, t, g, unknown, or other
  misc_feature (431)..(431): n is a, c, t, g, unknown, or other
  misc_feature (466)..(466): n is a, c, t, g, unknown, or other
  misc_feature (470)..(470): n is a, c, t, g, unknown, or other
  misc_feature (477)..(477): n is a, c, t, g, unknown, or other
  misc_feature (478)..(478): n is a, c, t, g, unknown, or other
  misc_feature (483)..(483): n is a, c, t, g, unknown, or other
  misc_feature (529)..(529): n is a, c, t, g, unknown, or other
  misc_feature (548)..(548): n is a, c, t, g, unknown, or other
  misc_feature (576)..(576): n is a, c, t, g, unknown, or other
  misc_feature (624)..(624): n is a, c, t, g, unknown, or other
aaagctggagctccccgcggtggcggccgctctagaactagtggatcccccgggctgcaggaattcgcacgagaccattacctagaacatcctaatcgaaaaactactcgatggaaccagcaacatgggccgcgttcctcggcattgccctttgcgcagcggcagcgctcttccttttgcgtggccggcgcccggtctacaaccccccgccgggccccaagccatggccgatcatcggcaaccttaacctcatgggcgagctgccccaccgctccatgaacgagctctccaagcggtacggtccgctcatgcagcnntctggttcgggtcgttgccctgttgggtcgtcggcgcgtccgccgagantggcaaagctcttcctcaagaccaacggacgcggcgttctccgaaccggcgaaaaggttcgcagntcggcaagtacacccgcgtaccgactgctcccggncttnctgtggnnctccnttttgagccgtacctgcgccagggcacgcagggatctgcgccaccngagctcttcagcgccacgncggctcgagtccttcgagcacatccgcnacgaggaaggtgcgcgtgatgctccgacagctgcgccaagcggctggncgcaccgtggcggcttaggactaccttgcagatgtggccgcctcggcgtgatctcgcggatag

SEQ ID NO: 23801 - protein, 192 aa, Zea mays
  misc_feature: Ceres CLONE 1394265-F
  misc_feature: SWISSPROT Homolog: EC 1.14.13.68 4-hydroxyphenylacetaldehyde oxime monooxygenase
  misc_feature (69)..(69): Xaa is any aa, unknown, or other
  misc_feature (86)..(86): Xaa is any aa, unknown, or other
  misc_feature (107)..(107): Xaa is any aa, unknown, or other
  misc_feature (119)..(119): Xaa is any aa, unknown, or other
  misc_feature (120)..(120): Xaa is any aa, unknown, or other
  misc_feature (123)..(123): Xaa is any aa, unknown, or other
  misc_feature (125)..(125): Xaa is any aa, unknown, or other
  misc_feature (140)..(140): Xaa is any aa, unknown, or other
  misc_feature (156)..(156): Xaa is any aa, unknown, or other
  misc_feature (172)..(172): Xaa is any aa, unknown, or other
MEPATWAAFLGIALCAAAALFLLRGRRPVYNPPPGPKPWPIIGNLNLMGELPHRSMNELSKRYGPLMQXSGSGRCPVGSSARPPRXAKLFLKTNGRGVLRTGEKVRXSASTPAYRLLPXXLWXSXLSRTCARARRDLRHXSSSAPRRLESFEHIRXEEGARDAPTAAPSGWXHRGGLGLPCRCGRLGVISRI

SEQ ID NO: 23802 - DNA, 612 bp, Zea mays
  misc_feature: Ceres CLONE 1394269-F
  misc_feature: Encodes the peptide sequence at SEQ ID NO. 23803
  misc_feature (370)..(370): n is a, c, t, g, unknown, or other
  misc_feature (427)..(427): n is a, c, t, g, unknown, or other
  misc_feature (505)..(505): n is a, c, t, g, unknown, or other
  misc_feature (533)..(533): n is a, c, t, g, unknown, or other
aaagctggagctccccgcggtggcggccgctctagaactagtggatcccccgggctgcaggaattcgcacgagaccattacctagaacatcctaatcgaaaactcccccctgttcccctcgtctcgtcgccgcctacgaaaatggctgcgctcgcgacactcctccgccacagccgccgcagccatgcccacgtcctccccatctcccgtgcgctctccaccaccaccccgaccaccggcggcaccgatcccgttgccatcacgttgtcgtacgccaagagacaactcctccgcgagcgcgatccggaccgcgtggtctccatcctcgacgccatcgacacggcgtccatctccgctgcttccacccggnacgcgctctccctcgccgcgcgccgcctttctcgctcccgccgcttcgctgacgcgnaggccctcctctcctcccatctcacccgcgtcaccacgaggcccacctcgccggccgtctgtgctcctacgcctccgncaacctccccgagaaggccatcgacgcngtccgctccggctgcgccgtcccttccaacccccaactcccccgctcccttcaacgccctcctctccactttcatacgg

SEQ ID NO: 23803 - protein, 157 aa, Zea mays
  misc_feature: Ceres CLONE 1394269-F
  misc_feature (77)..(77): Xaa is any aa, unknown, or other
  misc_feature (96)..(96): Xaa is any aa, unknown, or other
  misc_feature (122)..(122): Xaa is any aa, unknown, or other
  misc_feature (131)..(131): Xaa is any aa, unknown, or other
MAALATLLRHSRRSHAHVLPISRALSTTTPTTGGTDPVAITLSYAKRQLLRERDPDRVVSILDAIDTASISAASTRXALSLAARRLSRSRRFADAXALLSSHLTRVTTRPTSPAVCAPTPPXTSPRRPSTXSAPAAPSLPTPNSPAPFNALLSTFIR

SEQ ID NO: 23804 - DNA, 668 bp, Zea mays
  misc_feature: Ceres CLONE 1394270-F
  misc_feature: Encodes the peptide sequence at SEQ ID NO. 23805
  misc_feature (390)..(390): n is a, c, t, g, unknown, or other
  misc_feature (459)..(459): n is a, c, t, g, unknown, or other
  misc_feature (506)..(506): n is a, c, t, g, unknown, or other
  misc_feature (635)..(635): n is a, c, t, g, unknown, or other
  misc_feature (649)..(649): n is a, c, t, g, unknown, or other
  misc_feature (668)..(668): n is a, c, t, g, unknown, or other
aaagctggagctccccgcggtggcggccgctctagaactagtggatcccccgggctgcaggaattcgcacgagaccattacctagaacatcctaaaaataatcacagattcacagagcgctagggaggagagagggctagggtttcgtgctccctcacgcaacgaatccgagccggatcggggggtgcgcggagtcaccggcggcccggcgttgcctgggctgtgatacagttgcaatggcatctgtaactgatgagacagctaagattgagggtttgacatctgctgcagcctttgtggagggtggcattcaggacgcatgtgatgatgcatgcagcatttgccttgaggctttctgtgagagtgacccttctgcattgactggctgcnaacatgagttcccatctcaatgcattcttgaatggggccagagaagttcacagtggcccaatgtgttgncagcctattactatgagggatcctaccagtcaggagctgcttgaggnagtagagcgtgagaggaatataagaactaatcaaactcgggaacacactatatttcatcatcctgttcctggggggattttgagctgcagcatcctgcctggttggtaaatgatggctgagctttgaangagcgtatactgcnagcatctagctgctgctgn

SEQ ID NO: 23805 - protein, 88 aa, Zea mays
  misc_feature: Ceres CLONE 1394270-F
  misc_feature (52)..(52): Xaa is any aa, unknown, or other
  misc_feature (75)..(75): Xaa is any aa, unknown, or other
MASVTDETAKIEGLTSAAAFVEGGIQDACDDACSICLEAFCESDPSALTGCXHEFPSQCILEWGQRSSQWPNVLXAYYYEGSYQSGAA

SEQ ID NO: 23806 - DNA, 646 bp, Zea mays
  misc_feature: Ceres CLONE 1394271-F
  misc_feature: Encodes the peptide sequence at SEQ ID NO. 23807
  misc_feature (477)..(477): n is a, c, t, g, unknown, or other
  misc_feature (533)..(533): n is a, c, t, g, unknown, or other
  misc_feature (589)..(589): n is a, c, t, g, unknown, or other
  misc_feature (590)..(590): n is a, c, t, g, unknown, or other
  misc_feature (631)..(631): n is a, c, t, g, unknown, or other
aaagctggagctccccgcggtggcggccgctctagaactagtggatcccccgggctgcaggaattcgcacgagaccattacctagaacatcctaatcgaagtatctgaccacgtcacacgacaccaccaccagccctccccttcatcaattggagcacggcgcccgttcattcccctcttctccgctgcttgcctccggctccccaattccacgagatctccaattccaccgcgtcgtctctgcatccggaccccataccccgatcgatccctaaggcccatggttttctccgccgccgcgtcgcctctagtagccaccgctgctgactctgcttcctcctgcgtcgcccacctccgctgctgctgtcgcgttagttgctgccgttgttgaagacgcgtagctctttagggttcgcgatttctcgctgatcggttcgagaattggtaagctatggatctctcgcgggccacatcgtncgacctctcgctcgggctccactctcacggtcacgcccacgcccacgctcgaaggnacgcggtagccgcgccgctgcgcctgggtcgacgacgcgaaagagccgagccgganncgcgtcgtgggccggagagccgacgcggagagggattgacngaggacggggccgac

SEQ ID NO: 23807 - protein, 36 aa, Zea mays
  misc_feature: Ceres CLONE 1394271-F
MVFSAAASPLVATAADSASSCVAHLRCCCRVSCCRC

SEQ ID NO: 23808 - DNA, 653 bp, Zea mays
  misc_feature: Ceres CLONE 1394272-F
  misc_feature: Encodes the peptide sequence at SEQ ID NO. 23809
  misc_feature (388)..(388): n is a, c, t, g, unknown, or other
  misc_feature (460)..(460): n is a, c, t, g, unknown, or other
  misc_feature (489)..(489): n is a, c, t, g, unknown, or other
  misc_feature (490)..(490): n is a, c, t, g, unknown, or other
  misc_feature (585)..(585): n is a, c, t, g, unknown, or other
aaagctggagctccccgcggtggcggccgctctagaactagtggatcccccgggctgcaggaattcgcacgagaccattacctagaacatcctaatcgaaaaatcactagtcaccacttccccgcgctgccctcccactcccacacactttctgctgcctctcgccgcggccgatgggctgcttccttggctgcttcgggggggccaaggagcgccgccgccgccgccgcaagcggtcgccctcacagtcccccaacggccgtgcccgggccttgccgcgggttacgccgaacaaggttgatctggatggggaggccgtctccgccgccgcgccgctactagcgacgctcctcgagttgagggactccacggacaagatgtgcctggncctcgtgaagaaaaggtgacattcgaccccaacgtcaccacattcgaggcggccccgatcccggaggacgancgcgaggaagccgatccggaggatggtgnngatagcagcgagaaggggtggatgcaggcgtcggagtgcaccaagtccgaggccttccccttgaaccacaggtacagcaaagtcgccggcagcgncaacgtcagcgactacgaggacgcgagagagaatttttctaaaaaaacgaggaggaggaggaggacaa

SEQ ID NO: 23809 - protein, 77 aa, Zea mays
  misc_feature: Ceres CLONE 1394272-F
  misc_feature (72)..(72): Xaa is any aa, unknown, or other
MGCFLGCFGGAKERRRRRRKRSPSQSPNGRARALPRVTPNKVDLDGEAVSAAAPLLATLLELRDSTDKMCLXLVKKR

SEQ ID NO: 23810 - DNA, 615 bp, Zea mays
  misc_feature: Ceres CLONE 1394273-F
  misc_feature: Encodes the peptide sequence at SEQ ID NO. 23811
  misc_feature (269)..(269): n is a, c, t, g, unknown, or other
  misc_feature (356)..(356): n is a, c, t, g, unknown, or other
  misc_feature (460)..(460): n is a, c, t, g, unknown, or other
aaagctggagctccccgcggtggcggccgctctagaactagtggatcccccgggctgcaggaattcgcacgagaccattacctagaacatcctaatcgaaaaaaaaaaacgcacggggagcttggagacttcacgacaaatcgacgatcgccgcttctcttggccattgtagagggagagagagagcgcgagcgacctaggtcagtcggtttcggttttgggcgtcagcttcagctatccgcgaccgcgacgatgggtctgcgcgtggncgccacccgcgcagctccggccggcgtgcgcgtgctcggcaggggcgccgcgcgcgtgacgccgcgaccgtgggcggctgtcggcgncagagacgcttctccgtgcggatgtccgtcgcgaccacccgaggcacaccaccatcggcggtggcggcctccgaggaccaggcgctggagggtaggaactccangacggtggtggccggcatccctcgggggtggggccggaaccagctcttcccgcttacaagacgcagggcaaagcccgggggggccattgggggggggaacaggttcatcgacggggccgatgggcactggataaaacgggggaatcaacaaggcc

SEQ ID NO: 23811 - protein, 79 aa, Zea mays
  misc_feature: Ceres CLONE 1394273-F
  misc_feature: SWISSPROT Homolog: EC 2.7.7.27 Glucose-1-phosphate adenylyltransferase
  misc_feature (28)..(28): Xaa is any aa, unknown, or other
MSVATTRGTPPSAVAASEDQALEGRNSXTVVAGIPRGWGRNQLFPLTRRRAKPGGAIGGGNRFIDGADGHWIKRGNQQG

SEQ ID NO: 23812 - DNA, 666 bp, Zea mays
  misc_feature: Ceres CLONE 1394277-F
  misc_feature (527)..(527): n is a, c, t, g, unknown, or other
  misc_feature (528)..(528): n is a, c, t, g, unknown, or other
  misc_feature (576)..(576): n is a, c, t, g, unknown, or other
  misc_feature (577)..(577): n is a, c, t, g, unknown, or other
  misc_feature (584)..(584): n is a, c, t, g, unknown, or other
  misc_feature (631)..(631): n is a, c, t, g, unknown, or other
aagctggagctccccgcggtggcggccgctctagaactagtggatcccccgggctgcaggaattcgcacgagaccattacctagaacatcctaatcaaaaaattgattggttgcttggttgcttgcttcgtttcacgctttccccttcctttgctgagatccaaaagctgagactcagcttgtcgatccatctgttctgtgcgcctactcgtatcttaggatccatctgtatgttgtttacttgttttcctgattgaatcgcgcattggatgcctggtggttggccttgctcctagtcttttcatttacacgagctttcgacgaagccgcgtctggtctgtctgctccatcacaagagcacgcaaatggttcgatctgccgtgccagatgattgctgcattcagtgggacgtcatgcacatccacgatggattgtagcgtcagcactctgatcttttccttgtcgattgtttgtcgcagctgagttccccaccccccacaaacaattactagagtagctgcattggnncgggaaattaaagcgctagaagctcacagcattgggcggagcaggggnnccgccgnaaaggtactggtggcacatgtgccgccgcggcgttagcccccggggnagggcgaagtgggaaaaatgaaagtgcccgttctg

SEQ ID NO: 23813 - DNA, 659 bp, Zea mays
  misc_feature: Ceres CLONE 1394280-F
  misc_feature: Encodes the peptide sequence at SEQ ID NO. 23814
  misc_feature (303)..(303): n is a, c, t, g, unknown, or other
  misc_feature (338)..(338): n is a, c, t, g, unknown, or other
  misc_feature (401)..(401): n is a, c, t, g, unknown, or other
  misc_feature (421)..(421): n is a, c, t, g, unknown, or other
  misc_feature (453)..(453): n is a, c, t, g, unknown, or other
aaagctggagctccccgcggtggcggccgctctagaactagtggatcccccgggctgcaggaattcgcacgagaccattacctagaacatcctaatcgaaaaacactcgtccactcccccagtcacccccgcgcccgtctttgctctgcctctccgcgccgcagagcagagcagagcatggcgcccccacgccctctcctcgccgccgtcttcctcgccgcggcggttccgctcctcctttctccggcagaggcggggacggtgggcgtgaactacggccgcgtggcgaacaacctgccgaanccagcggcggttgtgcagctgctgaagcagcaggncggtggcgcaagtgaagctgtacgacgccgaccccaccgtgctgcgcgccctcgcaacacggnatcagaggggggtgggtggncgctgccaacgagcaggccgcggcggcggggncgcgcgcgtctacgcgctggttgtgggtgccccggaaacgtggggcgtaccacccggccagcagatccagggattcggcggggggcaaggagggggtccccgtcgccaaaaacggggcggcccactttggcccggcactggcccaggggcccccggttttgaccaggtggccctcaacagggcccctaaaggggcccccccccccc

SEQ ID NO: 23814 - protein, 145 aa, Zea mays
  misc_feature: Ceres CLONE 1394280-F
  misc_feature: SWISSPROT Homolog: EC 3.2.1.39 Glucan endo-1,3-beta-D-glucosidase
  misc_feature (42)..(42): Xaa is any aa, unknown, or other
  misc_feature (54)..(54): Xaa is any aa, unknown, or other
  misc_feature (75)..(75): Xaa is any aa, unknown, or other
  misc_feature (82)..(82): Xaa is any aa, unknown, or other
MAPPRPLLAAVFLAAAVPLLLSPAEAGTVGVNYGRVANNLPXPAAVVQLLKQQXGGASEAVRRRPHRAARPRNTXSEGGGWXLPTSRPRRRGRARLRAGCGCPGNVGRTTRPADPGIRRGARRGSPSPKTGRPTLARHWPRGPRF

SEQ ID NO: 23815 - DNA, 663 bp, Zea mays
  misc_feature: Ceres CLONE 1394281-F
  misc_feature: Encodes the peptide sequence at SEQ ID NO. 23816
  misc_feature (351)..(351): n is a, c, t, g, unknown, or other
  misc_feature (418)..(418): n is a, c, t, g, unknown, or other
  misc_feature (439)..(439): n is a, c, t, g, unknown, or other
  misc_feature (440)..(440): n is a, c, t, g, unknown, or other
aagctggagctccccgcggtggcggccgctctagaatagtggatcccccgggctgcaggaattcgcacgagaccattacctagaacatcctaatcaaaaaataccccgtctcggttctcaaacaccgccgccgccgttctcccgacatctccccgtccaggtcgttgggtcagcccctatccttcaccttcacgacttcacctgcttctccactgcgcgccccgcccccggccccgtcgtgcgccctgctcagatccatcgcacggggcttgccgcaccactgcgccaagcaaaaggtgggcggccagcggcgcgtgcgcagatcatgcactgttgtcttatgaagattgntaaggggagaaagaagatgagggataaacagcgaaaatcatctgccctcgggtctgatgcaggatgngcatctttcttatccctgatnngatggagcttggggggttttggcttggctgctcccttttcctaaacatcagcaggacgtggtcagacccatgtttatttcagtcctcttcatgcgaccagaaaattagaggacatcgagggaggatcatttccgcttggccacctcctcacaaggtgaatcctcgtggagggaaaagggaggggacctctaaaacaacccaagggtaatagatgattatccgg

SEQ ID NO: 23816 - protein, 52 aa, Zea mays
  misc_feature: Ceres CLONE 1394281-F
  misc_feature (9)..(9): Xaa is any aa, unknown, or other
  misc_feature (31)..(31): Xaa is any aa, unknown, or other
  misc_feature (38)..(38): Xaa is any aa, unknown, or other
  misc_feature (39)..(39): Xaa is any aa, unknown, or other
MHCCLMKIXKGRKKMRDKQRKSSALGSDAGXASFLSLXXWSLGGFGLAAPFS

SEQ ID NO: 23817 - DNA, 664 bp, Zea mays
  misc_feature: Ceres CLONE 1394285-F
  misc_feature: Translation starting site: 170
  misc_feature: SWISSPROT Homolog: EC 3.1.3.2 Acid phosphatase
  misc_feature (403)..(403): n is a, c, t, g, unknown, or other
  misc_feature (404)..(404): n is a, c, t, g, unknown, or other
  misc_feature (490)..(490): n is a, c, t, g, unknown, or other
  misc_feature (527)..(527): n is a, c, t, g, unknown, or other
  misc_feature (612)..(612): n is a, c, t, g, unknown, or other
  misc_feature (638)..(638): n is a, c, t, g, unknown, or other
  misc_feature (649)..(649): n is a, c, t, g, unknown, or other
  misc_feature (656)..(656): n is a, c, t, g, unknown, or other
aaagctggagctccccgcggtggcggccgctctagaactagtggatcccccgggctgcaggaattcgcacgagaccattacctagaacatcctaatcgaaaaccatccatccatccagttagttagttagtaagttagttgagggagaagaagcaggggaggggaagcgatgagcaacatgctgcgggctcgccgccgcctggacctcctgcaggtggtgctcttcgccgctgtgctcctcgtcgtcgtcgccgacgccggcgtgacgagccagtaccggcggaagctggaggcgacggtggagatgccactggacgccgacgtcttccgcgtcccgccggggtacaatgccccgcagcaggtgcacatcacgctgggtgaccaggagggcacggcgatgatnncgtgtcgtgggtgacggccaatgagctgggcagcagcaccgtcatgtacagcgaggcgtcgccggaccccggagaagatggagctnccgggcggagggcacccacacgcgctacgactacttncactacacctccggcttcatccaccactgcaccctcacaaaccctcagcatagcaccagtactactaccgccttgggggttcggncaacacggtggaggagcttctgcttncacacgccaancatggcngggggccg

SEQ ID NO: 23818 - DNA, 650 bp, Zea mays
  misc_feature: Ceres CLONE 1394287-F
  misc_feature: Encodes the peptide sequence at SEQ ID NO. 23819
  misc_feature (589)..(589): n is a, c, t, g, unknown, or other
  misc_feature (600)..(600): n is a, c, t, g, unknown, or other
aaagctggagctccccgcggtggcggccgctctagaactagtggatcccccgggctgcaggaattcgcacgagaccattacctagaacatcctaatcgaaaaagctctcccagccgccgccgcctccacctcttcctacgcttccttgtctccaccgcgagcgacctccatacaacggtgtcagcggcctccctacgccaccgtcctcatccgccgccgtcgtccactacaccgccacggtcgtcctcggtcgcgaccgcgcccttcgttctcatccagcgccacggtctagggtttgagcactcctccatcgtctccttgcctcttctccatcatctccttgcctcttctctcctctgtgttctccctctggtcacggtcttgtttgctcttttgtttttcattcaaatcgtcgtgcatccagatctggcgtctatttttgggccaatgcttatttcttgcagaaacaggcatccagatctagcgtggtctgagcacaaaagtgtacagcatgacctatggatcaggaaagtgtagcagacacgttcgtcgtcgcgacatcgtcgaagcgtgtggctactgcgctggncgtgacatcgnccagtcgtggtgcttgctgccctgacagcacgatgcgtctctgtctccaa

SEQ ID NO: 23819 - protein, 44 aa, Zea mays
  misc_feature: Ceres CLONE 1394287-F
  misc_feature (24)..(24): Xaa is any aa, unknown, or other
  misc_feature (28)..(28): Xaa is any aa, unknown, or other
MDQESVADTFVVATSSKRVATALXVTSXSRGACCPDSTMRLCLQ

SEQ ID NO: 23820 - DNA, 668 bp, Zea mays
  misc_feature: Ceres CLONE 1394288-F
  misc_feature: Translation starting site: 322
  misc_feature: SWISSPROT Homolog: EC 2.3.3.10 Hydroxymethylglutaryl-CoA synthase
  misc_feature (458)..(458): n is a, c, t, g, unknown, or other
  misc_feature (521)..(521): n is a, c, t, g, unknown, or other
  misc_feature (554)..(554): n is a, c, t, g, unknown, or other
  misc_feature (562)..(562): n is a, c, t, g, unknown, or other
  misc_feature (563)..(563): n is a, c, t, g, unknown, or other
  misc_feature (571)..(571): n is a, c, t, g, unknown, or other
  misc_feature (575)..(575): n is a, c, t, g, unknown, or other
aaagctggagctccccgcggtggcggccgctctagaactagtggatcccccgggctgcaggaattcgcacgagaccattacctagaacatcctaatcgaaaagacgcggctgaaaatttccacgaacacatagatccgcatcgtcgatccatccgtcctcctcccgacggtacgccagcctgccagagtccgacgcacgcctagggctcctggacacagcagagcccacgccttgactcgctccgttcgagtggagcgcacaggcaccggccggcgaccagagagggagcggatcgagggggctcggcttgagtggaggagatggaccgcaaggatgtcgggatcctcgccatggacatctacttcccgccctcctgcgtgcagcaggaagcacttgaggcccatgatggggcgagcaaagggaagtacaccattgggcttgggcaagattgcatggncttttgcagcgggggtggagatgtcatcttatggagtttttgacggttgtcaattctctgctngaaaaatacaagattgatcccaagctaattggncccttggnnaggggggnaaantgaaaacagttatagacaaaagcaaatccatcaaaaactggcctggaggcagatttttttggaggaaagggatatactgggaccctttggagg

SEQ ID NO: 23821 - DNA, 636 bp, Zea mays
  misc_feature: Ceres CLONE 1394290-F
  misc_feature: Translation starting site: 184
  misc_feature (285)..(285): n is a, c, t, g, unknown, or other
  misc_feature (286)..(286): n is a, c, t, g, unknown, or other
  misc_feature (287)..(287): n is a, c, t, g, unknown, or other
  misc_feature (307)..(307): n is a, c, t, g, unknown, or other
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (324)..(324): n is a, c, t, g, unknown, or other
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (348)..(348): n is a, c, t, g, unknown, or other
  misc_feature (349)..(349): n is a, c, t, g, unknown, or other
  misc_feature (356)..(356): n is a, c, t, g, unknown, or other
  misc_feature (357)..(357): n is a, c, t, g, unknown, or other
  misc_feature (362)..(362): n is a, c, t, g, unknown, or other
  misc_feature (363)..(363): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (398)..(398): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (462)..(462): n is a, c, t, g, unknown, or other
  misc_feature (464)..(464): n is a, c, t, g, unknown, or other
  misc_feature (467)..(467): n is a, c, t, g, unknown, or other
  misc_feature (468)..(468): n is a, c, t, g, unknown, or other
  misc_feature (470)..(470): n is a, c, t, g, unknown, or other
  misc_feature (471)..(471): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (505)..(505): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (528)..(528): n is a, c, t, g, unknown, or other
  misc_feature (529)..(529): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (622)..(622): n is a, c, t, g, unknown, or other
  misc_feature (623)..(623): n is a, c, t, g, unknown, or other
  misc_feature (625)..(625): n is a, c, t, g, unknown, or other
  misc_feature (628)..(628): n is a, c, t, g, unknown, or other
  misc_feature (629)..(629): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
aaagctggagctccccgcggtggcggccgctctagaactagtggatcccccgggctgcaggaattcgcacgagaccattacctagaacatcctaatcgaaaaacaaaacacaaactctcggagacagggaagtagcgtagctagatccagagctcggcgccagagatacccgacatcctcgtcatgtctccggttgcaagcaagggagtagtgatggggacggtgggcggtgggccggtggcggcagtgggccgccgcccgtgctgctgtgccctcatctgccgnnngtggggggagggagcaactntggggnnnnnnnnnnnnnnnnnnnnnnnnnnnnnggnnngnnggggggnnggggnngggggnnnnngggggggggnnnngggggggggggnggnnnnnggnnnnnnnnnnnnggggnnnggggggggggnnnnnngggggggnnnnnnnnnnngngnggnngnngagaagaacaaaccnnnnnnnnnnnnnaggcggnannnnnaccggcgccgcgaaccnnannnnnggcgccgcccgggnnnnnnnnnnnnnnnnnnnnnnnnnnnnnnnnnnnnnnnnnnnnnnnnnnnnnnnnnnnnnnnnnnnnnnnncnncnccnncnnnnnn

SEQ ID NO: 23822 - DNA, 702 bp, Zea mays
  misc_feature: Ceres CLONE 1394292-F
caagctggagctccccgcggtggcggccgctctagaactagtggatcccccgggctgcaggaattcgcacgagaccattacctagaacatcctaatcgaaaaactactagtgatcagaccagtgagctagcgactgtaccatgcaccagctgtaggagagcctggtgttacgtaggataggagtagcgccagccgccaagtgcgcgtccggcctgtgtgcttcgacgagcaggagggagccgcaccgccgggctcccgcaatgtcgcctcctccgcccccgccgctgctgcgcaaagagctgtcacgcaggacggcgctgctgggcctgcgcctgtgggtgctggtggacatccccgtcgaaatcccccttcgcgctgatccttgggcttctcctacctccccctcgacccgtatcgggaggcatccgtaccgggaatgggcatcgcccatggcacaccgccccccgcgcccggcgggggccccacgggcgtgttccccggatccaccggtccacccaccagccccaacggaaaatcccaggaaggtgggcctaacgctcggcgcgcggccaatgccgaactattggcgttcgcaggccgtggggcgcgcaggctcaccacaagtgccctcctccgacccactggacgcttgccccccgcccgccccaccggaagcccccgacgccccgaaggcggcgtacg

SEQ ID NO: 23823 - DNA, 635 bp, Zea mays
  misc_feature: Ceres CLONE 1394297-F
  misc_feature: Encodes the peptide sequence at SEQ ID NO. 23824
  misc_feature (329)..(329): n is a, c, t, g, unknown, or other
  misc_feature (351)..(351): n is a, c, t, g, unknown, or other
  misc_feature (364)..(364): n is a, c, t, g, unknown, or other
  misc_feature (565)..(565): n is a, c, t, g, unknown, or other
  misc_feature (569)..(569): n is a, c, t, g, unknown, or other
  misc_feature (605)..(605): n is a, c, t, g, unknown, or other
aaagctggagctccccgcggtggcggccgctctagaactagtggatcccccgggctgcaggaattcgcacgagaccattacctagaacatcctaatcgaaaaaatcaactcgtttctctccgattgctcctccgagtccgagactccgttctctcccgcatccaccgccgtctcatccccaatccgagcaacgcctcccctcgcctccaaaaccctacccctcctgtcaccggcgggggcatgaaccggtgatcgcttacctggtctcgtctgtctgcgcacgcgcgaggtcagtgagtgagcattgcggtggtccgatcgcccgcggngggccatggcgtctgtggcggnatcgggcggcggngcaagcgcgggggccggtgggttgaagacttacttcaagacccccgaggggcggcacaagctgcagtacgagaagacgcactcccccgccgtcgtgcactacaaccacaacggcaagaccgtcgcccagatgacggtggcatatttgaaaggagaagcagcaggccagggtttcacgccttcacaccaagtggctggtagntggngatgcgtctgcagctgcgagactgcttggcactggnaatggtagccggacacttagcttcgggagc

SEQ ID NO: 23824 - protein, 92 aa, Zea mays
  misc_feature: Ceres CLONE 1394297-F
  misc_feature (6)..(6): Xaa is any aa, unknown, or other
  misc_feature (77)..(77): Xaa is any aa, unknown, or other
  misc_feature (79)..(79): Xaa is any aa, unknown, or other
  misc_feature (91)..(91): Xaa is any aa, unknown, or other
MASVAXSGGGASAGAGGLKTYFKTPEGRHKLQYEKTHSPAVVHYNHNGKTVAQMTVAYLKGEAAGQGFTPSHQVAGXWXCVCSCETAWHWXW

SEQ ID NO: 23825 - DNA, 645 bp, Zea mays
  misc_feature: Ceres CLONE 1394312-F
  misc_feature: Translation starting site: 399
  misc_feature: SWISSPROT Homolog: EC 2.7.11.1 Non-specific serine/threonine protein kinase
  misc_feature (588)..(588): n is a, c, t, g, unknown, or other
  misc_feature (603)..(603): n is a, c, t, g, unknown, or other
aaagctggagctccccgcggtggcggccgctctataactagtggatcccccgggctgcaggaattcgcacgagaccattacctagaacatcctaatctaaaaaggcagggcgccaattgcggtggccaccacttccaatccactccccgtgttcgcctcgccgagctgttcttgctctgtcctctctccaactccacgatttgttccacacccggttcccgagcctccgcagcgcttcttgctgaaaaagggaactccgagttctccagctctggatcggcagagagcggtggttccttttgcggactctgaggtccagttcttgtttttgatttgtctcatcaacccaccagtcgggctgcaggcttaaagctggaaggaataatttgactagagaaatggggcagtgttgcagcagagctacggccccggactctggacggggaagtgccaatggttatggctattctaacccagcaaagccggcgcaagcacctccgagttacaaccctcctcagcaggcggccgaggtgaggtacacaccatcggcgacgaactcttcggcagtcccacccgtgcctgtgccgnccgagccaacggcgnacaccgatccttgcaaagcagtacgaagacgtgcgctctgtc

SEQ ID NO: 23826 - DNA, 632 bp, Zea mays
  misc_feature: Ceres CLONE 1394314-F
  misc_feature: Encodes the peptide sequence at SEQ ID NO. 23827
  misc_feature (580)..(580): n is a, c, t, g, unknown, or other
  misc_feature (585)..(585): n is a, c, t, g, unknown, or other
aagctggagctccccgcggtggcggccgctctagaactagttgatcccccgggctgcaggaattcgcacgagaccattacctagaacatcctaatcgaaaaaccagggtttcggacaaccgtctctctccctctctagtctctactgcttctccgccgtcggcggctctccgagtccggtatccccgtctccccatcggcgtcgtcgggtttaggttcatcacagcgtcccgttctcctatgcacgccgtcacgcgcaaaggcacgaagcgccggtcgtcgagcaacaaggctgtttggcccaggcacgcagccaacggaggggccactaccacacggcgtgcattccgccacccgtgaagccacatttacttcccccagccgccagccaatcaaacctaccagttccagccagagccagccttccccttcgccatggcggcctccgccgcagctcaacgtagatctgcaggaagtaggacgacgtacgagagggcagagctcgaggcgctcagggacgccccgtcgaagggagctcacgcgcgggtctggggcgacgtccgcgctaccctttgtcgctnccggntctccggtgagtatgacgggctgctcgttgcccgagaagacgtgagg

SEQ ID NO: 23827 - protein, 66 aa, Zea mays
  misc_feature: Ceres CLONE 1394314-F
  misc_feature (49)..(49): Xaa is any aa, unknown, or other
  misc_feature (51)..(51): Xaa is any aa, unknown, or other
MAASAAAQRRSAGSRTTYERAELEALRDAPSKGAHARVWGDVRATLCRXRXSGEYDGLLVAREDVR

SEQ ID NO: 23828 - DNA, 656 bp, Zea mays
  misc_feature: Ceres CLONE 1394317-F
  misc_feature: Encodes the peptide sequence at SEQ ID NO. 23829
  misc_feature (467)..(467): n is a, c, t, g, unknown, or other
  misc_feature (469)..(469): n is a, c, t, g, unknown, or other
  misc_feature (513)..(513): n is a, c, t, g, unknown, or other
  misc_feature (515)..(515): n is a, c, t, g, unknown, or other
aagctggagctccccgcggtggcggccgctctattactagtggatcccccgggctgcaggaattcgcacgagaccattacctagaacatcctaatcgaaacataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcatcgtgggcggcggcacggccgggtgcccgctggccgccacgctggcggagcgcttccgcgtgctgctgctggagcgcggcgcctcggcctacgacgacgaccgcatcggggacatggcccgcttcgcggacacgctgtcggacacctccccgggctcgccccgngnagggcttcccgccggaggacggggtcatcaactcccccccccgncncgtgggcgggagccggctgcatcaacgcccgccttctacatgcgggcgcagcgaccactaacttgcggggccccccggcggggacctggggccgccccccggggcgggctaaaccggtggcttgcaacaaagagttccgca

SEQ ID NO: 23829 - protein, 170 aa, Zea mays
  misc_feature: Ceres CLONE 1394317-F
  misc_feature: SWISSPROT Homolog: EC 4.1.2.10 Mandelonitrile lyase
  misc_feature (108)..(108): Xaa is any aa, unknown, or other
  misc_feature (123)..(123): Xaa is any aa, unknown, or other
MSGRSRHFTMSTLLATSFFFVLLCSSLQVRGVNYTFVKDAALAPSVSYYDYIIVGGGTAGCPLAATLAERFRVLLLERGASAYDDDRIGDMARFADTLSDTSPGSPRXGLPAGGRGHQLPPPXRGREPAASTPAFYMRAQRPLTCGAPRRGPGAAPRGGLNRWLATKSSA

SEQ ID NO: 23830 - DNA, 647 bp, Zea mays
  misc_feature: Ceres CLONE 1394318-F
aaagctggagctccccgcggtggcggccgctctagaactagtggatcccccgggctgcaggaattcgcacgagaccattacctagaacatcctaatcgaaaaaagcaaattgcatttcaagtcttttgggtttatacagcacagataaaggcggcagcggcagcagcagagcagcctaccttttcccctctccacctcccgcaagcaaactcacggtcacggcaccgcccccgcacccactgccctctagcttcttcctccccgctttcatggcaggaaaggctgaggcgatgatgcccataggccatccagtttgatccatgccatcctgaacctctatacatactgccccagcccgggcactcgcgatctctacttctctaccgccgctgtgcctgtgctagctcctctctctgcttctgcttctgcttttgcctcactcagcctgctgcaagcttttgctttggtttaggtgcttcttttgcattcctttactgttcccccccactttcgctcgctttgccacgcacacgaaaagctcctgcctttaccttctcggaccttatctccgccccgtagtgggatttgggtgggagctgcgctgcagctgcttgccccctcgcgtttctttgctcaattgggggtgt

SEQ ID NO: 23831 - DNA, 637 bp, Zea mays
  misc_feature: Ceres CLONE 1394325-F
  misc_feature: Encodes the peptide sequence at SEQ ID NO. 23832
aaagctggagctccccgcggtggcggccgctctagaactagtggatcccccgggctgcaggaattcgcacgagaccattacctagaacatcctaatcgaaaaaaaaagccttgcccttccctgctcctcctcgttctctgtgatgctgaggctaaaagctctcacctccctgctcctgctcctcctcctcgctctctgctccggtgttcatctgtgcgacgcgaggagtcggacgacgcgaggcggcagcggggcggcaccgtccgcctccgctgctgcgatcgggaggaaagggaaagcgaggagcagcggctcctcccacaggcaaagcggcgaagggagtcggagcccgaccgaaggcgaccccgtgcagggcgatggaagccaggctccagcacaggatacggtcttcagcgtgttggagttcggagccaagggtgacggcgttacagacgacactcaggcctttgaagcagcgtgggcagcagcgtgcaaggtggaggcgtctacggttcttgtaccatctgggctcgagtttgtcgtgggcccgatctcgttctctgggccttactgtaaaccgaacatcctgttccagctagatggaactattttggcccaaaccagcgcaagagcgtgg

SEQ ID NO: 23832 - protein, 165 aa, Zea mays
  misc_feature: Ceres CLONE 1394325-F
  misc_feature: SWISSPROT Homolog: EC 3.2.1.15 Polygalacturonase
MLRLKALTSLLLLLLLALCSGVHLCDARSRTTRGGSGAAPSASAAAIGRKGKARSSGSSHRQSGEGSRSPTEGDPVQGDGSQAPAQDTVFSVLEFGAKGDGVTDDTQAFEAAWAAACKVEASTVLVPSGLEFVVGPISFSGPYCKPNILFQLDGTILAQTSARAW

SEQ ID NO: 23833 - DNA, 642 bp, Zea mays
  misc_feature: Ceres CLONE 1394332-F
  misc_feature: Encodes the peptide sequence at SEQ ID NO. 23834
aaagctggagctccccgcggtggcggccgctctagaactagtggatcccccgggctgcaggaattcgcacgagaccattacctagaacatcctaatcgaaaatggagaaatctggacagaatgctcatatattgttgtctatgttagtcaagcatcttgaacacaagaatgtattgaaacaaccagatatgaatctagatatcattgaagttacttcacgccttgctgaacactccaaagctcagtcttctatagcactaatgtcttcaataagtgatatggtcaggcatatgggtaaaagcatgcaatccttggccagtgatgcaggtcctggagacaacatggtcaaatggaatagcagatatgggaaagctgtagatgaatgtcttgttcagttgtctagaaaggtcggtgatgctggacctatccttgatacgttagctgtagtactggaaaatatttcgagttctatgattgttgcacggtctactatctctgcagcatatcgcactgctcaaatagttgcatcattgccaaacttgtcacatcagagcaaagcatttccctgaggcgttgtttcatcaacttcttttagcaatgctctatccagattgtgagacacatttaggagcacatcggatt

SEQ ID NO: 23834 - protein, 155 aa, Zea mays
  misc_feature: Ceres CLONE 1394332-F
MEKSGQNAHILLSMLVKHLEHKNVLKQPDMNLDIIEVTSRLAEHSKAQSSIALMSSISDMVRHMGKSMQSLASDAGPGDNMVKWNSRYGKAVDECLVQLSRKVGDAGPILDTLAVVLENISSSMIVARSTISAAYRTAQIVASLPNLSHQSKAFP

SEQ ID NO: 23835 - DNA, 636 bp, Zea mays
  misc_feature: Ceres CLONE 1394333-F
  misc_feature: Encodes the peptide sequence at SEQ ID NO. 23836
agagctggagctccccgcggtggcggccgctctagaactagtggatcccccgggctgcaggaattcgcacgagaccattacctagaacatcctaatcgaaaaagagcagccgacaactctctaccgtccgagaccccaagcaccagcgcggcggcggcggcggcggcgaccatgggtgtcgggaagaacaagaggatctccaagggaaagaagtttaagatctgttccacagatcacgcgtgcgcgctcgcgaatcgggggttccacacatagcttcgtcgttttgaatttgatgtactaatggagtctaagggtggcaagaagtctagcagtagtcgttccatgatgtatgaagctccccttggctacagcattgaggacgttcgacctgccggaggcgcgaagaagttccagtctgctgcttactccaactgcgcaaagaagccatcctgatatcccttttggcttcctcgttctagtaggttaggatttcttttctgacacttcgattcttaccaatccccctggcctgctgctttcctgacaatcgagcagctccccagtcttgctcactgcagtcctccctcctcatctccagcgttgtgttctgactcagctgcaccaatggctgttctt

SEQ ID NO: 23836 - protein, 50 aa, Zea mays; identical to SEQ ID NO: 23071
  misc_feature: Ceres CLONE 1394333-F
  misc_feature (1)..(50): Pfam Name: AdoMetDC_leader Pfam Description: S-adenosyl-l-methionine decarboxylase leader peptide

SEQ ID NO: 23837 - DNA, 551 bp, Zea mays
  misc_feature: Ceres CLONE 1394343-F
  misc_feature: Encodes the peptide sequence at SEQ ID NO. 23838
  misc_feature (303)..(303): n is a, c, t, g, unknown, or other
  misc_feature (319)..(319): n is a, c, t, g, unknown, or other
  misc_feature (320)..(320): n is a, c, t, g, unknown, or other
  misc_feature (350)..(350): n is a, c, t, g, unknown, or other
  misc_feature (352)..(352): n is a, c, t, g, unknown, or other
  misc_feature (358)..(358): n is a, c, t, g, unknown, or other
  misc_feature (360)..(360): n is a, c, t, g, unknown, or other
  misc_feature (511)..(511): n is a, c, t, g, unknown, or other
aaagctggagctccccgcggtggcggccgctctagaactagtggatcccccgggctgcaggaattcgcacgagaccattacctagaacatcctaatcgaaaaactagtaccgccacacgaattcccgaccccgatggcgacatcgccaccgcagaaccctagctccggcgagccctccgatgcgtcgagcctcgcagccgcggcgctcgaggcgcccgtgcgcgtatggagatccctcgtcgcgcgcttccctcccctcccggactcctccagcttccttgctggcgtctccgacctccagcntccgctactttcgggnnaacagccgggcccccgccgggcgcaggggngntttccngnttcttaactcccccctttccccccccgggggcccggccacctccggctccgaattggtttggggaaaaaaggccccaaggcccttttggggtcctaaaaggggggggggggcaaaacccccccctgggataaattttttggggccccgggnttttcccacaaaaatttttttttttttgtggggggggccc

SEQ ID NO: 23838 - protein, 77 aa, Zea mays
  misc_feature: Ceres CLONE 1394343-F
  misc_feature (57)..(57): Xaa is any aa, unknown, or other
  misc_feature (63)..(63): Xaa is any aa, unknown, or other
  misc_feature (73)..(73): Xaa is any aa, unknown, or other
  misc_feature (76)..(76): Xaa is any aa, unknown, or other
MATSPPQNPSSGEPSDASSLAAAALEAPVRVWRSLVARFPPLPDSSSFLAGVSDLQXPLLSGXQPGPRRAQGXFPXS

SEQ ID NO: 23839 - DNA, 656 bp, Zea mays
  misc_feature: Ceres CLONE 1394395-F
  misc_feature: Encodes the peptide sequence at SEQ ID NO. 23840
  misc_feature (64)..(64): n is a, c, t, g, unknown, or other
  misc_feature (656)..(656): n is a, c, t, g, unknown, or other
tccttctggagctccccgcggtggcggccgctccattacaaaagcatcccccgggctgcagganatcacacgagaccattacctagaacatcctaatcgaaaaaaatcccaccacccttttccccttccaaccctcgggatctctccggcccgccatggaagtgttctactacctcgtgttcggcgcgctcgccgccatcgtggcggcgctggagctcgccaagtccggcaaggaccgcgtcgccacctccccggccttcaactcatttaagaacaactacatcctcgtttactccctcatgatgtctggggactggctgcaggggccctacgtgtactacctctacagccagtacggcttctatcagggcgacattggccgcctcttcatcgccggcttcggttcctccatgctcttcggcaccatcgtcggatccctcgcggataagcaggggcggaagagggcgtgtgtcacgtactgcatcacctacatcctcaggtggatcaccaaggattctccccagtaccaaggtcttaatgattgggcggggccctggggggaattggcacttcgctgctctttctcaccgttttgagccggggctccggggcagagccccaccaaaaaagggttttggatcccaaagggtggccgn

SEQ ID NO: 23840 - protein, 146 aa, Zea mays
  misc_feature: Ceres CLONE 1394395-F
  misc_feature (4)..(146): Pfam Name: DUF791 Pfam Description: Protein of unknown function (DUF791)
MEVFYYLVFGALAAIVAALELAKSGKDRVATSPAFNSFKNNYILVYSLMMSGDWLQGPYVYYLYSQYGFYQGDIGRLFIAGFGSSMLFGTIVGSLADKQGRKRACVTYCITYILRWITKDSPQYQGLNDWAGPWGELALRCSFSPF

SEQ ID NO: 23841 - DNA, 645 bp, Zea mays
  misc_feature: Ceres CLONE 1394397-F
  misc_feature (22)..(22): n is a, c, t, g, unknown, or other
tccatttgtagctttcttaggnggcggccgctctataactagtggatcccccgggctgcaggaattcccacgagaccattacctagaacatcctaatcgaaaaaataattctagtattccaccgccgcacacctcctgtcttccttcaccttcgcgctccgccgccgccgtcgattcgtgctgctctcacccctaacctgtccaacatcgccggggagggaagcagcagaagaagctccccttacctccggctatcgcctgaggataaagtggggtctgtaggggagtcttaggggggagcaaaagggataggatagggagagatgaagcaatcaatttcttcgtccgccttcgcccctgcttacgtccccgctactaaccctaggatcattctgtcttttctcgtttcttatccgactcttcttcgttttatgcctatcagttatgaggttgaacgccttcagaagcttctctactagattagtggtaatagtagacttgttcgagtttagcttggctgggaagattagtctctggtccgtgtttatatctgctagcaataatggctgcgatgaacggagaggtatttggtgaatgtggaaagaacataaatagcctcaagagaaagcgggagagccccgctgg

SEQ ID NO: 23842 - DNA, 657 bp, Zea mays
  misc_feature: Ceres CLONE 1394400-F
  misc_feature: Encodes the peptide sequence at SEQ ID NO. 23843
aaagctggagctccccgcggtggcggccgctctagaactagtggatcccccgggctgcaggaattcgcacgagaccattacctagaacatcctaatcgaaaagcaccccccattcgaacgccggagctcgacaaggacgaccgacgacgcacgcggagatgcggcgtactgcaaattttgaaaactgaactgcaagatggcatcaccagagctttcccgtgaggaaaatgcgtacatggcgaagctcgctgagcaggcgccgaggtacgacgagatgcttgagttcatggacaagggagccaagactgctgactcggaggagctcactgtgcaggagcgaaacctcttgtctgttgcatacaagaacgtcattggagcccgccgcgcctcatggcgcatcatctcctccatccagtagaaggattagggccgaggcaatgaggaccgagtaacactcatcaaggagtatcgtggcaagattgagactgagctgaccaagatctgtgatggcatcctcaagctgcttgagacccatcttgtgccgtcttccactgcccccgagtccaaggtcttctatctcaagatgaagggtcatcactacagataccttgctgagttcaagactggagctgagacaaaggacgccgctgagaacac

SEQ ID NO: 23843 - protein, 73 aa, Zea mays
  misc_feature: Ceres CLONE 1394400-F
MASPELSREENAYMAKLAEQAPRYDEMLEFMDKGAKTADSEELTVQERNLLSVAYKNVIGARRASWRIISSIQ

SEQ ID NO: 23844 - DNA, 816 bp, Zea mays
  misc_feature: Ceres CLONE 1394407-F
  misc_feature (16)..(16): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (80)..(80): n is a, c, t, g, unknown, or other
tttttttttttttttngtgttgctcgcgcttcttgtccacagcccccccggcgttcgagtgtgaatagaagggggnnntnacaaagctggactccaccgcggtggcggccgctctattactagtggatcccccgggctgcaggaattcgcacgagaccattacctagaacatcctaatcgaaaacttccgtccttggcaaccaggcccaggcatcgtttcaccgctattcctcctgccccatctcctcccgatccatccgagcccaaaccctagtccagccagatctccgccgccgccggcgagagcacggcatcagatccgccgagacggagttccgccgcatcttatcgacagtggtgcgccgccgctccggcactcgccccggccaccgacccgaaacactcgcgaacgcctcccggggcccgccccccacggaaacccggctgggtggtaaatcacccccaccccccaccccggggggggtgggttttcccgtagacgccccccaccatatccgattgccccccgcatcctcctctaaaccgccccccgcctccccccccccggtgttgtttgctcacacccgacagcgcaagacccacttcccttcccgacacaacgacacgcctttcgtttttaagacgccgctttcgcgatggcacccccaccgggacgcactcccctgtccgtcccacccagaaacctctagatcccactacaccattgcttgaccaccacacatattatctgccccgatatcgacggcatttttccccccctccatactctccaattgccacaaacgaacctaccct

SEQ ID NO: 23845 - DNA, 655 bp, Zea mays
  misc_feature: Ceres CLONE 1394411-F
  misc_feature: Encodes the peptide sequence at SEQ ID NO. 23846
tggagctccccgcggtggcggccgctctagaactagtggatcccccgggctgcaggaattcgcacgagaccattacctagaacatcctaatcgaaaaacacactgctcgttctcacgacaaattcgattcatcaaaatctacaaacgtagtagtatttacgagaatagatattacaggcccaaacagctgctgcttctgttgaagcacgccgcaccggcagacgttacccctccaatgggcgaatgcagaacggagtacaggggcctgcccgacgccaatggcgaggacgcggggacggtgccggccgcgctccgcaaggtgtccatagtcccgctcgttttcctcatcttctacgaggtctccggcgggccgttcggcatcgaggacagcgtgggcgcagcggggccgctcctcgccatcgtcggcttccttgtcctccccgtcatctggagcatcccggaggcgctgattaccgcggagctgggcaccatgttcccggagaacggcgggtacgtcgtgtgggtcgcctcggcgctcggcccctactggggattccagcaagggtgggtgaagtggctcagtggcgtcatcgacaatgccctgtaccccgtcctcttcctggactacctcaagtccgccgtgcctgccctgggc

SEQ ID NO: 23846 - protein, 140 aa, Zea mays; identical to SEQ ID NO: 20061
  misc_feature: Ceres CLONE 1394411-F

SEQ ID NO: 23847 - DNA, 649 bp, Zea mays
  misc_feature: Ceres CLONE 1394415-F
  misc_feature: Encodes the peptide sequence at SEQ ID NO. 23848
tggagctcaccgcggtggcggccgctctagaactagtggatcccccgggctgcaggaattcgcacgagaccattacctagaacatcttaatcgaaaaaaaccgccctcttgtgctctccctgtccctgccctcccccgctataataccgccacgccctcgtcgccatcgtcaccacaccaccactccctccctgccctctcactcccgatccctcctccaccaccgcttcctccgcgtcacccctctcgtcgtcgcctcacgaggcgaccagcggcggaccctccgcggcgcaaccatggggctcttcaccgtgacgaagaaggccaccacgcccttcgacggccagaagcccggcacctccggcctccgcaagaaggttactgtattccagcagccccattatctgcagaactttgtccaatcaacattcaatgcccttcctgtggatcaagtaagaggtgcaacaattgttgtctctggtgatggccgctatttctcaaaagatgctgttcagatcataacaaaaatggctgctgccaatggagtaagacgtgtttgggttggacaaaacagtctcatgtctactcctgctgtatctgctgtcatccgtgaaagagttggtgcagatggatcaaaggctactggtgc

SEQ ID NO: 23848 - protein, 117 aa, Zea mays
  misc_feature: Ceres CLONE 1394415-F
  misc_feature (16)..(117): Pfam Name: PGM_PMM_I Pfam Description: Phosphoglucomutase/phosphomannomutase, alpha/beta/alpha domain I
  misc_feature: SWISSPROT Homolog: EC 5.4.2.2 Phosphoglucomutase
MGLFTVTKKATTPFDGQKPGTSGLRKKVTVFQQPHYLQNFVQSTFNALPVDQVRGATIVVSGDGRYFSKDAVQIITKMAAANGVRRVWVGQNSLMSTPAVSAVIRERVGADGSKATG

SEQ ID NO: 23849 - DNA, 642 bp, Zea mays
  misc_feature: Ceres CLONE 1394429-F
  misc_feature (458)..(458): n is a, c, t, g, unknown, or other
aaagctggagctccccgcggtggcggccgctctagaactagtggatcccccgggctgcaggaattcgcacgagaccattacctagaacatcctaatcgaaaaaacctttggtctccccccgccgctccatcccataccgctctcgcacgacgagcccacagatgcggcaagatcgaatccatggcgagagctagcagaagccgcgggcttggtgcttgaaccctcgatccttcttggaggtcccccccgttccttctccttgcattgctcgcgttcctcgacgcgagcagaccagcacagagagaagaagaaaaaaaaaggagggttctttctcgcgtttcttctgtctattctgcggttctttcttggaagcagtaatgaggcggcatgggtggcagctcccgtaccatcctctccaggtggtggccgtgtccgtcttcttggcgctgggcttcgcngtctacgtcttcttcgcacccttcgttgggaggatgtgttccagtacgtggtcatagggctctacactcccctgttttatggggcctccttctatacatctggggtgctgcagcaaacccagcagatccccgggtcctcaaatcaaagaaatatctgagcttgtacggaagccgcaaacacagg

SEQ ID NO: 23850 - DNA, 624 bp, Zea mays
  misc_feature: Ceres CLONE 1394430-F
  misc_feature: Encodes the peptide sequence at SEQ ID NO. 23851
aaagctggagctccccgcggtggcggccgctctagaactagtggatcccccgggctgcaggaattcgcacgagaccattacctagaacatcctaatcgaaaatttctctcaatctctctcttctcctcgcctcgccttggtgttcacgccgtcgctagcgcctgccgcggcgaagcttctgtcctccccggcgccgggctcgggtcgtcgtcggccaggaagatggctggcggcttcagggtactgcatctggtcaggccttttctggctttcttgccagaggtgcagagcgcggataggaagatacctttcagagaaaaagttatatacactgttatttccctcttcattttcctggtctgcagccagctcccactctatggcattcattcaacaactggagctgatcctttctactggatgcgtgttatcctcgcatcaaaccgtggcactgtgatggagttgggtattactccaattgtgacatctgggatggtaatgcaacttcttgttggatcgaagatcattgaagttgacaacagtgtgagagaagatcgtgctctgctgaatggtgcacaaaagttgcttggtatcctgatttgctatggggaagctgtggcatat

SEQ ID NO: 23851 - protein, 134 aa, Zea mays
  misc_feature: Ceres CLONE 1394430-F
MAGGFRVLHLVRPFLAFLPEVQSADRKIPFREKVIYTVISLFIFLVCSQLPLYGIHSTTGADPFYWMRVILASNRGTVMELGITPIVTSGMVMQLLVGSKIIEVDNSVREDRALLNGAQKLLGILICYGEAVAY

SEQ ID NO: 23852 - DNA, 643 bp, Zea mays
  misc_feature: Ceres CLONE 1394438-F
  misc_feature: Encodes the peptide sequence at SEQ ID NO. 23853
  misc_feature (370)..(370): n is a, c, t, g, unknown, or other
  misc_feature (393)..(393): n is a, c, t, g, unknown, or other
  misc_feature (401)..(401): n is a, c, t, g, unknown, or other
aaagctggagctccccgcggtggcggccgctctagaactagtggatcccccgggctgcaggaattcgcacgagaccattacctagaacatcctaatcgaaaaagctagccaagctataccactagaaccagagcacaactcaaagcaatgccgccgcctcctcctcctccgccccactcccacgcttcccatcccgcgccgcatggacgcgagcagcactagcgcgggggcacacagcacggcgagcggccgggggcgcgacgatggacctgagcggatcgatggtgatggacgcgggcgcctcggagctgggcctgctcggcggcggatctagcaggctgctcaagcacgggcggggccccaatgcacnccaaccaagacgacgacgtgtgnttcgccgncaggcccaaacagcccatgacagggacagcgcccgtcgtcgccggagacggggcgggatgcaccaatgccgacgccggcgccgttcctggctgggctcgggcatcccccgccacggcggtgaagcagatgctaaatttctccgcccgccgccggcgcccgccgggttctcgggcgcctcctaccaccgttgagcttgatggcaaggcgaccatgcccggtggactaacgggacccccggccc

SEQ ID NO: 23853 - protein, 109 aa, Zea mays
  misc_feature: Ceres CLONE 1394438-F
  misc_feature (36)..(36): Xaa is any aa, unknown, or other
  misc_feature (44)..(44): Xaa is any aa, unknown, or other
MDLSGSMVMDAGASELGLLGGGSSRLLKHGRGPNAXQPRRRRVXRRQAQTAHDRDSARRRRRRGGMHQCRRRRRSWLGSGIPRHGGEADAKFLRPPPAPAGFSGASYHR

SEQ ID NO: 23854 - DNA, 626 bp, Zea mays
  misc_feature: Ceres CLONE 1394439-F
  misc_feature: Encodes the peptide sequence at SEQ ID NO. 23855
aagctggagctccccgcggtggcggccgctctagaactagtggatcccccgggctgcaggaattcgcacgagaccattacctagaacatcctaatcgaaaaatctcgaccacgaaacgtacggacttcgggcatcggccccaacgccagagaaaccgcaccaccacgcccgtcggcgacatgaatccgcccggagcagccgcggccaccgaagcaggaggccacgccgtggtgcctgcgtcagaccgggagtacgtgcactacccgaggctctcgccagaggaggtggacccgcccccgcccccgccttatcacgacgccaccgacgcgccgaccgcctacggaggtaacccctacatctactcccccgccggaggcgccgccacctccccgaataatacgatggactccgtgaaggacgggctctccaagatgccaaagaggtttgcagaggcgtcccgcaagaccgagaccatcaccggtaatttctggaagcactgcgagctgctcgattgcggtgacgtattttcacgaaatcgccttccgacgctgtgtctgtgcggttgtcatcacattgataatccgtgtatgcattgtaaatggacatattgctactgtaacatgaac

SEQ ID NO: 23855 - protein, 149 aa, Zea mays
  misc_feature: Ceres CLONE 1394439-F
MNPPGAAAATEAGGHAVVPASDREYVHYPRLSPEEVDPPPPPPYHDATDAPTAYGGNPYIYSPAGGAATSPNNTMDSVKDGLSKMPKRFAEASRKTETITGNFWKHCELLDCGDVFSRNRLPTLCLCGCHHIDNPCMHCKWTYCYCNMN

SEQ ID NO: 23856 - DNA, 652 bp, Zea mays
  misc_feature: Ceres CLONE 1394449-F
  misc_feature: Encodes the peptide sequence at SEQ ID NO. 23857
  misc_feature (318)..(318): n is a, c, t, g, unknown, or other
  misc_feature (349)..(349): n is a, c, t, g, unknown, or other
  misc_feature (409)..(409): n is a, c, t, g, unknown, or other
  misc_feature (410)..(410): n is a, c, t, g, unknown, or other
aaagctggagctccccgcggtggcggccgctctagaactagtggatcccccgggctgcaggaattcgcacgagaccattacctagaacatcctaatcgaaaaatcggctgtcgagtcgtcgcaaggtgttgctcgccgtatctcctttccccctcctccctgcgtcccccggctccggcgatccgccgcacctgaacccttctccacgtcgcctcgccggttgggttgaggtgagccgatcagatccgatcggggccggtccttgcgccactgctgcgtgagctcatctcggtcgaccgcctgcttggctcgatcggncggggacggcggcggccagatctgcaatggnagggcacaaggacgacgcggccaagtgcctgcgcatcggcaagggcgcgctcgacgccgnngaccgcgcgcgcgccatcaagttcctggtcaaaggaaaggcgctggacccctcgctgcccatcgaagaactcctcaccttcctttttcaaccccaagggggactcccaggttccttcgcccccggcgttttccccaccggaaattggccaaaaagggccatcgaggcaattgaggttgtagggcttaaaaaaaaaacccaggggcaaaaaaagggggggggggggccctcggaaaaacccca

SEQ ID NO: 23857 - protein, 102 aa, Zea mays
  misc_feature: Ceres CLONE 1394449-F
  misc_feature (2)..(2): Xaa is any aa, unknown, or other
  misc_feature (22)..(22): Xaa is any aa, unknown, or other
MXGHKDDAAKCLRIGKGALDAXDRARAIKFLVKGKALDPSLPIEELLTFLFQPQGGLPGSFAPGVFPTGNWPKRAIEAIEVVGLKKKTQGQKKGGGGPSEKP

SEQ ID NO: 23858 - DNA, 666 bp, Zea mays
  misc_feature: Ceres CLONE 1394452-F
  misc_feature: Encodes the peptide sequence at SEQ ID NO. 23859
  misc_feature (306)..(306): n is a, c, t, g, unknown, or other
tggagctccccgcggtggcggccgctctagaactagtggatcccccgggctgcaggaattcgcacgagaccattacctagaacatcctaatcgaaaacacttcccgtgtttctaactccggtggctccaccaccagcaacccgtgcagcgagcccaccccgaccactgccatgtcgaggcgcggcgactgggtctacgagaacaacggcgggacctgcgtggccatcgccggcgccgattactgtgtcgtcgcggcggacacccgcctctctgtcggatacagcatcctcacgcgcgaccactctnagatctgcgacctgcctgacaaatgtgtactagcatcttctggctttcagggtgatattaaaggtctgaacaagaacctagttgccagagaaattgtttcccacccccgcttacccaagggtggactgccctgcctggcaaaattccctcccataccctgaactaaagggtttttcccaataaacctttcaagggccccgggggctttcaacgaggggaaaagggggggtttccccataaagggaaaagtccccaaaaaaaaatggttatttggcctcgggaacggggtccttttttttttttcccgccggggaaaaaaaaaaaaaaaaaccaattcttttttggtccccccccgaggag

SEQ ID NO: 23859 - protein, 98 aa, Zea mays
  misc_feature: Ceres CLONE 1394452-F
  misc_feature: SWISSPROT Homolog: EC 3.4.25.1 Proteasome endopeptidase complex
  misc_feature (46)..(46): Xaa is any aa, unknown, or other
MSRRGDWVYENNGGTCVAIAGADYCVVAADTRLSVGYSILTRDHSXICDLPDKCVLASSGFQGDIKGLNKNLVAREIVSHPRLPKGGLPCLAKFPPIP

SEQ ID NO: 23860 - DNA, 642 bp, Zea mays
  misc_feature: Ceres CLONE 1394456-F
  misc_feature: Encodes the peptide sequence at SEQ ID NO. 23861
aaagctggagctccccgcggtggcggccgctctataactagtggatcccccgggctgcaggaattcgcacgagaccattacctagaacatcctaatcgaaaaagtttgttcaactacatacgcaaatcggaatcgaaaccctatctcggatccgatggctcgttcgccgccgccttcttcgtcggccggcggcgcgcagtacgcgcagcagttcctcaacacggcgctctcccagcgggggccgtccgcgctgccgtacgccgaggacgtcaagtggctcatccgcaaccacctggtggcgctggccgaggccttcccctccctccatcccaaggccgccctcttcacccacaacgacggccgcgccgctcacctcctccaggccgacggcaccatccccatccaccacgccggtgcctcctacaacctccccgccgtcatctggctgcccgagccctacccgcgctccccgccgctcgtcttcctctcgccgacccgagacatggtcatcaagcccccacaccgccttgtcgacagttccgggcttcgtcggcaacgcggccctacctcccgctcctgggtcttcccctcctcaaccttcgtcgacctcgtcggatccctctcgcacctattccggcctcg

SEQ ID NO: 23861 - protein, 162 aa, Zea mays
  misc_feature: Ceres CLONE 1394456-F
  misc_feature (43)..(159): Pfam Name: UEV Pfam Description: UEV domain
MARSPPPSSSAGGAQYAQQFLNTALSQRGPSALPYAEDVKWLIRNHLVALAEAFPSLHPKAALFTHNDGRAAHLLQADGTIPIHHAGASYNLPAVIWLPEPYPRSPPLVFLSPTRDMVIKPPHRLVDSSGLRRQRGPTSRSWVFPSSTFVDLVGSLSHLFRP

SEQ ID NO: 23862 - DNA, 620 bp, Zea mays
  misc_feature: Ceres CLONE 1394487-F
  misc_feature: Encodes the peptide sequence at SEQ ID NO. 23863
ctctggaactagtggatcccccgggctgcaggaattcgcacgagaccattacctagaacatcctaatcgaaaatagtcccaactcccaaccaccgccagccgtccgctctccgcaagcgcgaccttccggacagatccgccccgtcgcgccgacgagcggtccttctgcctagtttctccgcccagcgagcggcgggttcctcggagattcccgctggccgcggggatccatttgtgactgctcgcgttgcgcctggatctggtttgggacggaggagtgaaacgcgacggtgatcgtgcgaggtggggacgccatcagtgctctgtctggggttcggtctgttctttggctgccgatctggaaggttttcctgggatccgtcgctacgatctgtcccaggcagagcatctgcatcatctcgggtttgggccatggggaactctgctcatcttcggaggagcgggaacaccaagctccacccatttctcggggtccccggtaaaaagggggttagaagggtcgccttaagtcccagggcaacttacccatgggggcaaattggcgggggggtccccttccgtaattccggggcgggattcctgccggccccgccccctcg

SEQ ID NO: 23863 - protein, 62 aa, Zea mays
  misc_feature: Ceres CLONE 1394487-F
MGNSAHLRRSGNTKLHPFLGVPGKKGVRRVALSPRATYPWGQIGGGVPFRNSGAGFLPAPPP

SEQ ID NO: 23864 - DNA, 645 bp, Zea mays
  misc_feature: Ceres CLONE 1394493-F
  misc_feature: Encodes the peptide sequence at SEQ ID NO. 23865
aagctggagctccccgcggtggcggccgctctagaactagtggatcccccgggctgcaggaattcgcacgagaccattacctagaacatcctaatcgaaaaaccacggccagatcagaccaccagagtgactccaccctcgaggactccagtgtgcactgcctactcgccccacgccacccaaatcccgtcgggacgacgaataattcaagctggtgcgccgtataaatctaaccaatcgccatccgcccaccccccaaatcccaccacccttttccccttccaaccctcgggatctctccggcccgccatggaagtgttctactacctcgtgttcggcgcgctcgccgccatcgtgtcgtcgctggagctcgccaagttgggcaaggaccgcgtcgccacctccccggacttcaactcatttaagaacaactacatcctcgattactccctcatgatgtctggggactggctgcaggagacctacgtgtactacctctacagccagtacggcttcgacaagggcgacattggccgcctcttcatcgccggcttcggttcctccatgctcttcggcaccatcgtcggatccctcgcggataagcaggcgcggaagagggcgtgtgtcacgtactgcatcacctac

SEQ ID NO: 23865 - protein, 112 aa, Zea mays
  misc_feature: Ceres CLONE 1394493-F
  misc_feature (4)..(112): Pfam Name: DUF791 Pfam Description: Protein of unknown function (DUF791)
MEVFYYLVFGALAAIVSSLELAKLGKDRVATSPDFNSFKNNYILDYSLMMSGDWLQETYVYYLYSQYGFDKGDIGRLFIAGFGSSMLFGTIVGSLADKQARKRACVTYCITY

SEQ ID NO: 23866 - DNA, 655 bp, Zea mays
  misc_feature: Ceres CLONE 1394519-F
  misc_feature: Encodes the peptide sequence at SEQ ID NO. 23867
aagctggagctccccgcggtggcggccgctctagaactagtggatcccccgggctgcaggaattcgcacgagaccattacctagaacatcctaatcgaaaaaaactcaccctgcagccgccacctcatgaccctgcagcaccctcaggcctcaccgcctcagctgccaccctcaccctgcatccgagagagagagagaggagagttgccgccggagggaggaggtcgccgcggaggggaggggctcgccggtaggggacatcgccggcgcctggagagctcgtggaggggacagccaccgtcaccgccaggagacaagcgccgccgccgctaggaatcaggagacaagcgagcgcgatggtgagctccgcactgaggcgctgtctcccctgccatgcctctctctgtcatgccttccctccccatccgctgctggccgctgccggcgtcttccgtcgttcattccagtccggggatggtgagactatggacgaattcgaagaacggttgtttgggggcaaggacacagacaaaggatcactctacgagaagctcgatagggctgagaacactgcgacaggagcagttcaggatggatggatggttatgattcttttaatgatggcttaaatgatacaattgctaatgcggcacgc

SEQ ID NO: 23867 - protein, 90 aa, Zea mays
  misc_feature: Ceres CLONE 1394519-F
MVSSALRRCLPCHASLCHAFPPHPLLAAAGVFRRSFQSGDGETMDEFEERLFGGKDTDKGSLYEKLDRAENTATGAVQDGWMVMILLMMA

SEQ ID NO: 23868 - DNA, 837 bp, Zea mays
  misc_feature: Ceres CLONE 1394523-F
  misc_feature: Encodes the peptide sequence at SEQ ID NO. 23869
  misc_feature (1)..(1): n is a, c, t, g, unknown, or other
  misc_feature (2)..(2): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (18)..(18): n is a, c, t, g, unknown, or other
  misc_feature (20)..(20): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (51)..(51): n is a, c, t, g, unknown, or other
  misc_feature (52)..(52): n is a, c, t, g, unknown, or other
nntttcccccnnnnnctncnccacccccccccgcgtgnnnggtgggtgggnnttcatgttgtgactcctcttaggtggcggccgctctttaactagtggatcccccgggctgcaggatttcgcacgagaccattacctagaacatcctaatcgaaaaattcggcgactatggcggcggcaccggcaggcggcggccctcgggcattgtcccagcgggagcaggacatccagatgatgctcgccgccgatggccacctcggcaccaagaactgccacttccaggtggagcgctaccggtacaagcgccgcactgatgggatctatattattaaccgttggaaagacctgggacaagcttccggtggccgccagggtcatcgctgccccttgagaaacccgcaggacattaatcggggaggtctgctacggccttatgggggggggggggggggcctcaaggtttgggggaaaacaactgggtggccccatggccatttgcttgcgagggcgacacttccctgggaacatgttcaccaacccgggtgggccaaaaccccccctttcagggggggaggccccggccctctcttaaatcctttaccggaacccgcaggggcctggagccactccacgccccatctaacgggaggacttgcgcgccttgggaaaaaaattcccccagcccacgggcacttttcggggaaaacacggaccccccccccaaagggggccattggttgacaccctggggccctcctcgcgccgcaataacacaggggggaaaacaggaacgaaataggtaggacggggtcccggggcagcgcccgccccgaaaag

SEQ ID NO: 23869 - protein, 190 aa, Zea mays
  misc_feature: Ceres CLONE 1394523-F
MAAAPAGGGPRALSQREQDIQMMLAADGHLGTKNCHFQVERYRYKRRTDGIYIINRWKDLGQASGGRQGHRCPLRNPQDINRGGLLRPYGGGGGGLKVWGKTTGWPHGHLLARATLPWEHVHQPGWAKTPPFRGGGPGPLLNPLPEPAGAWSHSTPHLTGGLARLGKKIPPAHGHFSGKTRTPPPKGAIG

SEQ ID NO: 23870 - DNA, 690 bp, Zea mays
  misc_feature: Ceres CLONE 1394534-F
  misc_feature: Translation starting site: 260
  misc_feature (484)..(484): n is a, c, t, g, unknown, or other
  misc_feature (550)..(550): n is a, c, t, g, unknown, or other
  misc_feature (596)..(596): n is a, c, t, g, unknown, or other
  misc_feature (597)..(597): n is a, c, t, g, unknown, or other
aaagctggagctccccgcggtggcggccgctctagaactagtggatcccccgggctgcaggaattcgcacgagaccattacctagaacatcctaatcgaaaaatcgcttcagctcggcgtcttcacaaacgccggcgcaaactctcgcccgagcccgacagatcttcaattccccattccgcccaccgatcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatggccaagtgcctggagataagaccgcgggacatcacgatgatgccttcagcaccttcttcagccagactggtggctgggaagcacgttccccgtggcaatcttcgttgatctagaacccactgtgnatcgatgaggtgcgcactgggcacgtaccgccagctcttccaccctgagcagctcatcagtgggcnaaggaggatgccgctaacaatttcgcccgtggccactaccattggnnaggaaagattggttgatctgtgccttgaccgtatccgcaagcttgctgacactgcaccggcctcagggggctcctggcttcaagggggggggg

SEQ ID NO: 23871 - DNA, 630 bp, Zea mays
  misc_feature: Ceres CLONE 1394538-F
  misc_feature: Encodes the peptide sequence at SEQ ID NO. 23872
  misc_feature (383)..(383): n is a, c, t, g, unknown, or other
  misc_feature (458)..(458): n is a, c, t, g, unknown, or other
  misc_feature (498)..(498): n is a, c, t, g, unknown, or other
  misc_feature (544)..(544): n is a, c, t, g, unknown, or other
  misc_feature (551)..(551): n is a, c, t, g, unknown, or other
  misc_feature (552)..(552): n is a, c, t, g, unknown, or other
  misc_feature (554)..(554): n is a, c, t, g, unknown, or other
  misc_feature (555)..(555): n is a, c, t, g, unknown, or other
  misc_feature (569)..(569): n is a, c, t, g, unknown, or other
  misc_feature (570)..(570): n is a, c, t, g, unknown, or other
  misc_feature (578)..(578): n is a, c, t, g, unknown, or other
  misc_feature (600)..(600): n is a, c, t, g, unknown, or other
  misc_feature (601)..(601): n is a, c, t, g, unknown, or other
aagctggagctccccgcggtggcggccgctctatactagtggatcccccgggctgcaggaattcgcacgagaccattacctagaacatcctaatcgaaaactccttcccctccctctttccacgacaccaaaagaaaccgaaaaccatcgacgcgctccgtccaccctcccctaccccgcgtcctcctcccctacgcctcccagcccagcggcaaaacctaaccctagatgggcgccgtcacctctacggtcgcggcgcgctttgcctttttcccgccgagcccgccgtcgtacgggttcgagcagccggcgccgcttccggcccctgccacacccgagcctccggccccggccacatccaagccgccgcctccggccccggncacacccaagccgccgcctccggccccggccacacccaagccgccgccagcgagggaggataagggcggcggtgnggggggcggagctcacgggcgtcccgcggaggtttaccgnggaggcccgtcggtctgcggaacaaaagcggcacggaaggggttcntgatgcnncnngcgccaggcggagnnaaaggtcngggctgggtctactcccacggnnacggccgcctaccttcgggaagaatggat

SEQ ID NO: 23872 - protein, 134 aa, Zea mays
  misc_feature: Ceres CLONE 1394538-F
  misc_feature (52)..(52): Xaa is any aa, unknown, or other
  misc_feature (77)..(77): Xaa is any aa, unknown, or other
  misc_feature (106)..(106): Xaa is any aa, unknown, or other
  misc_feature (108)..(108): Xaa is any aa, unknown, or other
  misc_feature (109)..(109): Xaa is any aa, unknown, or other
  misc_feature (114)..(114): Xaa is any aa, unknown, or other
  misc_feature (117)..(117): Xaa is any aa, unknown, or other
  misc_feature (125)..(125): Xaa is any aa, unknown, or other
MGAVTSTVAARFAFFPPSPPSYGFEQPAPLPAPATPEPPAPATSKPPPPAPXTPKPPPPAPATPKPPPAREDKGGGXGGGAHGRPAEVYRGGPSVCGTKAARKGFXMXXAPGGXKGXGWVYSHGXGRLPSGRMD

SEQ ID NO: 23873 - DNA, 622 bp, Zea mays
  misc_feature: Ceres CLONE 1394541-F
  misc_feature: Encodes the peptide sequence at SEQ ID NO. 23874
  misc_feature (366)..(366): n is a, c, t, g, unknown, or other
gagctggagctccccgcggtggcggccgctctagaactagtggatcccccgggctgcaggaattcgcacgagaccattacctagaacatcctaatcgaaaagccattaagactagctaactagcgtgaaagagctcctccgacgactactagctctcgcttgctccgacgacccctgccggccgcctctggtacaacgtacgagaggaagagagacgatcgatggccggcgccaccgtgaccgtggacgaggtgaggaagggccagcgcgcgaccggccccgccaccgtgctggccatcgggacggcgacgcccgccaactgcgtgtaccaggccgactacccggactactacttccggatcaccnagagcgaccacctcaccgacctcaaggagaaaagtcagaggatgtgcgacaagtcgatgatccggaagcggtacatgcacctgacggaggagttcctgtcggagaacccgagcatgtgcgcgtacatggcggcgtcgctggacgcgcggcagaacggggtggtgacggaggtgcccaaactggggaaaggcggcggcccaaaaagggatcaggaagggggggcagcccaaagcccggataccgcaccggattgttc

SEQ ID NO: 23874 - protein, 133 aa, Zea mays
  misc_feature: Ceres CLONE 1394541-F
  misc_feature (6)..(131): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature (49)..(49): Xaa is any aa, unknown, or other
MAGATVTVDEVRKGQRATGPATVLAIGTATPANCVYQADYPDYYFRITXSDHLTDLKEKSQRMCDKSMIRKRYMHLTEEFLSENPSMCAYMAASLDARQNGVVTEVPKLGKGGGPKRDQEGGAAQSPDTAPDC

SEQ ID NO: 23875 - DNA, 653 bp, Zea mays
  misc_feature: Ceres CLONE 1394542-F
  misc_feature: Encodes the peptide sequence at SEQ ID NO. 23876
  misc_feature (314)..(314): n is a, c, t, g, unknown, or other
  misc_feature (317)..(317): n is a, c, t, g, unknown, or other
  misc_feature (353)..(353): n is a, c, t, g, unknown, or other
  misc_feature (355)..(355): n is a, c, t, g, unknown, or other
  misc_feature (359)..(359): n is a, c, t, g, unknown, or other
  misc_feature (363)..(363): n is a, c, t, g, unknown, or other
  misc_feature (365)..(365): n is a, c, t, g, unknown, or other
  misc_feature (366)..(366): n is a, c, t, g, unknown, or other
  misc_feature (376)..(376): n is a, c, t, g, unknown, or other
  misc_feature (553)..(553): n is a, c, t, g, unknown, or other
aagctggagctccccgcggtggcggccgctctagaactagtggatcccccgggctgcaggaattcgcacgagaccattacctagaacatcctaatcgaaaaatcttcttcctcgtgcgcgtgcagccgccttgcttgcggccctgcctctctcctctcctgctctcccaccggccaccgtcgccggccgccaccgtcgccgccatgcctttccgattccagttcccatggctcaagaacccaactacaaacggcggcacctccaacatagacactaaccctagcccccgcttccccaccccttccctcctatcnagnccatgtcacctcctttctctcctccttcccccgggngntccngcgncnngcgcctgggngcgatcacctcgccagcctcccactccgggccctacctactctgagatcgagaagcgctcgccggggtgcccgtgtacgcgctcgccacgcgccaaagagttcgggcttgtgcgccaaccccctggaaggcaaggggctaaaaactgagtccacgcccggctcggctgcttgtttcnggaaagaaaaacttacgctttttgaacaaagggatggtaatgccccccctctggggggcttccctggccggaaaaaggatccaaaggagggggggggggg

SEQ ID NO: 23876 - protein, 106 aa, Zea mays
  misc_feature: Ceres CLONE 1394542-F
  misc_feature (38)..(38): Xaa is any aa, unknown, or other
  misc_feature (51)..(51): Xaa is any aa, unknown, or other
  misc_feature (54)..(54): Xaa is any aa, unknown, or other
  misc_feature (55)..(55): Xaa is any aa, unknown, or other
  misc_feature (58)..(58): Xaa is any aa, unknown, or other
MPFRFQFPWLKNPTTNGGTSNIDTNPSPRFPTPSLLSXPCHLLSLLLPPGXPAXXAWXRSPRQPPTPGPTYSEIEKRSPGCPCTRSPRAKEFGLVRQPPGRQGAKN

SEQ ID NO: 23877 - DNA, 697 bp, Zea mays
  misc_feature: Ceres CLONE 1394545-F
  misc_feature: Encodes the peptide sequence at SEQ ID NO. 23878
  misc_feature (553)..(553): n is a, c, t, g, unknown, or other
aagctggagctccccgcggtggcggccgctctagaactagtggatcccccgggctgcaggaattcgcacgagaccattacctagaacatcctaatcgaaaaaacgagagcacccggaccagacgcccaagtcgatcgccatggcgatgaagccggcggcggcggctccccctaccccggccgcggcgcacagcgtgttcgtctacggcagcctgatggcggacgaggtggtccgcaccatcctcaagcgcgtcccgcccgccgccccggccctcctcccaaactaccaccggttcaacatcaagggccgcatttacccggcgatcctgcccgttgagagcaagagagttgctgggagggttatcatgggtgttactgatgaagagctccagcttcttgacgcgtttgaagacgtggagtacacgaggacaagagttgagatatcattggctgactcttccgagaacatgctggctgacacttaacgtgtggagtggatgcagaggatctcaatcttttatggagaatggggactttgaggtgatatgactggnttcctgagggccctgggggtgttaatgctatgtgattatcatggctaccgtggatcatattaaaatgatgaactctataagctactgcccggccctcgggattctaaaatttctgtttgcgccacgcacaagggaatgggtaag

SEQ ID NO: 23878 - protein, 114 aa, Zea mays; identical to SEQ ID NO: 18097
  misc_feature: Ceres CLONE 1394545-F
  misc_feature (19)..(115): Pfam Name: AIG2 Pfam Description: AIG2-like family

SEQ ID NO: 23879 - DNA, 650 bp, Zea mays
  misc_feature: Ceres CLONE 1394547-F
  misc_feature: Encodes the peptide sequence at SEQ ID NO. 23880
aaagctggagctccccgcggtggcggccgctctagaactagtggatcccccgggctgcaggaattcgcacgagaccattacccagaacatcctaatcgaaaactccgtccacatccgtcctccagcactccacctgcatcgacgaggaacgccgtagcgatttgcgaagcgaagcgggacgggagaggaacccgaggaaggcgaaaatgatctaccgcaactggtcgctgctctcgtccacaggcgtcatttggggcggcgtcgccaccgccggcctcgccggtatcttcctcttgggcggcaaggagaaattcaatggttatctgtgccgcgaaggcgagaggcttatgcagcaggacagagccgcgatgggccgaagctaagctttagcttctttggtatctcaagggagcaatagcccttggaaatttcacaagattcctgcgtccctaccagaacaagtccctatctaggatggaatccatccttctgcaggctttcactttcctgataataacagaaacaataaattgacaatgggttgtgttcttctgcaacctttttggctccctggtttcgcaagggttccgtgctttgtttggcgtcatcacttgcatgtcttggtataaaaaggttgctgttgcatttgg

SEQ ID NO: 23880 - protein, 58 aa, Zea mays
  misc_feature: Ceres CLONE 1394547-F
MIYRNWSLLSSTGVIWGGVATAGLAGIFLLGGKEKFNGYLCREGERLMQQDRAAMGRS

SEQ ID NO: 23881 - DNA, 708 bp, Zea mays
  misc_feature: Ceres CLONE 1394554-F
aaagctggagctccccgcggtggcggccgctctataactagtggatcccccgggctgcaggaattcgcacgagaccattacctagaacatcctaaaaaaaatcttatttcactgccagccctctgaaaaaaaaattaaaaaatgaggtcccagttccacccacctagagagccaaaagagccggcggtggccggcagccaaaacccacgttggattttgccgccgccgcctggagctaggggacaaggcaacgccggccggtgcaacatttatgcgtgtaccaggcagaccagcccggcagccacgcgtacacttctgccgcaaagctaaacgcgccactccgcggcaagctgctctgctgctcccaccagccacccggcaccgagtgccaatggcgactgcagcgagttccgacgccgggcggcgcggaagcctacctctgggtctgcgcgtcactggaccgcgcgcgtggccccgggagatgggacgccgaaggttgccgcccctggcggcgctccgcggcgaaagcgcaactactccctcctcccttgtcttcttctctttggaggcacgccagatccctgccccccgcttcctcccacgcccccgtgcccttcccaaaacttaattttatactcgcctaattaaaaatgacaggccacgacaatttagcgaaatacccgtcccacgccaaaccccctatcacaa

SEQ ID NO: 23882 - DNA, 644 bp, Zea mays
  misc_feature: Ceres CLONE 1394555-F
  misc_feature (260)..(260): n is a, c, t, g, unknown, or other
  misc_feature (298)..(298): n is a, c, t, g, unknown, or other
  misc_feature (300)..(300): n is a, c, t, g, unknown, or other
  misc_feature (301)..(301): n is a, c, t, g, unknown, or other
  misc_feature (306)..(306): n is a, c, t, g, unknown, or other
  misc_feature (307)..(307): n is a, c, t, g, unknown, or other
  misc_feature (396)..(396): n is a, c, t, g, unknown, or other
  misc_feature (405)..(405): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (417)..(417): n is a, c, t, g, unknown, or other
  misc_feature (593)..(593): n is a, c, t, g, unknown, or other
  misc_feature (622)..(622): n is a, c, t, g, unknown, or other
  misc_feature (625)..(625): n is a, c, t, g, unknown, or other
  misc_feature (626)..(626): n is a, c, t, g, unknown, or other
aagctggagctccccgcggtggcggccgctctagaactagtggatcccccgggctgcaggaattcgcacgagaccattacctagaacatcctaatcgaaaaagcgtgtctcgtgctccccccaggctcctcttcctcgctttccctccaccccgggcgcaaaccctaaccctaccgtcgctcgccccgcggcgtctgccaatggcgcgccccgtgtgagtgtgcgcgagagaggggtagaccttgaggccgctacccggngaggagagcgagagatgtatacaaggggggggagcggngnngaggnncttgggctggaaccggaagcggatcaacgacgcgctggataacatctcggagaagggcggccgcgtcgccgtccacggtcgaagggggnccggcgggnccgcnnnnngcnaaccgccaccgggcttgccggggccgggccttccggggcgcccatccccccggggcccggttgctcccggggggcccggctggctttcggtttgccgccgccttgggggggttcccggcttccctggggggccaggaccccccccgggggttttcccgggggttgcgccccccccnggggggtcctggggtccttttggtgtggnggnncccttttggttttttttg

SEQ ID NO: 23883 - DNA, 650 bp, Zea mays
  misc_feature: Ceres CLONE 1394557-F
agagctggagctccccgcggtggcggccgctctagtctagtggatcccccgggctgcaggaattcgcacgagaccattacctagaacatcctaatcgaaaaacggatcaaaatcgaatccaacgctactgcctagggtttcctctgcatttcccctaccacaccccgcgccgcccacccatggccgccgcagacgcgtccgccgagaccgccgccatcgcgcggcgcctggcctcctgcaacaccggcacccgggagcgcgcgctccgctacctcctctccgaatttctgccggtctccgcgccgcgcctctccgccaccgacctcctcaagctctggaagggcatcttcttctgcttctggcacgccgacaagccgctctaccagagctccgtcgcctcgcctccgccgtctccgtcccgccgccctccgccgatggtgccgtcttcctcgccgtctacctcaccacgctccgccgggagtgggtccacatcgacgtccacccccctcgacaagttccaacctcctcaaaccggtcgggtccttccaccacgcccttcctgcttctccatgggtaaactcctttccccccccgacggcccccctccccagggccgcggccccgaccctcggaaagacaagggccccttt

SEQ ID NO: 23884 - DNA, 690 bp, Zea mays
  misc_feature: Ceres CLONE 1394561-F
  misc_feature: Encodes the peptide sequence at SEQ ID NO. 23885
  misc_feature (321)..(321): n is a, c, t, g, unknown, or other
  misc_feature (372)..(372): n is a, c, t, g, unknown, or other
  misc_feature (420)..(420): n is a, c, t, g, unknown, or other
  misc_feature (605)..(605): n is a, c, t, g, unknown, or other
  misc_feature (635)..(635): n is a, c, t, g, unknown, or other
  misc_feature (644)..(644): n is a, c, t, g, unknown, or other
aaagctggagctccccgcggtggcggccgctctagaactagtggatcccccgggctgcaggaattcgcacgagaccattacctagaacatcctaatcgaaaaacgccgccatcttcgcaagccaccgcaaccgaagcccgccttcgccgccgccgcctctgcgatccccgcaaggtcgcaaacatgtctaccgtgctccagcgcccgacccccggcacggtccagtgcttcggccgcaagaagacggctgtggccgtcgcctacaccaagcccggggcgcgggctgatcaaggtgaacggcgtcccgattgagctcatcanggccggagatgctccgcctcaaggccttcgagcccatccctggctggcggngcgctccaggttcaaggacatcgacatgaggatccgcgtccgaggcgncgggaaagacgtcgcagatctacgccattcgccaggccgtcgccaagggggctcgtcgctaactaccagaaatacgtcgacgaggccgcccaagaaggaggtcaaggacttcttcacccggtacgaccgcaccctttctcgtcgccgaccccaggcgctggaaggcgaagaaaagttcggggggncccggcgccccgcgccggggttccagaagnccaacccgntggagcgctcggcttgcccgcgccttgccgtaacccgaatgcctgt

SEQ ID NO: 23885 - protein, 97 aa, Zea mays
  misc_feature: Ceres CLONE 1394561-F
  misc_feature (8)..(8): Xaa is any aa, unknown, or other
  misc_feature (70)..(70): Xaa is any aa, unknown, or other
  misc_feature (80)..(80): Xaa is any aa, unknown, or other
  misc_feature (83)..(83): Xaa is any aa, unknown, or other
MRIRVRGXGKDVADLRHSPGRRQGGSSLTTRNTSTRPPKKEVKDFFTRYDRTLSRRRPQALEGEEKFGGXRRPAPGFQKXNPXERSACPRLAVTRMP

SEQ ID NO: 23886 - DNA, 708 bp, Zea mays
  misc_feature: Ceres CLONE 1394563-F
  misc_feature: Pfam Name: HECT Pfam Description: HECT-domain (ubiquitin-transferase)
  misc_feature (374)..(374): n is a, c, t, g, unknown, or other
aagctggagctccccgcggtggcggccgctctagaactagtggatcccccgggctgcaggaattcgcacgagaccattacctagaacatcctaatcgaaaactgccatcaggcctcacattaatgccttcctggaagggtttaatgaactcattccacgggagctgatatctatcttcaacgacaaagagcttgagcttctgattagtggtcttccagatattgacttgcacgatttgaaaacaaatacagaatattctggctacagcatagcctctccagtcgtccagtggttctgggaaatcgttcaggggttcagcaaggaagacaaagctcggttcctccagttcgtcactggcacttcaaaggtaccgnttggaaggttttagtgaacttcaagggatctctgggccacaaaggtttcagatacacaaggcatacggcagcacgaaccatctgccttcagctcatacttgctttaaccaactagacttgcctgagtacacgtccaagagagcttcccaggagagggctactgttggcaatcccgagccaatggaaggggtttcgggattggctaatcaggccttgctccgttttgcccggggaaaagtcctgtaccggaaaccggagcaattccaatgggcaagcaaacaacgggggggcgcttgatcccttaaccaccttctgaaacatccaacagtgtatg

SEQ ID NO: 23887 - DNA, 767 bp, Zea mays
  misc_feature: Ceres CLONE 1394564-F
  misc_feature: Encodes the peptide sequence at SEQ ID NO. 23888
aagctggagctccccgcggtggcggccgctctagaactagtggatcccccgggctgcaggaattcgcacgagaccattacctagaacatcctaatcgaaaaacatcgagtaatttatcgagtcaggtgagagggcggagcagatctcgccggccggggccatgggtgctgccggcgcgatccggcgggcggcggcgtcggtggtcgacagggcgtgcgcggggacgcggggcttccgccgcgcgctggcgcggttcgcgccgcggccgtcggcgttcggccccgccgcagacgcggagggccgcgccggtgcgcgcccgtgcgtaatctctgggaccttcccggttccagtacgcccgtcctagccatgtccccccccccgcgggggggggggggtactcctccgcccccgtcaccccacccccccgccccgcccgggcgctcgctcctctcccccccgccaccgggcggtgtgactcctctccgccctggctcccgtccccgcccgccaccgccgaccacgctgtccccccgtctttttgacgtctttggcgatttcttcctctttttcttcagtcccccgccttctcacgcctctgtcgagggagggggggagcggcagacggcgggcaggggggtccttccgccgcccgtggcctcctgtctgcgtctgcgctccccccatgacttgttgacttcccactctgtaccatgtgtctttggcgtgaaggacttgctttcgatccctctccctactcccccccccac

SEQ ID NO: 23888 - protein, 67 aa, Zea mays
  misc_feature: Ceres CLONE 1394564-F
MGAAGAIRRAAASVVDRACAGTRGFRRALARFAPRPSAFGPAADAEGRAGARPCVISGTFPVPVRPS

SEQ ID NO: 23889 - DNA, 708 bp, Zea mays
  misc_feature: Ceres CLONE 1394565-F
  misc_feature: Translation starting site: 149
  misc_feature: Pfam Name: ZF-HD_dimer Pfam Description: ZF-HD protein dimerisation region
  misc_feature (394)..(394): n is a, c, t, g, unknown, or other
  misc_feature (403)..(403): n is a, c, t, g, unknown, or other
  misc_feature (404)..(404): n is a, c, t, g, unknown, or other
  misc_feature (529)..(529): n is a, c, t, g, unknown, or other
  misc_feature (530)..(530): n is a, c, t, g, unknown, or other
  misc_feature (577)..(577): n is a, c, t, g, unknown, or other
  misc_feature (608)..(608): n is a, c, t, g, unknown, or other
  misc_feature (610)..(610): n is a, c, t, g, unknown, or other
aagctggagctccccgcggtggcggccgctctagaactagtggatcccccgggctgcaggaattcgcacgagaccattacctagaacatcctaatcgaaaaacaaatttaaattttacaaaggagtcgagaagaagaagaagaagcatatgagaaagcgtcaagtggtgttgaggagagcctcgccggaggaaccttctagaagctcgtcgacggcttcgtctctgacggtgagagggttgagatacggcgagtgtcagaagaaccatgccgcggcggtcggcggatacgccgtcgatggctgccgtgagttcatggcaagcaacggagaggaaaggttcggtggcagcgctaacgtgcgccgcctgtggctgccaccgcagtttccatcgtanagaatcgannaccgaggttgtttgcgactgtaattcacctccttcgactggaaactagaccagtaaaactagactagtggtcaaggggtttgtggtctcgttgagaagtaaagcagaaattttcagagatgatannatttgggagggttggggaaagatttaatattaactggatggctttangcatgtctcagaaaagatctatggaatatgnangctttataggtttcaagaaaaagaaggatttattggttgttttttatgaatgggttttataaagggttggtttttctggtttctggcccaaattaatg

SEQ ID NO: 23890 - DNA, 670 bp, Zea mays
  misc_feature: Ceres CLONE 1394568-F
  misc_feature: Encodes the peptide sequence at SEQ ID NO. 23891
  misc_feature (199)..(199): n is a, c, t, g, unknown, or other
atagctggagctccccgcggtggcggccgctctagaactagtggatcccccgggctgcaggaattcgcacgagaccattacctagaacatcctaatcgaaaaaagttgtttctcttctcttgctccgcaaaccagcgcaagcccttccctgacagcggcggcgacatggtgctcgaggcgacgatgatctgcatagacnactcggagtggatgcggaacggcgactacgccccgtcgcggttccaggcgcaggccgatgccgtcaacctcatatgcggtgccaagacccagtcgaacccggagaacacagtaggcgtgatgacgatggccgggaagggcgtccgcgtgcttgtcactcccaccagcgacctcgggaagattctcgcctgtatgcacggggttgggaagttgggtgctgaggcaaacttggctgcggcaatccaggtttgctcagcttgcgctaaagcatcgcccagaacaagagggcagcagccaggaggaattatagcattttccatcggaaggtccctgggggaagtacgaacaagaaaaaattttgggaaaccaatcggggagaaagctggaaaaagaaaccaagggtggctccttggaaattggtgtgacactttggggggaaacctgggaaggaggaaaagccctgggaaaaacg

SEQ ID NO: 23891 - protein, 168 aa, Zea mays
  misc_feature: Ceres CLONE 1394568-F
  misc_feature (12)..(12): Xaa is any aa, unknown, or other
MVLEATMICIDXSEWMRNGDYAPSRFQAQADAVNLICGAKTQSNPENTVGVMTMAGKGVRVLVTPTSDLGKILACMHGVGKLGAEANLAAAIQVCSACAKASPRTRGQQPGGIIAFSIGRSLGEVRTRKNFGKPIGEKAGKRNQGWLLGNWCDTLGGNLGRRKSPGKN

SEQ ID NO: 23892 - DNA, 629 bp, Zea mays
  misc_feature: Ceres CLONE 1394569-F
  misc_feature: Translation starting site: 181
  misc_feature: SWISSPROT Homolog: EC 1.11.1.15 Peroxiredoxin
  misc_feature (485)..(485): n is a, c, t, g, unknown, or other
  misc_feature (492)..(492): n is a, c, t, g, unknown, or other
  misc_feature (539)..(539): n is a, c, t, g, unknown, or other
  misc_feature (573)..(573): n is a, c, t, g, unknown, or other
ggagctcaccgcggtggcggccgctctagaactagtggatcccccgggctgcaggaattcgcacgagaccattacctagaacatcctaatcgaaaaaccccacccattcactcgcctgcgctccctcgccgccccagttccccaccccctgctcacccacccgtcccctcctgctcgcccatggctcccatcgctgtcggcgacgccctccccgacggccagctcgggtggttcgacgagaacgaccagctgcagcaggtctccgtccacgcgctcgccgccggcaagaaggtcatcctcttcggcgtccccggcgccttcaccccgacctgcagcaaccagcatgtgccaggcttcatcacacaggctgagcagctcaaagccaagggtgtagacgagatcctgcttatcagcgttaacgaccccttcgtcatgaaggcgtgggcgaagacctaccccgagaaacagcacgtgaaagtccctcnccgacgnatctggagcgtacaccaaggcgctcgacctcgagctcgatctcacgnacaagggcctgggcgtgcgctcgaaaaagttcgnttctcctgggccgacgaactcaccggtcaccgtcgcaaaaattcgaggaagggggg

SEQ ID NO: 23893 - DNA, 714 bp, Zea mays
  misc_feature: Ceres CLONE 1394571-F
  misc_feature: Encodes the peptide sequence at SEQ ID NO. 23894
  misc_feature (406)..(406): n is a, c, t, g, unknown, or other
aaagctggagctccccgcggtggcggccgctctagaactagtggatcccccgggctgcaggaattcgcacgagaccattacctagaacatcctaatcgaaaaaagcattccccgtttgccttgtttaccattcctccccaaaacacatcctgcgatcctcgaagcctccgccgagcatcgatcatgtcggcctactgcggcaagtacgcggatgagctcatcaagaatgctgcctacatcggcacccctggcaagggtatccttgctgctgatgagtcaactggcaccattggcaagcgcctttccagcatcaatgtcgagaacgtggaggagaaccggcgggctctccgtgagctcctgttctgctgccctggtgccctccgtaaatcaaggcggtgtgaccctncttcgaggagaccctctaccaaagaaccaaggatggcaagctttttttgtcgatgcctcaagggagggggaggcgtcctccctgggcatcagggtcgacaggccacccatttgggaggttgttgggcacccgacaaggagaccaccaccccggggccacgatgacctcgggaagggctgcgctaaggacttaccaagggcgggtgcccggctttgcccaaggtgggcgttgctgtttcctcaagaattgggccccaacgaggccggtcacagctttgtcatttgacctggaaaggcctccgggggtcg

SEQ ID NO: 23894 - protein, 128 aa, Zea mays
  misc_feature: Ceres CLONE 1394571-F
  misc_feature: SWISSPROT Homolog: EC 4.1.2.13 Fructose-bisphosphate aldolase
  misc_feature (75)..(75): Xaa is any aa, unknown, or other
MSAYCGKYADELIKNAAYIGTPGKGILAADESTGTIGKRLSSINVENVEENRRALRELLFCCPGALRKSRRCDPXSRRPSTKEPRMASFFCRCLKGGGGVLPGHQGRQATHLGGCWAPDKETTTPGPR

SEQ ID NO: 23895 - DNA, 618 bp, Zea mays
  misc_feature: Ceres CLONE 1394576-F
  misc_feature (390)..(390): n is a, c, t, g, unknown, or other
  misc_feature (442)..(442): n is a, c, t, g, unknown, or other
aagctggagctccccgcggtggcggccgctctagaactagtggatcccccgggctgcaggaattcgcacgagaccattacctagaacatcctaatcgaaaacggttccattccaagtccacctgcccctcctccctccctatctatcctgtactctctctcagtttctctctccccccgttctccgttccacatcgcgtgcgcattgagacgacgagtttctagagcgccgtaccgcgcacggctcccgagccccaccgcaaagcgccggaatcgtgagcgcgtccggcctcgcctagctgctccgcgccgagaggcggccgaggaggacgggcgatgtacccggtggtgacgggcacgccgccggcgcggctgccggcggcgtcgcggntggacaaaggccacgaggccaccttgctggcaggggccccccgaaattgggncccctcaaaactcctcaaaaaaatttgtggggaaaaacccccttcttaaaaccccccaaacgtgtttttttggaaaaaaaaaagaggggggggtggttaaaaaaaaaagtgtgggtgggaaaaaaaaaaaaaatttttttctctttccccccaaaaaaaagccccccccccaaaaa

SEQ ID NO: 23896 - DNA, 597 bp, Zea mays
  misc_feature: Ceres CLONE 1394581-F
  misc_feature: Encodes the peptide sequence at SEQ ID NO. 23897
  misc_feature (262)..(262): n is a, c, t, g, unknown, or other
  misc_feature (279)..(279): n is a, c, t, g, unknown, or other
  misc_feature (282)..(282): n is a, c, t, g, unknown, or other
  misc_feature (283)..(283): n is a, c, t, g, unknown, or other
  misc_feature (305)..(305): n is a, c, t, g, unknown, or other
  misc_feature (331)..(331): n is a, c, t, g, unknown, or other
  misc_feature (339)..(339): n is a, c, t, g, unknown, or other
  misc_feature (340)..(340): n is a, c, t, g, unknown, or other
  misc_feature (347)..(347): n is a, c, t, g, unknown, or other
  misc_feature (550)..(550): n is a, c, t, g, unknown, or other
tggagctccccgcggtggcggccgctctagaactagtggatcccccgggctgcaggaattcgcacgagaccattacctagaacatcctaatcgaaaactcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcgncgctggctgccatgtgntgnncgtcgtgctccaagaccggcgntgtcgacggcctcccgccggggcctnccgggtgnncggtggntggggaacctgttccagggtgatcctgcagcgacgggccttcatgtacgtggtgcgcgacctccgggagaagtacgggcccatcttcaccatgcggatggggcagcgcaccctcatcgtgggcacctcggcggagctcatccacgaggggctggtggagcagggccccatgttccggaggcgggccgaagaaagccccacccngctcctcttcagggtggggaagggaaccgtaaatcggggcttacggg

SEQ ID NO: 23897 - protein, 69 aa, Zea mays
  misc_feature: Ceres CLONE 1394581-F
  misc_feature: SWISSPROT Homolog: EC 1.14.14.1 Unspecific monooxygenase
  misc_feature (54)..(54): Xaa is any aa, unknown, or other
MYVVRDLREKYGPIFTMRMGQRTLIVGTSAELIHEGLVEQGPMFRRRAEESPTXLLFRVGKGTVNRGLR

SEQ ID NO: 23898 - DNA, 649 bp, Zea mays
  misc_feature: Ceres CLONE 1394583-F
  misc_feature (315)..(315): n is a, c, t, g, unknown, or other
  misc_feature (400)..(400): n is a, c, t, g, unknown, or other
  misc_feature (522)..(522): n is a, c, t, g, unknown, or other
  misc_feature (530)..(530): n is a, c, t, g, unknown, or other
  misc_feature (558)..(558): n is a, c, t, g, unknown, or other
aagctggagctccccgcggtggcggccgctctagaactagtggatcccccgggctgcaggaattcgcacgagaccattacctagaacatcctaatcaaaattattcatagaacaacgtctcctttccaagacaatcagcgaacgaaacgaaccctaagcaaatcgaggtcgaggggtggtccgatctcggtggctactgattatcggccgcccttcccgcgccgcggtctgcgctttggccggtcctgcggggccttgacatccgcccgggtccccgtcaaccatatcaactgaatatccaattcaaagggcggngagcgtacgtgtaccaccaccgtcttccggccgtccaccgtttccagcacacagggtaaaggcaagcaaacgagcggcggaacgnctagcccgcaatacaaaatccggaggaactcccaggaggcgaaaagcagatccgtctcccccgaccggcgatcgctatcgacttgtagcggaagccatggcgtcggcagcgctaatctgcgncacgaagncagtggaaggccctccaggcgcacgtcnggcgcgattcagaagacgcacctgcgcgacctgatgggcgacgccgaccgatgcaagcaatgacggttgaaaatataaggggatctttctg

SEQ ID NO: 23899 - DNA, 673 bp, Zea mays
  misc_feature: Ceres CLONE 1394589-F
  misc_feature: Encodes the peptide sequence at SEQ ID NO. 23900
  misc_feature (280)..(280): n is a, c, t, g, unknown, or other
aaagctggagctccccgcggtggcggccgctctagaactagtggatcccccgggctgcaggaattcgcacgagaccattaccacatcctaatcgaaaaaacaccacctcgcctgcgatcttcgtagcctccgtcgcgtcgagcatcgatcatgtcggcctactgcggaaagtacaaggatgagctcatcaagaatgctgcctacattggcacccccggcaagggtatccttgctgctgatgagtccactggcaccattggcaagcgcctttccagcatcnatgtcgaggacgttgaggagaaccgccgtgccctccgtgagctcctattctgctgccctggtgctctccagtacatcaaccggtgtgaccctcttcgaggagaccgtgtaccaaagaaccaagatggaaggcttttttggtgatgcctccaggagagggaggcgccctccctgggcatcaaggttgacaggcaccccttggggggtgggtggccctgataaggaaaccaccacccaggccatgacgactttgggaagcggtgcgccaagtactacaaggaggggcccgcttttgcagggggagggctggtttccagaattgccctaagggccatcacgatttgccccgactggaacgctcggggtcggggtcgggatggcacacctggcggag

SEQ ID NO: 23900 - protein, 90 aa, Zea mays
  misc_feature: Ceres CLONE 1394589-F
  misc_feature: SWISSPROT Homolog: EC 4.1.2.13 Fructose-bisphosphate aldolase
  misc_feature (44)..(44): Xaa is any aa, unknown, or other
MSAYCGKYKDELIKNAAYIGTPGKGILAADESTGTIGKRLSSIXVEDVEENRRALRELLFCCPGALQYINRCDPLRGDRVPKNQDGRLFW

SEQ ID NO: 23901 - DNA, 676 bp, Zea mays
  misc_feature: Ceres CLONE 1394590-F
  misc_feature: Encodes the peptide sequence at SEQ ID NO. 23902
  misc_feature (598)..(598): n is a, c, t, g, unknown, or other
  misc_feature (665)..(665): n is a, c, t, g, unknown, or other
aaagctggagctccccgcggtggcggccgctctagaactagtggatcccccgggctgcaggaattcgcacgagaccattacctagaacatcctaatcgaaaagtcgcgccgccgctcccctcccaacccactagctcaaaaccctagagctctcgcctgctcgcctccgccgccggagcgagctccccatcttcatccgtcaaccatggcgacccagatcagcaagaagaagaagttcgtcagcgacggtgttttctacgccgagctcaatgagatgctgacgcgggagctggcggaggacggctactctggcgtggaggtgcgcgtcacgccgatgcgcacggagatcatcatccgcgccacgcgcacgcagaacgtgctcggcgagaagggccgtaggatcagggagctcacctccgtcgtccagaagaggttcaacttccctgagaatggcgttgagctttatgccgagaaggtcgtcaaccgtgggctctgtgccatcgcgcaggccgagtccctccgttacaagctcctcggtggccttgccgtccgcagggtttgctacggtgttcttcgtatgttaatgggagagggtggncaagggttggggaaggtgatcggtgagtgggaaagctcagggcccaaagagcaaagtccatgaaggntcaaggatggc

SEQ ID NO: 23902 - protein, 151 aa, Zea mays
  misc_feature: Ceres CLONE 1394590-F
  misc_feature (45)..(102): Pfam Name: KH_2 Pfam Description: KH domain
MATQISKKKKFVSDGVFYAELNEMLTRELAEDGYSGVEVRVTPMRTEIIIRATRTQNVLGEKGRRIRELTSVVQKRFNFPENGVELYAEKVVNRGLCAIAQAESLRYKLLGGLAVRRVCYGVLRMLMGEGGQGLGKVIGEWESSGPKEQSP

SEQ ID NO: 23903 - DNA, 695 bp, Zea mays
  misc_feature: Ceres CLONE 1394593-F
  misc_feature (238)..(238): n is a, c, t, g, unknown, or other
  misc_feature (671)..(671): n is a, c, t, g, unknown, or other
  misc_feature (695)..(695): n is a, c, t, g, unknown, or other
aaagctggagctccccgcggtggcggccgctctataactagtggatcccccgggctgcaggaattcgcacgagaccattacctagaacatcctaatcgaaaaatccaacgacccacactgagacgtcccctccccgctccgtcctctctcctctgccgccgagacgacgcgatggcggggtccgccgccttgccgccgctcgccgccttcgcggcgctccttaccgcgcggtgcttcnccgccgccagggccgcgctccgggccctgatcacgccgcgcctactggcggagccgttcgcgggacctcggcgtctcggcgctcccgctcggcgggccgccgctaggccggggcgcggtaccacgatatggctcctcccccgggtaccgcggaggccgccccccactttgcccccccgtcggaggtcgcctctaggggggccggcggacgcggctccggggcaccgcttcgagcacggagctgccttctcagcccccccgctgcctccccccccccggcgggggccggggccccccagcgcggcccgtgtgccgtcccccctggaaccgggccgcctgtttatccgcgccccggctcccccgccgccggcgcgcgggcgccgggccccccggggtccccgccgcgccccacactcccgccgcccggccgttgntccaaccctgccccgttttgttcn

SEQ ID NO: 23904 - DNA, 661 bp, Zea mays
  misc_feature: Ceres CLONE 1394594-F
  misc_feature: Encodes the peptide sequence at SEQ ID NO. 23905
  misc_feature (388)..(388): n is a, c, t, g, unknown, or other
  misc_feature (400)..(400): n is a, c, t, g, unknown, or other
  misc_feature (486)..(486): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
tggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggagggacggagtggtcgaacgggaccgcaaggaggaccctgcggtggtgcaagcaggcgtgcgagtggcagtacggaaaggacaccccgcgnaagagggaagcnaagagcgagtgccgcgagcggcaccagcaagctgacgcgggcgaggacggcgacagcggcgtggacgcctacgtctccggctcggnagggggcgaggggcnnnnncaggggctgcgccgccacgaggggcaggccgggggaagaccaggaatggatggaggcgggggccgccgcccgcggaattggccggcgacattggaaaaaagagtagggtcccgggaaaccaagagccgcgggcaaagggccgggaaaaggtggcag

SEQ ID NO: 23905 - protein, 142 aa, Zea mays
  misc_feature: Ceres CLONE 1394594-F
  misc_feature (84)..(84): Xaa is any aa, unknown, or other
  misc_feature (89)..(89): Xaa is any aa, unknown, or other
  misc_feature (90)..(90): Xaa is any aa, unknown, or other
MVGVPPARRRAAGRSSHGRGGGTEWSNGTARRTLRWCKQACEWQYGKDTPRKREAKSECRERHQQADAGEDGDSGVDAYVSGSXGGEGXXQGLRRHEGQAGGRPGMDGGGGRRPRNWPATLEKRVGSRETKSRGQRAGKRWQ

SEQ ID NO: 23906 - DNA, 677 bp, Zea mays
  misc_feature: Ceres CLONE 1394596-F
  misc_feature: Encodes the peptide sequence at SEQ ID NO. 23907
  misc_feature (493)..(493): n is a, c, t, g, unknown, or other
  misc_feature (601)..(601): n is a, c, t, g, unknown, or other
agagctggagctccccgcggtggcggccgctctagaactagtggatcccccgggctgcaggaattcgcacgagaccattacctagaacatcctaatcgaaaaattgatacctgaacatcatctccccctggtacatcgatgatcccgaccctccatcacaagtttgcgcatctgtatcgcctgtaaattactggtcgacggcggcatctatacccatgctgaaggctgccgtgctggtctcatgcgcgcgcgtcctcctggtcgccgaggtgatcgctgaacgtcaacgctgctggcgtgcaggatcttcccatgccggagtgcttccttccgccggacctgcagggagccacctggacccgcctctgcttgcacgctgaggccacatcgtgccagacatactgcaacacgccgtgagaccggagagaaatagaagatgagtacaaggacgacgcggacgaggcgaaggacgcctacgtctcacgctacgagnaacgccaagaggctgggccggtacatgaacagcagcgagcaggacaagggcgaccgcgtgaaggaccagacgtcgtgcatgcccgagcgatgcaggaccagtgaggangatgtacggacgacgccgcggacacggcgtccagtgcccacggagcgagcgagaaccacacccgtgaagccgtggg

SEQ ID NO: 23907 - protein, 34 aa, Zea mays
  misc_feature: Ceres CLONE 1394596-F
MPECFLPPDLQGATWTRLCLHAEATSCQTYCNTP

SEQ ID NO: 23908 - DNA, 647 bp, Zea mays
  misc_feature: Ceres CLONE 1394597-F
  misc_feature: Translation starting site: 160
  misc_feature (384)..(384): n is a, c, t, g, unknown, or other
  misc_feature (446)..(446): n is a, c, t, g, unknown, or other
  misc_feature (521)..(521): n is a, c, t, g, unknown, or other
aaagctggagctccccgcggtggcggccgctctagaactagtggatcccccgggctgcaggaattcgcacgagaccattacctagaacatcctaatcgaaaaatcgcacatattattgagaccaactagcaacatataaagcacaatagtgtaccaacaatggcagtcaaaatattttgcttccttatgctccttgttctttctgcaagcgttgctaccgcgaccattttcccacaatgctcacaagctcctataggttcccttcttcccccatacctatcaccagctggtgtcttcagtatatgaaaaccctattgttcaaccctacgggatccaacaggcaatcgaaacaggcatcttaccattatcacccttgttcctccnacaaccgtcaaccctattacagtagttacctttggtgcatttgatgccacaacacatcatgncactgcaactaccacaacttgtgctagcaaaccttgctgcatactctcagctacatcagtttcatccattcaacnactggctgcattgactcctgctgctatttgcaatacaagtaaccatgcaccagctaggtgctggctaccccagaaatttcttcctttcaccccctaaaagcatttgattttttttgtttattaacc

SEQ ID NO: 23909 - DNA, 660 bp, Zea mays
  misc_feature: Ceres CLONE 1394599-F
  misc_feature: Encodes the peptide sequence at SEQ ID NO. 23910
aagctggagctccccgcggtggcggccgctctagaactagtggatcccccgggctgcaggaattcgcacgagaccattacctagaacatcctaatcgaaaaactcgctctctcccctctggctctgagtggcgctagtgggcgaccgccgccgcgtccctccgtcaggtgcccaggtgtagcctcgtcggcccctccgtcaggtcttcgtcggccccctcgccgacgagcacccaccagccaggcatgagagcgcgcttctagaataatgtctgtgcttacctgcgtgattgaaagcatgggctcatcctgtagcagatcccattctttcgacgaggctgaagcagctgaaaatgcaaagtctgcagacattgaccggaggattttgcaagaaacaaaagccgaacaacacatccacaagctcttacttctcggtgctggagaatcggggaagtctacaatatttaaacaaatattatatgagggagctaaagagttagcccaagtggaaccagattcttcaaaatatgtcttatctccagataatcaggagattggagaaaaatatcagaaattggtgccagattggaatacccatcgttgaacaaagaacgtgtacaggatgtaagaaaactatggcaagatccagccattcaggaaa

SEQ ID NO: 23910 - protein, 111 aa, Zea mays
  misc_feature: Ceres CLONE 1394599-F
MSVLTCVIESMGSSCSRSHSFDEAEAAENAKSADIDRRILQETKAEQHIHKLLLLGAGESGKSTIFKQILYEGAKELAQVEPDSSKYVLSPDNQEIGEKYQKLVPDWNTHR

SEQ ID NO: 23911 - DNA, 843 bp, Zea mays
  misc_feature: Ceres CLONE 1394601-F
  misc_feature: Encodes the peptide sequence at SEQ ID NO. 23912
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
ttttttttttttttttttttttctgtttttttctgtcgcggacnnnnaaaagctggagctccccgcggtggcggccgctctagaactagtggatcccccgggctgcaggaattcgcacgagaccattacctagaacatcctaatcgaaaattttacacgcccccttctctctcgatttctcgcggagcggtcctccacctttatcgccgccgccgccgttgctgtgttccgtctcttcgccgatggcttcggccaagttcggtgctgcccagcaggtggagaaccgaggcgcgctgtccaaaaggtcacgtaacgacgtgtctgtaagggagggggactggaattgtcctcattgtgctaatgccgacttctgttctggaaaggatggccgcggggggggcctggggtgccccccgcgcgtcggcgggggccatccaccagaatgatgcgcagggcggctcctggctttggggaatcgagcgggcctcgttggattgcggggggcgggggggaagccatttgatcgacatacgcacgggtactgcgggaaggtgcgcgccggggaaggaagagggggggatgccactccgtctgggggccgtcccaagccccactggggcgacttcacccccacttaacacattggtcagttcggcgtctccgcactaagaataccgcgcggttaatcgaagaccccggcatagtggcgaggcggcaagtaaaaaacaaacagctggggtggtgggggggcacaagagaaccaaccgcggcgggcgcgcaacaatcacacctagcccgcccccccctcgaaacgacacgaaaacctctagggggggagagaaa

SEQ ID NO: 23912 - protein, 67 aa, Zea mays
  misc_feature: Ceres CLONE 1394601-F
MASAKFGAAQQVENRGALSKRSRNDVSVREGDWNCPHCANADFCSGKDGRGGGLGCPPRVGGGHPPE

SEQ ID NO: 23913 - DNA, 713 bp, Zea mays
  misc_feature: Ceres CLONE 1394603-F
  misc_feature: Translation starting site: 150
  misc_feature (713)..(713): n is a, c, t, g, unknown, or other
gctctagaactagtggatcccccgggctgcaggaattcgcacgagaccattacctagaacatcctaatcgaaaactttcgtcgactccacttctcttctccgcgtcacctcctcttcgccgccgccgacgcttcaccgggcagccagccatggatgaggagtacgacgtgatcgtactaggcacggggctcaaggagtgcatcctcagcggtctcctctctgtggacggcctcaaggtttgcatatggacagaaatgactactatggaggagattccacctcgctcaaccttaatcagctctgggaaagggtttagagggggaagacaagccccccagcacatcttgggtgcaagcagagactaccatggtggacatggtggccaacgttttatgatggcaaatggggaactttgggttctcaacccttctcccacaccggaggggaaccaaggtacttggtcatttcaagagttggtggatgaggaagcttatggtttttcagggaggggaaagatatttacaaagggcccccgggcccctggtaatggaggccccccggaaacgccccccttttggtgggggccctatttcccagaacggggacgagcaagggaacatttctttttctggatgtttccccacaattaccccgggaaacctggttcccaagataaccaataaccggggatgcggcctctctcccatggctcn

SEQ ID NO: 23914 - DNA, 621 bp, Zea mays
  misc_feature: Ceres CLONE 1394604-F
  misc_feature: Encodes the peptide sequence at SEQ ID NO. 23915
  misc_feature (325)..(325): n is a, c, t, g, unknown, or other
  misc_feature (511)..(511): n is a, c, t, g, unknown, or other
  misc_feature (517)..(517): n is a, c, t, g, unknown, or other
aaagctggagctccccgcggtggcggccgctctagaactagtggatcccccgggctgcaggaattcgcacgagaccattacctagaacatcctaatcgaaaaatttcactttccttctctcctctcctcctgctgctactaggttcgggccgtccgtccttgctcttgatctgcattatttaattcggaccattcccccgccgtcctcccgcccgcctgccggagatggagatggagaacgggcacgccaagtaccgggtggccgtcattggcagcggcaactggggcagcgtcgcctcccgcctcatcgcctccaacaccgccnagctgccctccttctatgatgaagtaaggatgtgggtgtttgaggaaatactgcctacaggcaggaagctatctgagtccattaacgaacagaatgagaactgcaaatacttgccaggtataaagcttggaacgaatgttattgccgaccctgacttggagagcgcagtcaaagacgcgaaatatngctggnttttgtgacgcccatcatttgtggaggtatatgtaagaagcttggagggagcttacccaggagctgaggtatctcctcatcagggcatggagtcacatgggaag

SEQ ID NO: 23915 - protein, 99 aa, Zea mays
  misc_feature: Ceres CLONE 1394604-F
  misc_feature (10)..(100): Pfam Name: NAD_Gly3P_dh_N Pfam Description: NAD-dependent glycerol-3-phosphate dehydrogenase N-terminus
  misc_feature: SWISSPROT Homolog: EC 1.1.1.8 Glycerol-3-phosphate dehydrogenase (NAD(+))
  misc_feature (34)..(34): Xaa is any aa, unknown, or other
  misc_feature (96)..(96): Xaa is any aa, unknown, or other
  misc_feature (98)..(98): Xaa is any aa, unknown, or other
MEMENGHAKYRVAVIGSGNWGSVASRLIASNTAXLPSFYDEVRMWVFEEILPTGRKLSESINEQNENCKYLPGIKLGTNVIADPDLESAVKDAKYXWXL

SEQ ID NO: 23916 - DNA, 619 bp, Zea mays
  misc_feature: Ceres CLONE 1394607-F
  misc_feature: Encodes the peptide sequence at SEQ ID NO. 23917
  misc_feature (260)..(260): n is a, c, t, g, unknown, or other
  misc_feature (268)..(268): n is a, c, t, g, unknown, or other
  misc_feature (319)..(319): n is a, c, t, g, unknown, or other
aaagctggagctccccgcggtggcggccgctctagaactagtggatcccccgggctgcaggaattcgcacgagaccattacctagaacatcctaatcgaaaaatcttcctgctcaacatcagtagcagctttagctgtagcagcgccaccggccaccgccacgccatggccaccacgttgcacaagccccttggggcgatcaccgttgacgacctcgccgcggcggcgcctgggtcggacgccaccgcgctccacgcagngctccggngcgcgctcgactcgcacggacccaccgagtgtggggcgagctctgccggtncgtgctctgtccgtctgtccccttcgcgtcccacggatgctctactcccgctgctttcgcgggttcccgtcccccacgccgccggcctggacgccggaccccaaggagtctgtcttgaccaatgtcgggcgtgtcctcgaggcggcgtggtaggaacttgatcggcgacccgtacaaggatcccatcaccagctttcccagaacctcacaaggtctccaacgagaacccagaggcgtactggaagatggtatttgaaggatatggttatccaattcagcgtagagccatcctgcatctgg

SEQ ID NO: 23917 - protein, 104 aa, Zea mays
  misc_feature: Ceres CLONE 1394607-F
  misc_feature (32)..(32): Xaa is any aa, unknown, or other
  misc_feature (35)..(35): Xaa is any aa, unknown, or other
  misc_feature (52)..(52): Xaa is any aa, unknown, or other
MATTLHKPLGAITVDDLAAAAPGSDATALHAXLRXALDSHGPTECGASSAGXCSVRLSPSRPTDALLPLLSRVPVPHAAGLDAGPQGVCLDQCRACPRGGVVGT

SEQ ID NO: 23918 - DNA, 665 bp, Zea mays
  misc_feature: Ceres CLONE 1394608-F
  misc_feature (405)..(405): n is a, c, t, g, unknown, or other
  misc_feature (427)..(427): n is a, c, t, g, unknown, or other
aaagctggagctccccgcggtggcggccgctctagaactagtggatcccccgggctgcaggaattcgcacgagaccattacctagaacatcctaatcgaaaaacaaaactccccgtttcccatcgcgggcactctccttcgagccgaccgccgctcccacccccaccactcgccagctcgccacttcctcccgtctcctcccttccagaggtggcgcgtaagccccgatggacgcctctctcctccacggcgccgccgcctcgctccagagttccacccagcacgcccgcgcgggcgccgccgcctttcacccctcgcgtgtgacccatccctacgccttacgcgctcctcgttctcgaccaatcgccacctcgagatttcactccgggcgatctcggccagtcntgtcccctcgggggcaggcgcnaccccccgggaaccgccacgttgtcgccgcccctaccgggggagcaaaacgagggttcagaggtgggggtatgacaacaacgggcagataaagcccggaggagctcaagaaattttggaaagggatggttggaactacttcaaggggcgaggccctgggggatgcagggccctgaccaatgcagggcttatgaatggcaaatccgagagggacgagggcagggtcctggtgggaaaac

SEQ ID NO: 23919 - DNA, 877 bp, Zea mays
  misc_feature: Ceres CLONE 1394617-F
  misc_feature: Encodes the peptide sequence at SEQ ID NO. 23920
  misc_feature (25)..(25): n is a, c, t, g, unknown, or other
  misc_feature (29)..(29): n is a, c, t, g, unknown, or other
  misc_feature (30)..(30): n is a, c, t, g, unknown, or other
  misc_feature (43)..(43): n is a, c, t, g, unknown, or other
  misc_feature (47)..(47): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (877)..(877): n is a, c, t, g, unknown, or other
gggaggtgcccaccaaaacacccgnatannccacaaaccgggngttngnnnnttaaaagtggaactccccgcggtggcggccgctctagaactagtggatcccccgggctgcaggaattcgcacgagaccattacctagaacatcctaatcgaaaaaccaacccaaagcagccacggcagcctccttcctcctctcactctcggtcgagctgacgctcgctacctcgcttcgcactccattccaaaagaggcgaggaaaggggatgatgttcatcgaagagctttcccgcggcgagagccgccacggggggggacggcccggtgggagagcgagtgcggaggaccgggtgcgagcgcggcggggggtgtgaaacagagagggcaaagaaaaggcagccaccacgcctggcgcacgtccggccgtggggaccggtgcaacgctacaacttatcacggggacaaagagagctcggcggctcccccgaagagtcgggcgccggggggctctgcggcgtcgcgggggtaggccagacacgggggggcaccacccaaagcaacggaactagagtgtgtgtcttcggccagaccccgggcgaaagcggggagatctcgtgaatgaggggcagaacctcagcggaaataaggtggcggggcacgcatccacatctcccccgtgggcggtaccgctccacgcgaggggctcttgccaacccacaccagaaggctagaacggcctcaccaaaacgagcgctaatcaatatcctgtggtgggcgggggctgacttcgaaacccctccctctaaccctcaagtgggggcggccccgcaaacacgaccatcggcgggggggcgcccgcacggtcggacgacacactacn

SEQ ID NO: 23920 - protein, 35 aa, Zea mays
  misc_feature: Ceres CLONE 1394617-F
MMFIEELSRGESRHGGGRPGGRASAEDRVRARRGV

SEQ ID NO: 23921 - DNA, 522 bp, Zea mays
  misc_feature: Ceres CLONE 1394625-F
  misc_feature: Translation starting site: 280
  misc_feature: SWISSPROT Homolog: EC 6.3.2.19 Ubiquitin--protein ligase
  misc_feature (285)..(285): n is a, c, t, g, unknown, or other
  misc_feature (289)..(289): n is a, c, t, g, unknown, or other
  misc_feature (365)..(365): n is a, c, t, g, unknown, or other
  misc_feature (426)..(426): n is a, c, t, g, unknown, or other
aaagctggagctccccgcggtggcggccgctctagaactagtggatcccccgggctgcaggaattcgcacgagaccattacctagaacatcctaatcgaaaagattaaaataatacgcagcagccgattgcactcgaccaagagaagcaacgactgcatctctggtctcccacgcctataatcccattcccctccttcaaagccctgcggcgatttcgattcttcccttctatctccaggtatacccatcggagcagcactgacaaaaattctccagatatggcnaagncaaaaaaaaaaggggaattttccaagaaggaactccaattggggaattccttccccaaaaaaaagggaaacccccnaacccggaaccatccaatggcagtgcagggcctgctggagaggatctattccactggcagnccacaatcatggggtcctagtgacagccccctatgcaaggcgggggtttttctttataaatatcccattttcctccctgactaccccctttaagcc

SEQ ID NO: 23922 - DNA, 691 bp, Zea mays
  misc_feature: Ceres CLONE 1394634-F
  misc_feature: Encodes the peptide sequence at SEQ ID NO. 23923
  misc_feature (589)..(589): n is a, c, t, g, unknown, or other
  misc_feature (639)..(639): n is a, c, t, g, unknown, or other
  misc_feature (682)..(682): n is a, c, t, g, unknown, or other
tggagctccccgcggtggcggccgctctagaactagtggatcccccgggctgcaggaattcgcacgagaccattacctagaacatcctaatcgaaaaaacaccagaatccgcgaatcacagacgcgtctatctcagcttgctgcactgcactaccctgccctgccatcatatcgtacgtgagcccggccgagcgagagcgagggagaggcatggctgctccgaagctcgcgacgctggcgctggccgtgctcctggcggcgaccgtggtggctcccccggccgcggtgcgcgcggcgatgtcgtgctccaccgtgtacagcacgctgatgccgtgcctgccgttcgtccagatgggcggggccatgccgccccagccgtgctgcggcggcatccgcagcctgctgcagcaggccaacaacacccccgaccgccgcaccatctgcggctgcctcaagaacgtcgccaacggcgccaacgggagcggcacctacatcagccgcgccgccgcgctgcccagcaagtgcggcgtcgccctgccgtacaagatcagcaccaacgttaactgcaacacgattaataaagtgatgnagcgtccctgtgcgcgtcccgggcgagaatgcatgcatggccgctgccgnaaagtaataaaatatgcctactggtattttagcctattatcgnaggtgtgcc

SEQ ID NO: 23923 - protein, 160 aa, Zea mays
  misc_feature: Ceres CLONE 1394634-F
  misc_feature (32)..(119): Pfam Name: Tryp_alpha_amyl Pfam Description: Protease inhibitor/seed storage/LTP family
  misc_feature (127)..(127): Xaa is any aa, unknown, or other
  misc_feature (158)..(158): Xaa is any aa, unknown, or other
MAAPKLATLALAVLLAATVVAPPAAVRAAMSCSTVYSTLMPCLPFVQMGGAMPPQPCCGGIRSLLQQANNTPDRRTICGCLKNVANGANGSGTYISRAAALPSKCGVALPYKISTNVNCNTINKVMXRPCARPGRECMHGRCRKVIKYAYWYFSLLSXVC

SEQ ID NO: 23924 - DNA, 663 bp, Zea mays
  misc_feature: Ceres CLONE 1394636-F
  misc_feature: Encodes the peptide sequence at SEQ ID NO. 23925
aaaagtggagctccccgcggtggcggccgctctagtactagtggatcccccgggctgcaggaattcgcacgagaccattacctagaacatcctaatcgaaaaatccgactaaaaagggccagggccagggccttcgcttgcttactactcctgcttaccacactctaccttgtctcttcacgtgcacacgacgcctcccccaatggctgcggtggcggaggaggaggtgatcgtcgtcggcgcggggcagtcggggctagcggtggcggcgtgcctgtccctgcgcggcgtgcggtcgctggtcctggagcgcgacgactgcgtggggtcgctgtggcggaagcgcgcctacgaccgcctccacctccacctcaccaagaagtactgcgcgctgccgcacgcgccgcacccggccgaggcctccgcgtacctgcaccgcgacgacttcgcgcggaaccggtaggtgaatgccgcgcgattcgccgcccgccggacttccgccggcagggttggcaagagcactaacaactcactgatccaacccctctaacccctcaggtccacgcttggctgctggtccctcccccccccactaaacccttgcaagattcgccccctcgcccgctcaccccctcgccctgacccaccacccccccccccccg

SEQ ID NO: 23925 - protein, 86 aa, Zea mays
  misc_feature: Ceres CLONE 1394636-F
MAAVAEEEVIVVGAGQSGLAVAACLSLRGVRSLVLERDDCVGSLWRKRAYDRLHLHLTKKYCALPHAPHPAEASAYLHRDDFARNR

SEQ ID NO: 23926 - DNA, 629 bp, Zea mays
  misc_feature: Ceres CLONE 1394639-F
  misc_feature: Encodes the peptide sequence at SEQ ID NO. 23927
  misc_feature (463)..(463): n is a, c, t, g, unknown, or other
  misc_feature (581)..(581): n is a, c, t, g, unknown, or other
gctggagctccccgcggtggcggccgctctagaactagtggatcccccgggctgcaggaattcgcacgagaccattacctagaacatcctaatcgaaaagaaagcggaggagggagcaatggcggagccgagccagcagctgcggtcgttcgtggaggtgccggcgggctcccacttccccatccagaacctgcccttcggggtcttccgccggcggggggtgcaggcgcaggcgccgcgccccgcggtggccatcggggacttcgcgctcgacctcgccgccgtcgccgacgcggggctcttcgacgggcccgcgctctccggctccccgtgcttccaccaggagacgctcaacatgttcttggggatggggccgccggcgtggagggaggcgcgcgccacgctacagaaaatcctatcagccgacgagcccgtcttgcgtgacaacgaagcactgaggaancagtgtctggtaccaatgagtgatatagagatggttctaccaatcaccggttgggaggtacacgaacttcttttgttctgtgcacatgcaatgaattgtggattcttccttccgaggncggagactccagcaatccaaattgggtttaatcttcaggaggatacaa

SEQ ID NO: 23927 - protein, 170 aa, Zea mays
  misc_feature: Ceres CLONE 1394639-F
  misc_feature (10)..(129): Pfam Name: DUF1969 Pfam Description: Domain of unknown function (DUF1969)
  misc_feature: SWISSPROT Homolog: EC 3.7.1.2 Fumarylacetoacetase
  misc_feature (115)..(115): Xaa is any aa, unknown, or other
  misc_feature (155)..(155): Xaa is any aa, unknown, or other
MAEPSQQLRSFVEVPAGSHFPIQNLPFGVFRRRGVQAQAPRPAVAIGDFALDLAAVADAGLFDGPALSGSPCFHQETLNMFLGMGPPAWREARATLQKILSADEPVLRDNEALRXQCLVPMSDIEMVLPITGWEVHELLLFCAHAMNCGFFLPRXETPAIQIGFNLQEDT

SEQ ID NO: 23928 - DNA, 658 bp, Zea mays
  misc_feature: Ceres CLONE 1394642-F
  misc_feature: Encodes the peptide sequence at SEQ ID NO. 23929
  misc_feature (509)..(509): n is a, c, t, g, unknown, or other
  misc_feature (520)..(520): n is a, c, t, g, unknown, or other
  misc_feature (541)..(541): n is a, c, t, g, unknown, or other
  misc_feature (573)..(573): n is a, c, t, g, unknown, or other
  misc_feature (627)..(627): n is a, c, t, g, unknown, or other
  misc_feature (638)..(638): n is a, c, t, g, unknown, or other
  misc_feature (639)..(639): n is a, c, t, g, unknown, or other
  misc_feature (657)..(657): n is a, c, t, g, unknown, or other
aaaagctggactccaccgcggtggcggccgctctagaactagtggatcccccgggctgcaggaattcgcacgagaccatacctagaacatcctaatcgaaaacttccactgcaggttcctaacccccacccacctcgcccaaattgcaaccttccccgagtgctccaggtcccgtggccggcccccagatcctctccaatcccaatccaagtatcgaacggatcccatcggtggcgctcgagcgagcgagtgcggccggaaccgagcgaagatgggcatctcgagcatgccggcgcccgaggacagcctgctggggttcgtgctgtacaacacggcggcgtcggtggcgatcctggcggggctggtgcgcgccgcgctgctgttcctgggcctggcggcggcggcggaggacgaggagccgcggcagcaggcggaggccgtgacggtcacggccgtggggcccagcctcgcggaccggttccggagcaggttccggccgtcgcgctagnggcgcggcccngggcgggacatgccgcgtggncccctggtgcggttcgagacaacgaaaatccnggggggtgcagcgtcttcccctggcggccacctctttccaccgcgcatgcctcngaagacctggnnatcgactaacgaccacgnc

SEQ ID NO: 23929 - protein, 78 aa, Zea mays
  misc_feature: Ceres CLONE 1394642-F
MGISSMPAPEDSLLGFVLYNTAASVAILAGLVRAALLFLGLAAAAEDEEPRQQAEAVTVTAVGPSLADRFRSRFRPSR

SEQ ID NO: 23930 - DNA, 711 bp, Zea mays
  misc_feature: Ceres CLONE 1394645-F
  misc_feature: Encodes the peptide sequence at SEQ ID NO. 23931
  misc_feature (529)..(529): n is a, c, t, g, unknown, or other
  misc_feature (558)..(558): n is a, c, t, g, unknown, or other
  misc_feature (574)..(574): n is a, c, t, g, unknown, or other
  misc_feature (596)..(596): n is a, c, t, g, unknown, or other
  misc_feature (597)..(597): n is a, c, t, g, unknown, or other
tcaccgcggtggcggccgctctagaactagtggatcccccgggctgcaggaattcgcacgagaccattacctagaacatcctaatcgaaaacattccaccggctccgatcccaactgccatggcgctctccatctacacgcccacctcctcctccctcgtcccgccctccattcaggaggtcaggctgacttcgcgaccgccaaagcccgcgactttcagcctacggaggccacatctggccgcgcgggccgccgctggcaacgcacccacgtccccggtccgcgaggtcgtcactgagctcgacgcggtcgccggcttcagcgagatcgtgccggacaccgtcgtgttcgatgatttcgagaggttcgcacccacggcggccacagtgagctcgtcgctgctgcttgggatcactgggctcccagacactaagttcaagagtgcgatagatactgcactggcagatggtgagtgcaacgcactggagaaggctgaggacaggatgtcctgttacctcaccaaggctcnttgacaatgtggcgctgaactggctcatncagtccctgggagagnttcgacggaaatagatgctcgnntagcttatgacaccaaggccataatccacagggtacatgaactgttggattctatacaccacatggatgctcaactggaccgcctgtattcaaaatcccggctacatgcaaagg

SEQ ID NO: 23931 - protein, 136 aa, Zea mays
  misc_feature: Ceres CLONE 1394645-F
  misc_feature: SWISSPROT Homolog: EC 2.2.1.2 Transaldolase
MALSIYTPTSSSLVPPSIQEVRLTSRPPKPATFSLRRPHLAARAAAGNAPTSPVREVVTELDAVAGFSEIVPDTVVFDDFERFAPTAATVSSSLLLGITGLPDTKFKSAIDTALADGECNALEKAEDRMSCYLTKA

SEQ ID NO: 23932 - DNA, 640 bp, Zea mays
  misc_feature: Ceres CLONE 1394664-F
  misc_feature: Translation starting site: 159
aagctggagctccccgcggtggcggccgctctagaactagtggatcccccgggctgcaggaattcgcacgagaccattacctagaacatcctaatcgaaaaacatgccacattgccaccaagccacagttccacctttcgattcatgcacgctcagtcatgggcgccctccggagtttagccatctcctacccggagttcctcgtggccgggctgtgcttcgtctccctctcggccctgcgccacgcgatgcgtgagcggcggcaacgcgccccccctgagctggcctgtggtgggcatgctcccgttcgtgctcgcgaacctcgggcgcctctacgacgccatcaccgacgccctccacgggtccgggtgcacgctcatgttgcgcgggccgtggctcgcccgcgcggacttcctggtgacgtgcgacccggcggccgtccagcactgcctggcgtcaaacacgggggctacgacaggcgccgagactttgcggagatggtccacctcctgggcgaagggctgctggttgcggaccccgcgttgtgggcgcgccaaggggacgtcgccgccaccggtttcgggaccccgggggttccggtccttcgtcctggggaccagggcgcgccagacgggggcgg

SEQ ID NO: 23933 - DNA, 629 bp, Zea mays
  misc_feature: Ceres CLONE 1394667-F
  misc_feature: Encodes the peptide sequence at SEQ ID NO. 23934
  misc_feature (437)..(437): n is a, c, t, g, unknown, or other
  misc_feature (456)..(456): n is a, c, t, g, unknown, or other
  misc_feature (468)..(468): n is a, c, t, g, unknown, or other
aagctggagctcaccgcggtggcggccgctctagaactagtggatcccccgggctgcaggaattcgcacgagaccattacctagaacatcctaatcgaaaactccctccctcctccattggactgcttgctccctgttgaccattgggtattctgaaccatcgagccatggctgccaagctgactcgcctccacagtcttcgcgaacgccttggtgccaccttctcctcccatcccaatgaactgatagcactcttttccaggtatgttcaccagggcaagggaatgcttcagcgccatcagctgcttgcggagtttgatgccctgtttgatagtgacaaggagaagtatgcaccctttgaagacattcttcgtgctgctcaggaagcaattgtgctccccccatggggtgcacttgctatcaggccaaggcctggngtctgggattacattccgntggattgaagtngacctgcctgtgaagaacctgaatggttctgagtatttggaatcagggaacaggtggggggatggacaatccaacggaactttggggttggacttggttttgagcccttaaagggccctttccgcccttccccaggggaaaacccacgcggaaaggggggg

SEQ ID NO: 23934 - protein, 98 aa, Zea mays
  misc_feature: Ceres CLONE 1394667-F
  misc_feature: SWISSPROT Homolog: EC 2.4.1.13 Sucrose synthase
  misc_feature (97)..(97): Xaa is any aa, unknown, or other
MAAKLTRLHSLRERLGATFSSHPNELIALFSRYVHQGKGMLQRHQLLAEFDALFDSDKEKYAPFEDILRAAQEAIVLPPWGALAIRPRPGVWDYIPXD

SEQ ID NO: 23935 - DNA, 702 bp, Zea mays
  misc_feature: Ceres CLONE 1394668-F
  misc_feature: Encodes the peptide sequence at SEQ ID NO. 23936
ccccgcggtggcggccgctctatatctagtggatcccccgggctgcaggaattcgcacgagaccattacctagaacatcctaatcgaaaaacaactcgcagatcgagtccaagcattcaccggagaatcccaaatcacactctccagtaaccgcccgcttctccagccgcatctctagccgagtctatctcctcctcctcctccgccgccgcaactatcctaatggctcgcttcgccgtggtcgccgccatcgtcgccctcctcgccgtcgtcgcggcggcgcaggccccggccgccaccccgaccacagctcccaaggccgcgcccaggatggccccgctggcgccaccccctgtgcggtccccggccaccgccccggcgtcgggcgacaagccggcgaccgccgcgaggccgtcaccgttggcgtctcatcggggaccgagcagcgagggccccgacgcctctgcaccgtacgcgaaggccccgacctcgagagaatggccaattccggccgcaagcaccactgtcaccgccttccggaagaagaggcgcctcctgcgcctgcgatcgcggcttaatactcgcagacgaagcgggcacccacggcggtatgtgctacaggtctcgccgaggcgcctgggggagaaggttatacaatagagcttgaattcttggtgtgggcgaaaaactgaccttactgcg

SEQ ID NO: 23936 - protein, 145 aa, Zea mays
  misc_feature: Ceres CLONE 1394668-F
MARFAVVAAIVALLAVVAAAQAPAATPTTAPKAAPRMAPLAPPPVRSPATAPASGDKPATAARPSPLASHRGPSSEGPDASAPYAKAPTSREWPIPAASTTVTAFRKKRRLLRLRSRLNTRRRSGHPRRYVLQVSPRRLGEKVIQ

SEQ ID NO: 23937 - DNA, 656 bp, Zea mays
  misc_feature: Ceres CLONE 1394671-F
  misc_feature: Encodes the peptide sequence at SEQ ID NO. 23938
  misc_feature (368)..(368): n is a, c, t, g, unknown, or other
  misc_feature (371)..(371): n is a, c, t, g, unknown, or other
  misc_feature (392)..(392): n is a, c, t, g, unknown, or other
  misc_feature (397)..(397): n is a, c, t, g, unknown, or other
  misc_feature (656)..(656): n is a, c, t, g, unknown, or other
aaagctggagctccccgcggtggcggccgctctagaactagtggatcccccgggctgcaggaattcgcacgagaccattacctagaacatcctaatcaaaaaaacaaccgatcgcccacgcaaacctctcctcaactcgatcaaaccggggacggaaaaggcccaccaaaatcccccaaaatttcgtacctcctcagccccagcaatctcgaatcccgatgctcacagcctccaccgaatccctggcggtcgtcatcagcgcatgagctttcttcgctcgctagcggactccttctcatcgctgctcttctcgtcgggaggcggggcggtgtccatggacgcggcgggggcggccccgtcgccggcgncgntggtgggggagcgcgtggcgntgaanctcagggggtacttcgacctcgccaaagaggagatcgacaaggccgtgcgcgctgaaggagtgggggctccccgacgaggccaccgcgcactaccgcaacgcgaatgcgggtcatgctcgaggccaaggccgcgcgcgtcccccgatgccgtctcctccagcgagaaaggggggaagggtcaagggtgtaccaaggagaagatcgcccaagtggcaggccccaggtcgagggagccggcttcaagagtggctgggtcan

SEQ ID NO: 23938 - protein, 131 aa, Zea mays
  misc_feature: Ceres CLONE 1394671-F
  misc_feature (36)..(36): Xaa is any aa, unknown, or other
  misc_feature (37)..(37): Xaa is any aa, unknown, or other
  misc_feature (44)..(44): Xaa is any aa, unknown, or other
  misc_feature (45)..(45): Xaa is any aa, unknown, or other
MSFLRSLADSFSSLLFSSGGGAVSMDAAGAAPSPAXXVGERVAXXLRGYFDLAKEEIDKAVRAEGVGAPRRGHRALPQRECGSCSRPRPRASPDAVSSSEKGGKGQGCTKEKIAQVAGPRSREPASRVAGS

SEQ ID NO: 23939 - DNA, 658 bp, Zea mays
  misc_feature: Ceres CLONE 1394673-F
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (237)..(237): n is a, c, t, g, unknown, or other
  misc_feature (238)..(238): n is a, c, t, g, unknown, or other
  misc_feature (239)..(239): n is a, c, t, g, unknown, or other
  misc_feature (240)..(240): n is a, c, t, g, unknown, or other
  misc_feature (242)..(242): n is a, c, t, g, unknown, or other
  misc_feature (250)..(250): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (349)..(349): n is a, c, t, g, unknown, or other
  misc_feature (355)..(355): n is a, c, t, g, unknown, or other
  misc_feature (360)..(360): n is a, c, t, g, unknown, or other
  misc_feature (367)..(367): n is a, c, t, g, unknown, or other
  misc_feature (402)..(402): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (451)..(451): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (504)..(504): n is a, c, t, g, unknown, or other
  misc_feature (505)..(505): n is a, c, t, g, unknown, or other
  misc_feature (507)..(507): n is a, c, t, g, unknown, or other
  misc_feature (508)..(508): n is a, c, t, g, unknown, or other
  misc_feature (524)..(524): n is a, c, t, g, unknown, or other
aaagctggagctccccgcggtggcggccgctctagaactagtggatcccccgggctgcaggaattcgcacgagaccattacctagaacatcctaatcgaaaaacgggtcaccagtcaccacatccctccctccctgccatttgtttggttgttcctctcgcagtctcgctcgccaccaggcagcaggcatcccaatctcgcgagagccagtagcggcggcggcggcgnnnnnnnngnnnncncttccggntgcctgccgtgtggccgtcggggtgggggtccgccttcgcggcgtcgcggtctggctctccccggccggcgctcgccggcgggggtgtccnnnccgcgnccgccntgtcnttccctnttcgccgcccgccgggggggggggggggggggggnttggggttttctgggggggcccnnngccggtgcctccccctgccccctnttccccnnnnggcggggtgccccccgtcggccgcctttgcggccttccttgtnncnngcccccccgggcccgntcgcccccggcgctggctccccgcggcccgccccgcgcccccgccccccccgcgcgcttccctcctcggcctccccttccgctcccccggggggggggggcgctgccccggtctcgtgtttcgcgcgccgtgtg

SEQ ID NO: 23940 - DNA, 638 bp, Zea mays
  misc_feature: Ceres CLONE 1394675-F
  misc_feature: Encodes the peptide sequence at SEQ ID NO. 23941
  misc_feature (285)..(285): n is a, c, t, g, unknown, or other
  misc_feature (293)..(293): n is a, c, t, g, unknown, or other
  misc_feature (399)..(399): n is a, c, t, g, unknown, or other
  misc_feature (427)..(427): n is a, c, t, g, unknown, or other
tggagctccccgcggtggcggccgctctagaactagtggatcccccgggctgcaggaattcgcacgagaccattacctagaacatcctaatcgaaaaacaagcacacgaagccttcgcattcctgtccggcggaaccgcggaaggaagggagccgaacgagcaagcaagccaccaaggaaggttgctagggccggggcggatggggttcatactgcgggtgaggctcgcctccttcttcgccggcgcggctggcgccccgcacggcgggggctacttcctctacnaggactancagctcgccaacgattctatggggcctcagggtgaaatgtctccaggactcaactgacactcgctacgaagcccttgaaaagcgactcgctgctttggaaggtcancaaagcactgaggctgcaccggatgtgnatacgccatcagattagtctggtcgctacgagactttgatttacggctgttttcgtttaacccagttggcttctcctttgaaaggaagtacctggacaaaaaaaaaatatctaggatgcttcttttggactggaagtctgcaaatggccgaggctgagatcctcccctacttttcatggcggaaaagccatgaacctccaaaaaaaaaaaa

SEQ ID NO: 23941 - protein, 49 aa, Zea mays
  misc_feature: Ceres CLONE 1394675-F
  misc_feature (29)..(29): Xaa is any aa, unknown, or other
  misc_feature (31)..(31): Xaa is any aa, unknown, or other
MGFILRVRLASFFAGAAGAPHGGGYFLYXDXQLANDSMGPQGEMSPGLN

SEQ ID NO: 23942 - DNA, 632 bp, Zea mays
  misc_feature: Ceres CLONE 1394684-F
  misc_feature: Encodes the peptide sequence at SEQ ID NO. 23943
  misc_feature (396)..(396): n is a, c, t, g, unknown, or other
  misc_feature (397)..(397): n is a, c, t, g, unknown, or other
  misc_feature (588)..(588): n is a, c, t, g, unknown, or other
aaagctggagctccccgcggtggcggccgctctataactagtggatcccccgggctgcaggaattcgcacgagaccattaacctagaacatcctaatcgaaaacaatccaattcacaaacacacacgggcaatcaattagcagaacccgcgccacccccccttcctcggagtcggagcgagtcgaggaacggctcgtctgcctctcccgttctccttcccctcctccccagaagatctgatccatcatcgaggactcgccgggaagaatcaaggatatatagataataaacaaacaaaggttcctccagagcccagaggagggaagtcaccggccgtcggcggggaggagatgtcggacggcgcgggctcccggacggggcgtcgctggcgcgtgnngcctctcggtcacctcgtcggtggccatcgtcatctgcaacaagtacctcatcagcactctaggcttcttctttgcgacgacgctgacgagctggcacctcatggtgaccttcttcacgctgtacgttgcgcagcggctgcgcttcttcgagccaaagccgatcgacgcgcggaccgtcatctccttcggnctgctcaacggcatctccattggcctcctcacctcctgcctcgg

SEQ ID NO: 23943 - protein, 44 aa, Zea mays
  misc_feature: Ceres CLONE 1394684-F
MVTFFTLYVAQRLRFFEPKPIDARTVISFGLLNGISIGLLTSCL

SEQ ID NO: 23944 - DNA, 641 bp, Zea mays
  misc_feature: Ceres CLONE 1394686-F
  misc_feature: Encodes the peptide sequence at SEQ ID NO. 23945
  misc_feature (351)..(351): n is a, c, t, g, unknown, or other
  misc_feature (486)..(486): n is a, c, t, g, unknown, or other
aagctggagctccccgcggtggcggccgctctataactagtggatcccccgggctgcaggaattcgcacgagaccattacctagaacatcctaatcgaaaaatcgccagacagactatataccacagccagtcaaccacatcactacctagttgtgcataggcaatgacgtccaaggtagagctgtcgccggaggtcaagtccccggatgacaagctgtggccgcgtcgctgctcgactccacgaagctgttccccaagatcttccccgagcagtacaagagcatcgagaccgtcgagggcgacggtaagtcggccggcaccgtccgcctcctcaagtacaccgaggcgangccgatgctgacgttcgccaaggagaagcttgagacggcgtacgacgagaacaagtcgctgtcgtacagcgtgctggacggcgagctggcgaacttctacaagaactgcaagatcacgcttgaggtgactccggncaaggcggacggcgagggcggcgccgtcgtcagctgggccatggagttcgacaaggccaacgaccaggtgcccgacccggacgtcatcaaggagaccgcccacaagacgttccacgacctcgacgactacctcctcaagaactagatggagcgac

SEQ ID NO: 23945 - protein, 91 aa, Zea mays
  misc_feature: Ceres CLONE 1394686-F
  misc_feature (1)..(91): Pfam Name: Bet_v_I Pfam Description: Pathogenesis-related protein Bet v I family
  misc_feature (44)..(44): Xaa is any aa, unknown, or other
MLTFAKEKLETAYDENKSLSYSVLDGELANFYKNCKITLEVTPXKADGEGGAVVSWAMEFDKANDQVPDPDVIKETAHKTFHDLDDYLLKN

SEQ ID NO: 23946 - DNA, 655 bp, Zea mays
  misc_feature: Ceres CLONE 1394687-F
  misc_feature: Encodes the peptide sequence at SEQ ID NO. 23947
  misc_feature (393)..(393): n is a, c, t, g, unknown, or other
  misc_feature (396)..(396): n is a, c, t, g, unknown, or other
  misc_feature (421)..(421): n is a, c, t, g, unknown, or other
  misc_feature (422)..(422): n is a, c, t, g, unknown, or other
  misc_feature (461)..(461): n is a, c, t, g, unknown, or other
  misc_feature (512)..(512): n is a, c, t, g, unknown, or other
  misc_feature (545)..(545): n is a, c, t, g, unknown, or other
  misc_feature (595)..(595): n is a, c, t, g, unknown, or other
  misc_feature (627)..(627): n is a, c, t, g, unknown, or other
  misc_feature (630)..(630): n is a, c, t, g, unknown, or other
  misc_feature (640)..(640): n is a, c, t, g, unknown, or other
  misc_feature (641)..(641): n is a, c, t, g, unknown, or other
aaagctggagctccccgcggtggcggccgctctagaactagtggatcccccgggctgcaggaattcgcacgagaccattacctagaacatcctaatcgaaaaacatcgatcagtcgcgtgtctaggtttcctctctcaccatagcgcccgctctgtcgcccttcgttcacctctccttcctctcctccctgcctgccagggagaggggaagtcagaggcacggagtggcgcagagcagacgcacgtgaaccattgtagctgtccctgtcgtcgtcgtcgtcgtcaacgaatccacacaaggaaaggatggagaagaagccgaccatcctcatgaacaggtacgagctcgggcgcacgctcgggcagggcaccttcgccaaggtgtaccacggncgnaacctcgcgtccggcgagagcgtgnncatcaaggtcatcgacaaggagaaggtgatgcgcgtcgncatgatcgaacagatcaagcgcgagatctccgtcatgcgcctcgtcgccancccaacgtcgtgaggctgcaacgaggtgatggncagcaagagcaagaatacttcccccctgggagtaacggtcccggggcggngagctctttcgccgcgtcggcccgcggcgggnttnaaggaagagnnccccgcgagaaggt

SEQ ID NO: 23947 - protein, 72 aa, Zea mays
  misc_feature: Ceres CLONE 1394687-F
  misc_feature: SWISSPROT Homolog: EC 2.7.11.1 Non-specific serine/threonine protein kinase
  misc_feature (39)..(39): Xaa is any aa, unknown, or other
  misc_feature (52)..(52): Xaa is any aa, unknown, or other
  misc_feature (69)..(69): Xaa is any aa, unknown, or other
MEKKPTILMNRYELGRTLGQGTFAKVYHGRNLASGESVXIKVIDKEKVMRVXMIEQIKREISVMRLVAXPTS

SEQ ID NO: 23948 - DNA, 720 bp, Zea mays
  misc_feature: Ceres CLONE 1394689-F
atgtggctccccgccggggggggcgcgcctagaactactggagcctccggcgctgctggaattcttacgacaccattacctactacatcctaatagacaatatttcctgaggctatggaatgatgtatcaaaagacaattgaattagtgcatgtacttggacacctctgtgaaaattgacgctcaaaggatttcagttggacataacttgaactttgaacccagaaaagatacaagtcatcatgagtctgccagcatacatctgtcgctgatgatcatataaaaacagtaacgccagccgcaatgttttgcacgagaaaatacagcatctacgaaggttagtactcattcagtgaattcagatagtgaagacaagagctacaagcaagtcatggatactgatcctggtacaagccatagcacagggttgatgtttgaggtgggcgctgcagaagaagaacttgacatgctcctcgattcatttggcggaactcacctttccagctccaacttggacgaaccatttgagcccgtttcaactttgcaagagatcagtcggtccaatgagaaggttggacctagcttgtcttccggaccacctttgcttgcacctctcgacgatgctctagatgacttgctttcagagacttctcatactgctgcacagaacgaaggctttgctacgcaatgtataacttctcaaccgacggctgattctggc

SEQ ID NO: 23949 - DNA, 628 bp, Zea mays
  misc_feature: Ceres CLONE 1394694-F
  misc_feature: Translation starting site: 228
  misc_feature: SWISSPROT Homolog: EC 2.4.1.12 Cellulose synthase (UDP-forming)
  misc_feature (427)..(427): n is a, c, t, g, unknown, or other
  misc_feature (467)..(467): n is a, c, t, g, unknown, or other
  misc_feature (561)..(561): n is a, c, t, g, unknown, or other
ggagctccccgcggtggcggccgctctagaactagtggatcccccgggctgcaggaattcgcacgagaccattacctagaacatcctaatcgaaaactctcggatcgagtgcttgagctccgaccaaatctcgcagcggctgcaattccgagcccgaagagcggatcaggcgaggacgacgccttcgattctgatctgcggtcggcgcgacccagagagaaccggagatgcagcagggcgacggcacggaggcgcaggtgacgtgggaggaccagcagaacatcaaccgcttcggtcgcctcaacaaccgcctccacgagctccaggaagagatcaagctcgcaaaggagacgaatgagaaccttgatctcttcctgggtcacagtggagggcttgacgttgaaggcaatgaacttcctcgtttggnttatgtggctcgggaaaaacgtcctgggattcaacatcancagaaggctggtgccatgaatgcacttgttcgtgtatcagctgtccttactaatgggcaatacatgttgaaatcttgattgggaccactacatncataatagcaaggctcttcgagaagctatgtgcttccttatggaccaaacctaggaaaggatggtcg

SEQ ID NO: 23950 - DNA, 707 bp, Zea mays
  misc_feature: Ceres CLONE 1394699-F
  misc_feature: Encodes the peptide sequence at SEQ ID NO. 23951
  misc_feature (26)..(26): n is a, c, t, g, unknown, or other
aagctggagctccccgcggtggcggncgctctataactagtggatcccccgggctgcaggaattcgcacgagaccattacctagaacatcctaatcgaaaaccgttgcagtgcagttgcaggctctcgccgactccccttctccttcgacctccgccgctcgccgacgtttcccgtccgcggtggcgcctcctcccctcccactcttcctcgttgtcgatctcgtatcgggcaccatggtaagatcactctccaccgccctcgtgaggggacttatgagatcgtcccgtgcatcgacatcagctgctgtgtcacgaccagctatccaggaggttatgaactattcatcaggtcttagttgcactcctaatgcgaatggggactcagtgacaacacgagtagctgctgatcacgacacccatcaagattttcagccaacaagtaaaaggtcagatatgtctttcagtgacattgttgctcaggatgtgaaggagcaccctgctgtcatctatatgaaaggttatcctgacgctcctaggtgtggtttcagggcattagcagcgaaggtcctccagcaatatggcgtccccatcagtgctagagatattctttcagatctaaagctcacagagagtgttatagcatacagtaactggcctacgttacacaaatatttatcataggagagtacgttgagggatctgatat

SEQ ID NO: 23951 - protein, 148 aa, Zea mays
  misc_feature: Ceres CLONE 1394699-F
MVRSLSTALVRGLMRSSRASTSAAVSRPAIQEVMNYSSGLSCTPNANGDSVTTRVAADHDTHQDFQPTSKRSDMSFSDIVAQDVKEHPAVIYMKGYPDAPRCGFRALAAKVLQQYGVPISARDILSDLKLTESVIAYSNWPTLHKYLS

SEQ ID NO: 23952 - DNA, 614 bp, Zea mays
  misc_feature: Ceres CLONE 1394701-F
  misc_feature: Encodes the peptide sequence at SEQ ID NO. 23953
  misc_feature (331)..(331): n is a, c, t, g, unknown, or other
  misc_feature (332)..(332): n is a, c, t, g, unknown, or other
  misc_feature (389)..(389): n is a, c, t, g, unknown, or other
  misc_feature (402)..(402): n is a, c, t, g, unknown, or other
  misc_feature (612)..(612): n is a, c, t, g, unknown, or other
aagctggagctccccgcggtggcggccgctctagaactagtggatcccccgggctgcaggaattcgcacgagaccattacctagaacatcctaatcgaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcggtgtcgacggcctcccgccgnngcctccgggttgggcggtggtggagaacctgttccagtgatccttcagcgacggccnttcatgtacgtgntgcgcgacctccgggagaagtacgggcccatcttcaccatgcggatggggcagcgcaccctcatcgtggtcacctcggcggagctcatccacgaggcgctggtgaagcagggccccatggtcgcgagcccgcccggagacagccccaccccgcctctcttcagcgtcgggaagtgcaccgtcaactcggcgccctacggccccctgtggngg

SEQ ID NO: 23953 - protein, 73 aa, Zea mays
  misc_feature: Ceres CLONE 1394701-F
  misc_feature: SWISSPROT Homolog: EC 1.14.13.68 4-hydroxyphenylacetaldehyde oxime monooxygenase
  misc_feature (4)..(4): Xaa is any aa, unknown, or other
MYVXRDLREKYGPIFTMRMGQRTLIVVTSAELIHEALVKQGPMVASPPGDSPTPPLFSVGKCTVNSAPYGPLW

SEQ ID NO: 23954 - DNA, 682 bp, Zea mays
  misc_feature: Ceres CLONE 1394704-F
  misc_feature: Encodes the peptide sequence at SEQ ID NO. 23955
aagctggagctccccgcggtggcggccgctctagaactagtggatcccccgggctgcaggaattcgcacgagaccattacctagaacatcctaaaaaaaaaaataggacaagccccagcagtttgccactcccacgcgaaacagaagccccagcagggcggcactcccgacgcgacgcccctgcttgccggccgggaggctcactcgactctgcctccacttcctcgtctgtccgttgaagcacggcgccgatggcggcggcgccagcgctcgcgcggaagctgctggacgcggcgcggaagccgaatttcgcggagtgggaccgcggcgtggcgcccccgatccaccagcacccggaggtggccttccaaggacccccggacggggggggtcgtgggcgccgagttcgaagagatcggggtcccctacccctggcccgtcgcgcaaaaggggggcctgggccacaatcacgggccccgccgggggccccgggtctccgttcccccccaaaagggaccgccttccccatccagcaaatggggaaaatggggggtttcaagaactcacggaaaaacggaaaaaatggcttggcggggcggcccatgaacccccccacgggggacatggctttcttggggaagcaagatagcggttttttctcacccccccggaaggggtaata

SEQ ID NO: 23955 - protein, 142 aa, Zea mays
  misc_feature: Ceres CLONE 1394704-F
MAAAPALARKLLDAARKPNFAEWDRGVAPPIHQHPEVAFQGPPDGGGRGRRVRRDRGPLPLARRAKGGPGPQSRAPPGAPGLRSPPKGTAFPIQQMGKMGGFKNSRKNGKNGLAGRPMNPPTGDMAFLGKQDSGFFSPPRKG

SEQ ID NO: 23956 - DNA, 683 bp, Zea mays
  misc_feature: Ceres CLONE 1394705-F
aagctggagctccccgcggtggcggccgctctagaactagtggatcccccgggctgcaggaattcgcacgagaccattacctagaacatcctaatcgaaaaaaaaagggccatccgagttgccagccaattttgcatccccaccaccaatccaccaccccacacccagtgacagagacagaaggccgggcaggtatacgcgacgcgacggagatggagcacacgaatcatcgccgccgccgtcaagttttggccaccgtgtcggcgacgacgacgctcctgctgcttctcctctgcctcgcggagttgacgacggcagaggccctgcgcgagcacagggacgagggcgggcgctagcatcagtggcggaaccggaagggggtggggcagcaccgccgcccggaggaagcaaatcgccggccgtggggggttgtccgggaactcgaacgcgcaccccggtgaaccctgggcgacccccggggggaagcttgacccgcgaggggggacgaaccccgaacggggaccaactttcccccggcccggccccgcccggccggtttttccgaaagggccgcggccctccaccgagttacatagacctccggcggggggggggggggcccaaccccccggtgggccgccacaaacgtgggggacaaggcgccctctccccacgcccgggcc

SEQ ID NO: 23957 - DNA, 746 bp, Zea mays
  misc_feature: Ceres CLONE 1394710-F
  misc_feature: Encodes the peptide sequence at SEQ ID NO. 23958
  misc_feature (643)..(643): n is a, c, t, g, unknown, or other
  misc_feature (644)..(644): n is a, c, t, g, unknown, or other
  misc_feature (650)..(650): n is a, c, t, g, unknown, or other
aagctggagctccccgcggtggcggccgctctatactagtggatcccccgggctgcaggaattcgcacgagaccattaccagaacatcctaatcgaaaaatccgtgctttgtgcctgtttggtgcgcgtccacctttcggggtcaccggcttctgctttcttgctacgccaccgcgcctctcgtctatttatggagtcccccgatccatgaagccggtgcaggccgagagttgtcaacgacgacgtctgccggcagtgctcctgctcctcctcctccttcccggccgccgcgcgagcttgggttagtgtctcttcttcgcggaggcctgtgagaggagccatcatcatggccgctgttgagactgttgtcctcaaggttgctatgtcatgcgagggctgcgccggggcggtcagaagagtgctctccaagatggaaggagttgaaaccttcgacatagacctcaaggagcagaaggtgacagtcaaaggcaatgtcaagcctgaggacgtcttccagacggtttccaagtcggggaagaggacctcgtactgggagggcgaagccacggccccggacgctgcggcggctccagaagccgaagcagctcccagcaccgcggcagaagcgcctcctgctgctccnngcgcgncagagatcaccccagccaaagctgacgcctgatcgtcacgctattattcactcacatgtgatgctgtgcggctgcgactcctaaacctaaatctag

SEQ ID NO: 23958 - protein, 111 aa, Zea mays
  misc_feature: Ceres CLONE 1394710-F
  misc_feature (7)..(68): Pfam Name: HMA Pfam Description: Heavy-metal-associated domain
  misc_feature: SWISSPROT Homolog: EC 3.6.3.4 Copper-exporting ATPase
  misc_feature (100)..(100): Xaa is any aa, unknown, or other
  misc_feature (102)..(102): Xaa is any aa, unknown, or other
MAAVETVVLKVAMSCEGCAGAVRRVLSKMEGVETFDIDLKEQKVTVKGNVKPEDVFQTVSKSGKRTSYWEGEATAPDAAAAPEAEAAPSTAAEAPPAAPXAXEITPAKADA

SEQ ID NO: 23959 - DNA, 734 bp, Zea mays
  misc_feature: Ceres CLONE 1394713-F
  misc_feature: Encodes the peptide sequence at SEQ ID NO. 23960
  misc_feature (710)..(710): n is a, c, t, g, unknown, or other
aaagctggagctccccgcggtggcggccgctctagaactagtggatcccccgggctgcaggaattcgcacgagaccattacctagaacatcctaatcgaaaaactctgatgttgttgcttcgtataacctggtctccgaaatccgaataccccgtagcagctgcggttggatctcagatcggtgctgcggtccctcttttaatttgtttcccctccgcttccgttagcgccgactgatcgtcgagtcagatcttacaccctatatatagtctcatctagccgtcactagtgagactcgatttgattcgttccactggattaagcgctttgagcgcgctagatacgtgtcatatcacataaacaatggtgaaggctgttgctgtgcttggtagcagcgatggtgtcaagggcaccatctttttcacccaagagggagatggccctaccgctgtcaccggaagtgtctctggcctcaagcctggcctccatgggttccatgtacatgcacttggtgacaccaccaatggatgcatgtcaactggaccacactacaatcctgcgagcaaggagcatggggcaccagaagatgagaaccgccatgctggtgatcttggaaacgtgacagctggagcagatggtgttgctaatatcaatgtcaccgacagccagatcccactgactgggccaaactcaatcattggcagagctgntgttgttcacgctgatcctgatga

SEQ ID NO: 23960 - protein, 123 aa, Zea mays
  misc_feature: Ceres CLONE 1394713-F
  misc_feature (1)..(123): Pfam Name: Sod_Cu Pfam Description: Copper/zinc superoxide dismutase (SODC)
  misc_feature: SWISSPROT Homolog: EC 1.15.1.1 Superoxide dismutase
  misc_feature (116)..(116): Xaa is any aa, unknown, or other
MVKAVAVLGSSDGVKGTIFFTQEGDGPTAVTGSVSGLKPGLHGFHVHALGDTTNGCMSTGPHYNPASKEHGAPEDENRHAGDLGNVTAGADGVANINVTDSQIPLTGPNSIIGRAXVVHADPD

SEQ ID NO: 23961 - DNA, 653 bp, Zea mays
  misc_feature: Ceres CLONE 1394716-F
  misc_feature: Translation starting site: 239
  misc_feature (230)..(230): n is a, c, t, g, unknown, or other
  misc_feature (538)..(538): n is a, c, t, g, unknown, or other
aaagctggagctccccgcggtggcggccgctctagaactagtggatcccccgggctgcaggaattcgcacgagaccattacctagaacatcctaatcgaaaagcattgcattgcataaacctctcgtgggaagtgcaaacaccaaatccgcaatctatctatctatcacccattcaggcctgcaggctgcagctctctccactgcacactagagcgagctgccacagacnaggacacaatgccacccatacccaagagaggcgagcatctcctgctcctcctaattgtcgcatgcgatgccaccgccgccaccgccgtcggaaccgtccccttctacccgtccgcggagtcagccgccgccgagcactgcaacgacacgctgtacccggagctctgcctgtcgacactcgcggacttccggacctacacaagaagccgctcccggacgtcatctgcgcggccgtgaaccgcaccgaggacgtggtgttcgccacgtccagcaactgctcgtactacctgcaggacaggtccctggtcnggcgcggaaccgcctggccatcaacgactgcctggagctgctgcccaccacgatggacgagctcccgcgcagaaccggcgaactggcgtccccggccggggggggggtccgggtt

SEQ ID NO: 23962 - DNA, 629 bp, Zea mays
  misc_feature: Ceres CLONE 1394717-F
  misc_feature (357)..(357): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (486)..(486): n is a, c, t, g, unknown, or other
  misc_feature (549)..(549): n is a, c, t, g, unknown, or other
aagctggagctccccgcggtggcggccgctctagaactagtggatcccccgggctgcaggaattcgcacgagaccattacctagaacatcctaatcgaaaaagatctcccgctccctccttcccttcatctctctgaatcctgctgcccacctcgccgtcctcgcattccgccgctcgctctcgcgatccggcagcttcctcttcgccgtcgttcttgcctcacctcgtccgctatcctgtaagctgctgctgggtcacccgtggctggactcgaccccgccggcgccgcctccgggggctgggttcgccggatgtttatcggctcctgatccatccggatcccggatccgccgcanaggcaccgcctttgtaggttctccgggcccatgcaggagggtttggcgattcggcggtgaggcagggctctggtttagttcttgcgttggactagcccggagatgcttcgtggaacgnnngcacgcggncgggatgcgcggaggcgggcactgcgctcgtcgcggcggcgtctgcccgggtggatctggtgncttctcggatcttccctcctggcgggctcatgctcttcgtccttcacacaccaaaaggagcagttcgccggccgtcgtga

SEQ ID NO: 23963 - DNA, 615 bp, Zea mays
  misc_feature: Ceres CLONE 1394718-F
  misc_feature: Encodes the peptide sequence at SEQ ID NO. 23964
  misc_feature (257)..(257): n is a, c, t, g, unknown, or other
  misc_feature (258)..(258): n is a, c, t, g, unknown, or other
  misc_feature (402)..(402): n is a, c, t, g, unknown, or other
aaagctggagctccccgcggtggcggccgctctagaactagtggatcccccgggctgcaggaattcgcacgagaccattacctagaacatcctaaaaaaaaatcactacctctccctctccgtcgcgacacaggccacggcgggcggcggcggaggcttccgtgcggctcttggcggattgaacgcccactcgagctgcgccggcggctgtttcagccgtccttagatagaccctgctttcctcccgggcgaatcannagtgcacaaatgccgacaccagtgaaagtcgtgctccccgtggtgctcctcggctgcggcggcgtcgggcgctacctcctccgcacatcgtctcctgtcgtcccctccacgcaccagggcgtggcatccgggtggtgggcgtcnccaatactcctcctggtcgtcgccgaaaaagggcactccaccggcctcgatgacggggtcctcaccaatttgggccggcaaggccggaagctcccccttccctccctggccggcggagggactggaatttgtcaaaaacctgggggtagggggaaagctaaaacccgccccccccctggaaaacccaaggggccggggctaaaaaaccggcct

SEQ ID NO: 23964 - protein, 116 aa, Zea mays
  misc_feature: Ceres CLONE 1394718-F
MPTPVKVVLPVVLLGCGGVGRYLLRTSSPVVPSTHQGVASGWWASPILLLVVAEKGHSTGLDDGVLTNLGRQGRKLPLPSLAGGGTGICQKPGGRGKAKTRPPPGKPKGPGLKNRP

SEQ ID NO: 23965 - DNA, 637 bp, Zea mays
  misc_feature: Ceres CLONE 1394724-F
  misc_feature: Encodes the peptide sequence at SEQ ID NO. 23966
  misc_feature (323)..(323): n is a, c, t, g, unknown, or other
  misc_feature (547)..(547): n is a, c, t, g, unknown, or other
aagctggagctccccgcggtggcggccgctctagaactagtggatcccccgggctgcaggaattcgcacgagaccattacctagaacatcctaatcgaaaagagaagaaacacggaagggaggctctcaccagtcaccactcacctgacgacgagcgagcgagaggaacggggcgagggaagttaaacgcgcggcgatgccggagctgccggaggtggaggcggcgcgtcgggcgctgcaggcgcactgcgtggggaggcgcatcgcgcgctgcgccgtggcgacgacgccaaggtggtcgttgccgccgccggccgcgcggncttcgagcgggccatggtcggccggaccatcgtcgccgcgcgcccggaggggcaagaacctctggctccagctcgacgcgccgcccttcccgtcctttcagttcgggatggcaggcgcgatatatatcaaaggcattcctgtgacgaattataagagatccgttgttaattccgaagaggagtgcccctcccaatactctaaattctttgctgagcttgatggngggtttggagttctctttcactgataaacggcgctttgcaagagttcggtttgttggagatcctgaaaccgaccccccatttctgagctg

SEQ ID NO: 23966 - protein, 124 aa, Zea mays
  misc_feature: Ceres CLONE 1394724-F
  misc_feature (2)..(123): Pfam Name: Fapy_DNA_glyco Pfam Description: Formamidopyrimidine-DNA glycosylase N-terminal domain
  misc_feature (43)..(43): Xaa is any aa, unknown, or other
MPELPEVEAARRALQAHCVGRRIARCAVATTPRWSLPPPAARXSSGPWSAGPSSPRARRGKNLWLQLDAPPFPSFQFGMAGAIYIKGIPVTNYKRSVVNSEEECPSQYSKFFAELDGGFGVLFH

SEQ ID NO: 23967 - DNA, 624 bp, Zea mays
  misc_feature: Ceres CLONE 1394735-F
  misc_feature: Encodes the peptide sequence at SEQ ID NO. 23968
  misc_feature (315)..(315): n is a, c, t, g, unknown, or other
  misc_feature (316)..(316): n is a, c, t, g, unknown, or other
  misc_feature (340)..(340): n is a, c, t, g, unknown, or other
  misc_feature (406)..(406): n is a, c, t, g, unknown, or other
  misc_feature (407)..(407): n is a, c, t, g, unknown, or other
  misc_feature (417)..(417): n is a, c, t, g, unknown, or other
  misc_feature (451)..(451): n is a, c, t, g, unknown, or other
  misc_feature (473)..(473): n is a, c, t, g, unknown, or other
  misc_feature (474)..(474): n is a, c, t, g, unknown, or other
  misc_feature (483)..(483): n is a, c, t, g, unknown, or other
  misc_feature (488)..(488): n is a, c, t, g, unknown, or other
aaagctggagctccccgcggtggcggccgctctagaactagtggatcccccgggctgcaggaattcgcacgagaccattacctagaacatcctaaaaaaaactttctgacctcttctggaatcctgcgacgaggggaccgaaatggcctcgtcctcctctgactccggccgcatcgccggaaccctagccttgcgtacgagctcggccttagcggcggcgtcgctaatcccggggctcccggacgacgttgcagctgtcattctctgcctgctcaccttcccccgacagtcccgcctccgcgccacctcgggggnnttggtgcttgctcctctctggggntacgctcctcccgctccgccgtaagctccgtctcccggggcgccagcttctctggctctttcccanncgaccatccntcgctccccgatcctgctcgaccccgcgcactanccagctggtggccctccgccgnntccctggtngcggnagctttacggctcgcacttaccggcccctcggcgtggcgccactctaggtcctcgggggggctttgctcgacgccgagtttaccctttggggaccctcgccctcgggggggcctacggggtgaccttgcactcccg

SEQ ID NO: 23968 - protein, 73 aa, Zea mays
  misc_feature: Ceres CLONE 1394735-F
  misc_feature (58)..(58): Xaa is any aa, unknown, or other
MASSSSDSGRIAGTLALRTSSALAAASLIPGLPDDVAAVILCLLTFPRQSRLRATSGXLVLAPLWGYAPPAPP

SEQ ID NO: 23969 - DNA, 679 bp, Zea mays
  misc_feature: Ceres CLONE 1394738-F
  misc_feature: Translation starting site: 208
  misc_feature (388)..(388): n is a, c, t, g, unknown, or other
  misc_feature (441)..(441): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (465)..(465): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (475)..(475): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (496)..(496): n is a, c, t, g, unknown, or other
  misc_feature (497)..(497): n is a, c, t, g, unknown, or other
  misc_feature (504)..(504): n is a, c, t, g, unknown, or other
  misc_feature (505)..(505): n is a, c, t, g, unknown, or other
  misc_feature (527)..(527): n is a, c, t, g, unknown, or other
  misc_feature (531)..(531): n is a, c, t, g, unknown, or other
  misc_feature (537)..(537): n is a, c, t, g, unknown, or other
  misc_feature (539)..(539): n is a, c, t, g, unknown, or other
  misc_feature (554)..(554): n is a, c, t, g, unknown, or other
  misc_feature (555)..(555): n is a, c, t, g, unknown, or other
  misc_feature (562)..(562): n is a, c, t, g, unknown, or other
  misc_feature (566)..(566): n is a, c, t, g, unknown, or other
  misc_feature (570)..(570): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (586)..(586): n is a, c, t, g, unknown, or other
  misc_feature (589)..(589): n is a, c, t, g, unknown, or other
  misc_feature (593)..(593): n is a, c, t, g, unknown, or other
  misc_feature (596)..(596): n is a, c, t, g, unknown, or other
  misc_feature (597)..(597): n is a, c, t, g, unknown, or other
  misc_feature (602)..(602): n is a, c, t, g, unknown, or other
  misc_feature (616)..(616): n is a, c, t, g, unknown, or other
  misc_feature (620)..(620): n is a, c, t, g, unknown, or other
  misc_feature (624)..(624): n is a, c, t, g, unknown, or other
  misc_feature (625)..(625): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (655)..(655): n is a, c, t, g, unknown, or other
  misc_feature (656)..(656): n is a, c, t, g, unknown, or other
  misc_feature (664)..(664): n is a, c, t, g, unknown, or other
  misc_feature (665)..(665): n is a, c, t, g, unknown, or other
  misc_feature (667)..(667): n is a, c, t, g, unknown, or other
  misc_feature (668)..(668): n is a, c, t, g, unknown, or other
aaagctggagctccccgcggtggcggccgctctagaactagtggatcccccgggcttgcaggaattcgcacgagaccattacctaagaacattcctaatcgaaaaagaaaagcccccctcaaaacccacggcgccgccgcagccgcgttcacgaagcttggggaggcgagcaccccgatccggcgaggtgccgcgagcgaggcagcgatgagaggccgtgcgtcccatctccgcgcgctcctctcgcgagcgctctctccaagccttcctcctcctggtcgcgctctgcctcaggtcactaggcccgggtgcgtctccgttcggagctgggattcgtgggggcgcgcgcgcttcttctccatcgacgcctcggttgcgaccgcagggncgggtcgaagccccctggcgcgcccgccggggggtactggcgggcggcgaggnannnnnnnnnngnnnnnnnnnncngnnnannncngannnggggggccggccgggnngggccgnncggcgggggggccgggggcccngggnccccgncnccccccccccgggcnngggggcngggngggngggnnnnncccggggnccnccgnccnnggggnggggggcgggcccngggngggnnggggcgnnnnncgggcggggggcggggggnnccccgggnncnncccggggggcc

SEQ ID NO: 23970 - DNA, 642 bp, Zea mays
  misc_feature: Ceres CLONE 1394740-F
  misc_feature: Translation starting site: 214
  misc_feature (148)..(148): n is a, c, t, g, unknown, or other
aagctggagctccccgcggtggcggccgctctagaactagtggatcccccgggctgcaggaattcgcacgagaccattacctagaacatcctaatcgaaaaggaaatccatggtgtaggcccagagagatctagctagagtttctggncatccgcctccgccccccaccgcctccacctccgccccccaccgccccgccccacagcaggaaggatggaagccccgggctccccctacgcctcctcgccggaatccgcccccaagcgtgccccacgctcccctccgcagcagcagcagtctccctccgaggaaggagatgacaaggagaaaccaacacatttgagatttctagtgtctaatacggcagcagggtgcatcattgggtaagggtggatcaaccattaatgattttcagtcccagtctggggctcgtattcagttatcacgtagccactgagtttttccctggtacaaatgacagaatcatcatggtttctggactgtttgatgaaagtaatgaagcccatggagctgattcttgagaaactggtggcttgaggggtgaagaattcaacgaagcagaagctagacctaaagttaagacttgtagttcctaatagcttccttgtggtggtataaatg

SEQ ID NO: 23971 - DNA, 630 bp, Zea mays
  misc_feature: Ceres CLONE 1394743-F
aagctggagctccccgcggtggcggccgctctagaactagtggatcccccgggctgcaggaattcgcacgagaccattacctagaacatcctaatcgaaaaactactagtgatcagaccagtgagctagcgactgtaccatgcagcagctgtaggagagcctggtggtaggtaggataggagtagcgccagccgccaagtgcgcgtccgggctggctgcttcgacgagcaggagggagccgcaccgccgggctcccgcaatgtcgcctcctccgcccccgccgctgctgcgcaacgagctgtcgcgcaggacggcggtgctgggcctgcgcctgtgggtgctggtggtcatcgcccgccggggtcgcctccgcgctggtcctcgtgctcattccctcccaccccccccggcgcgtcgcgaccccccccgaaaggcctccccggccgttatggcaccgcccctggctccccccccccctttcccccttgttctcccgccctgtctcccggcacccccccctgtgttgttcccctcctccccgccccccccctctaccattctccctcccctcccctctttctctccctcgccccgtttcttccgcttctcctccttcttcccccccttttg

SEQ ID NO: 23972 - DNA, 653 bp, Zea mays
  misc_feature: Ceres CLONE 1394746-F
  misc_feature: Encodes the peptide sequence at SEQ ID NO. 23973
  misc_feature (305)..(305): n is a, c, t, g, unknown, or other
  misc_feature (375)..(375): n is a, c, t, g, unknown, or other
  misc_feature (376)..(376): n is a, c, t, g, unknown, or other
  misc_feature (423)..(423): n is a, c, t, g, unknown, or other
  misc_feature (453)..(453): n is a, c, t, g, unknown, or other
  misc_feature (454)..(454): n is a, c, t, g, unknown, or other
  misc_feature (488)..(488): n is a, c, t, g, unknown, or other
  misc_feature (568)..(568): n is a, c, t, g, unknown, or other
  misc_feature (578)..(578): n is a, c, t, g, unknown, or other
aagctggagctccccgcggtggcggccgctctagaactagtggatcccccgggctgcaggaattcgcacgagaccattacctagaacatcctaatcgaaaactgctcctctaccccttcctctcccggcgaccagctggcctctcctttgttgaggcgagagacccccacccgatccggcgatggacgccgcgtccaggccgcctccgccccacggagcaggggtccgcgtccgcgccccgctggtggagtctgtctcctgctactgcagattagatacaggccttaaaactgttgttgaggccnaggaagtttgttcctggcgcgaaaatgtgcaggcaacctgaagtcaaacaaaacaagcgcaagtcaaggnnctcaaaaagaggaaaggtgcaggactcaagcaccacttttacctggnccttcctgatgatcttgctattgcctgccnntatacgagttcctcgacttgacagccaaaactcnaggatggtttgcaaaagatggaacccgtctttttgtctgggaattacttttactccttgcgtagaaaaattggagtgcanaaaaaatggntgtatgtctttaaaagggacggtgaaggaaagaaatctggaatggctttgatcactccaccagggtatggaagcc

SEQ ID NO: 23973 - protein, 54 aa, Zea mays
  misc_feature: Ceres CLONE 1394746-F
  misc_feature (42)..(42): Xaa is any aa, unknown, or other
MDAASRPPPPHGAGVRVRAPLVESVSCYCRLDTGLKTVVEAXEVCSWRENVQAT

SEQ ID NO: 23974 - DNA, 631 bp, Zea mays
  misc_feature: Ceres CLONE 1394747-F
  misc_feature: Encodes the peptide sequence at SEQ ID NO. 23975
  misc_feature (251)..(251): n is a, c, t, g, unknown, or other
  misc_feature (284)..(284): n is a, c, t, g, unknown, or other
  misc_feature (534)..(534): n is a, c, t, g, unknown, or other
aagctggagctccccgcggtggcggccgctctagaactagtggatcccccgggctgcaggaattcgcacgagaccattacctagaacatcctaatcaaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccnacaaggagatcttcctccgcgagcttatctccnactcttccgatgcgctggacaagatcaggttcgagagtctcactgacaagagcaagctcgatgcgcagcctgagcttttcatccaccttgtcccagacaaggccacgaacacgctctccatcatcgacagcggcatcggcatgaccaagtccgaccttgtcaacaacctcggtaccatcgccaggtccgggacgaaggagttcatggaagcccttgctgccgggcgctgatgtgtccatgattgcccagntccggcgtcgggttctactctgcctacctcgtcgccgaaagaagtgtcgtggcccaccggcacaacgttgaccaagagtacgtgggggaagtcccac

SEQ ID NO: 23975 - protein, 114 aa, Zea mays
  misc_feature: Ceres CLONE 1394747-F
  misc_feature (28)..(28): Xaa is any aa, unknown, or other
  misc_feature (39)..(39): Xaa is any aa, unknown, or other
MASETETFAFQAEINQLLSLIINTFYSXKEIFLRELISXSSDALDKIRFESLTDKSKLDAQPELFIHLVPDKATNTLSIIDSGIGMTKSDLVNNLGTIARSGTKEFMEALAAGR

SEQ ID NO: 23976 - DNA, 620 bp, Zea mays
  misc_feature: Ceres CLONE 1394749-F
  misc_feature: Translation starting site: 401
  misc_feature: SWISSPROT Homolog: EC 2.7.11.24 Mitogen-activated protein kinase
  misc_feature (435)..(435): n is a, c, t, g, unknown, or other
tggagctccccgcggtggcggccgctctagaactagtggatcccccgggctgcaggaattcgcacgagaccattacctagaacatcctaatcaaaaggaccgcgcctcgctctctcttgtctcgcccgctagctcccatcccagcctcccaccgcgcccgcctgccccaacctcccccctcccctccccgctccgctccgctccacgcacggcgccagatctgctgctgctgcggcggacggtggacgccgcgccgcgcgtgccgcaggcgatgacgtgagcgtcggatcctgcccggtcgtgccatcccggcgacgatgacagcgtaagcgggcgggggacgaccgcgccccccccggccctactcccgaggtcattggcgagtgctccttgacagaaaatgccgatgatgccgcatccccccaatggcatggncagtcaaggaaagcattactatactatgtggcagacactgtttgagatcgacacaagtacgtgtcgatcaagcccatcgggagaggagcttacggaaatcgttgctcatctgctacccgcgagaccaatgaaaaagtcgcgataaaaaagataacaacgtctttgacaccgtgaggatgcgctag

SEQ ID NO: 23977 - DNA, 654 bp, Zea mays
  misc_feature: Ceres CLONE 1394751-F
  misc_feature (251)..(251): n is a, c, t, g, unknown, or other
  misc_feature (253)..(253): n is a, c, t, g, unknown, or other
  misc_feature (254)..(254): n is a, c, t, g, unknown, or other
  misc_feature (255)..(255): n is a, c, t, g, unknown, or other
  misc_feature (259)..(259): n is a, c, t, g, unknown, or other
  misc_feature (260)..(260): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
  misc_feature (270)..(270): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (274)..(274): n is a, c, t, g, unknown, or other
  misc_feature (275)..(275): n is a, c, t, g, unknown, or other
  misc_feature (277)..(277): n is a, c, t, g, unknown, or other
  misc_feature (278)..(278): n is a, c, t, g, unknown, or other
  misc_feature (279)..(279): n is a, c, t, g, unknown, or other
  misc_feature (280)..(280): n is a, c, t, g, unknown, or other
  misc_feature (301)..(301): n is a, c, t, g, unknown, or other
  misc_feature (302)..(302): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (377)..(377): n is a, c, t, g, unknown, or other
  misc_feature (378)..(378): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (404)..(404): n is a, c, t, g, unknown, or other
  misc_feature (406)..(406): n is a, c, t, g, unknown, or other
  misc_feature (407)..(407): n is a, c, t, g, unknown, or other
  misc_feature (432)..(432): n is a, c, t, g, unknown, or other
  misc_feature (442)..(442): n is a, c, t, g, unknown, or other
  misc_feature (444)..(444): n is a, c, t, g, unknown, or other
  misc_feature (445)..(445): n is a, c, t, g, unknown, or other
  misc_feature (455)..(455): n is a, c, t, g, unknown, or other
  misc_feature (474)..(474): n is a, c, t, g, unknown, or other
  misc_feature (489)..(489): n is a, c, t, g, unknown, or other
  misc_feature (566)..(566): n is a, c, t, g, unknown, or other
  misc_feature (588)..(588): n is a, c, t, g, unknown, or other
  misc_feature (589)..(589): n is a, c, t, g, unknown, or other
  misc_feature (602)..(602): n is a, c, t, g, unknown, or other
  misc_feature (603)..(603): n is a, c, t, g, unknown, or other
  misc_feature (621)..(621): n is a, c, t, g, unknown, or other
  misc_feature (631)..(631): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (654)..(654): n is a, c, t, g, unknown, or other
caagctggagctcaccgcggtggcggccgctctagaactagtggatcccccgggctgcaggaattcgcacgagaccattacctagaacatcctaatcgaaaaatcctggccacacccacacagcaagccagcagagcagaaagcagccgcagccccagcccccacaagacgaggcaacaatggcgctagaagcagccaccgccccccgcgcactcctcgccgcgtgcctcgtcctgctggtcctcggcggngnnnccgnnccgnnnnnnnnnnnncnnnnccccccccccccccccccccnncccccccccccccccccccccccccccccccccccccccccccccccccccccnnnccccccnnncccccccccnnccnnnccccnnnnnnnnnnnnnnccncnnccccccccccccccccccccccccncccccccccncnncccccccccnccccccccccccccccccnccccccccccccccnccccccccccccccccccccccccccccccccccccccccccccccccccccccccccccccccccccccccccccncccccccccccccccccccccnnccccccccccccnncccccccccccccccccncccccccccncnnnccccccccccccccccccn

SEQ ID NO: 23978 - DNA, 646 bp, Zea mays
  misc_feature: Ceres CLONE 1394754-F
  misc_feature: Encodes the peptide sequence at SEQ ID NO. 23979
  misc_feature (338)..(338): n is a, c, t, g, unknown, or other
  misc_feature (340)..(340): n is a, c, t, g, unknown, or other
  misc_feature (350)..(350): n is a, c, t, g, unknown, or other
  misc_feature (462)..(462): n is a, c, t, g, unknown, or other
  misc_feature (469)..(469): n is a, c, t, g, unknown, or other
aagctggagctccccgcggtggcggccgctctagaactagtggatcccccgggctgcaggaattcgcacgagaccattacctagaacatcctaatcgataaatccaatacccccacgaacccactctctctccccacgatggcaaaaatggcgatggcgtcctcccgcctcccggctctcctctgcctcgccgccgtcgccgtcgccgtcgcggcggaggccgccgccgccgccggagaaggcggcctccgcctgccccgcgacgccacgttcccggcggcgcaggcggagcggctcatccgcgcgctcaacctcctgcctaaggagaaaggagcggngncggccgcggncggtggcgacgggcccagcgtggcgcccggggagctcctagagcgtcgcgtccgggtgcccggcgcgcccggcggggtcggggaccctcggccacacgccggatacttccgncctgcgnacacgcacgaagccaggaatgttctacttcttcttcgaatcgaggggcaaagaagaggggagacgacccccgtcgtgatctgggtcaacggaggggaccggctgcaagaccggagctggcccgtcttctaacaagaatgggcccctttcacctttgacaacaaccatggtcgcctga

SEQ ID NO: 23979 - protein, 153 aa, Zea mays
  misc_feature: Ceres CLONE 1394754-F
  misc_feature: SWISSPROT Homolog: EC 3.4.16.5 Carboxypeptidase C
  misc_feature (67)..(67): Xaa is any aa, unknown, or other
  misc_feature (68)..(68): Xaa is any aa, unknown, or other
  misc_feature (71)..(71): Xaa is any aa, unknown, or other
  misc_feature (111)..(111): Xaa is any aa, unknown, or other
MAKMAMASSRLPALLCLAAVAVAVAAEAAAAAGEGGLRLPRDATFPAAQAERLIRALNLLPKEKGAXXAAXGGDGPSVAPGELLERRVRVPGAPGGVGDPRPHAGYFRPAXTHEARNVLLLLRIEGQRRGETTPVVIWVNGGDRLQDRSWPVF

SEQ ID NO: 23980 - DNA, 699 bp, Zea mays
  misc_feature: Ceres CLONE 1394755-F
  misc_feature (17)..(17): n is a, c, t, g, unknown, or other
  misc_feature (24)..(24): n is a, c, t, g, unknown, or other
  misc_feature (165)..(165): n is a, c, t, g, unknown, or other
  misc_feature (182)..(182): n is a, c, t, g, unknown, or other
ccccgctggagctcccngcggtgncggccgctctagaactagtggatcccccgggctgcaggaattcgcacgagaccattacctagaacatcctaatcgaaaaacgggtcaccagtcaccacatccctccctccctgccatttgtttggttgttcctctcgcagnctcgctcgccaccaggnaggaggcatcccaatctcgcgagagtcagtagcggcgtccgccgcctcgctgagggtcgccccccacccacccacgggggcacccgacagtacgaaccccacccactctcgaggcgcgtggggcttaccatgccccaccctgacccagatatatatgagatccccaacattacaccaccagtagactcacccccccaccgcggcggggggcgggggtgctgatgccttaacattctgtgcagaagcacccttgctgaagggtagatagaatacatcggtaaccctcgccaccgaacttactagacccccccccgcacgacaagttcgcgtgtattccgcgacccggaattcttactgcccgcactacccgcctatcacagcaccacggacataatgggccgcgacacgagccgccgttacatgcgcgcggccaatcgagattgaggagtgaacagccagacaacgcgaaagaataaccagatgacgaatcgagcggagagacaatagcacaatatag

SEQ ID NO: 23981 - DNA, 706 bp, Zea mays
  misc_feature: Ceres CLONE 1394759-F
  misc_feature: Translation starting site: 507
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (21)..(21): n is a, c, t, g, unknown, or other
  misc_feature (26)..(26): n is a, c, t, g, unknown, or other
  misc_feature (36)..(36): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (415)..(415): n is a, c, t, g, unknown, or other
  misc_feature (416)..(416): n is a, c, t, g, unknown, or other
  misc_feature (706)..(706): n is a, c, t, g, unknown, or other
ggggnnnnnnnnnnnnngggnggggncggcgggggngggggggnnnnnngggnnnnggggnnnnnnnnnnnnnnnnnnnnnnaaaaaactggagctccccgcggtggcggccgctctagaactagtggatcccccgggctgcaggaattcgcacgagaccattacctagaacatcctaatcgaaaaaggatgacaaaatttcccactccactcgaattaaaaccctagcggcaaaaccttcgctctgcgccgccgtcgcctgctcccgtcccgccaccacatccgcccaggagctcgccgtcggggaggctgctcgaggagccgcgctgtctctcccgcgccgcgaccttcgccctcgccgccgccatggatctgcgcgatctccggtgaggtgccggacgagccggtggtgtcnnaagaagtcggggcttctcttcgagcggcggctcatcgagcgctacattgaggaccatggcaagtgccccatcaccaaggatgagcttactatggatgatatcgtgccggtcaataccaacaaggtcgtgaagcccagggcctttgcaggctgcaagcattccaggactcccttggggatttttcagaacggagtgggatgctctcatgctttctaattttgctttggagcagcagctacacaccgcaagaccagaaacttagtcatgcactctaccagcatgaggctggn

SEQ ID NO: 23982 - DNA, 631 bp, Zea mays
  misc_feature: Ceres CLONE 1394763-F
  misc_feature (274)..(274): n is a, c, t, g, unknown, or other
  misc_feature (277)..(277): n is a, c, t, g, unknown, or other
  misc_feature (278)..(278): n is a, c, t, g, unknown, or other
  misc_feature (289)..(289): n is a, c, t, g, unknown, or other
  misc_feature (292)..(292): n is a, c, t, g, unknown, or other
  misc_feature (342)..(342): n is a, c, t, g, unknown, or other
  misc_feature (345)..(345): n is a, c, t, g, unknown, or other
aaagctggagctccccgcggtggcggccgctctagaactagtggatcccccgggctgcaggaattcgcacgagaccattacctagaacatcctaatcaaaaggcccgcgcctcgctctctcttgtctcgcccgctagctcccatcccagcctcccaccgcgcccgcctgccccaacctcccccctcccctccctgctccgctccgctccacgcacggcgccagatctgctgctgctgcggcggccggtggacgccgcgccgcgcgtgccggcgncgnngacgtgagcgncgnatcctgcccggccgtgccatcccggcgacgatgacagcgtaagcgggcgncgnacgaccgcccccccccggcccctactcccgaggggatggggggggggctccttggcacacaaaggcgatgaccgcggcacccccccatggggggggccccgtcagggaaaacccttaacaaacttaagggggcaaaaacctgcttggaaatcccaccccacgccccccggggtattaacgccccccgtcaaaaccacattacggaaatctcctcggtccgccgcgcaaacccccacacccacccgaaaaagtcccccactaaaatgactaacacccgccctcttcc

SEQ ID NO: 23983 - DNA, 670 bp, Zea mays
  misc_feature: Ceres CLONE 1394767-F
  misc_feature (215)..(215): n is a, c, t, g, unknown, or other
  misc_feature (222)..(222): n is a, c, t, g, unknown, or other
  misc_feature (232)..(232): n is a, c, t, g, unknown, or other
  misc_feature (500)..(500): n is a, c, t, g, unknown, or other
  misc_feature (670)..(670): n is a, c, t, g, unknown, or other
caagctggagctcaccgcggtggcggccgctctagactagtggatcccccgggctgcaggaattcgcacgagaccattacctagaacatcctaatcgaaaaaaaaaaacgcacggggagcttggagacttcacgacaaatcgacgatcgccgcttctcttggccattgtagagggagagagagagcgcgagcgacctaggtcagtcggtttcggntttgggngtcgcttccnctttccccggccgcgtctttgggtctggcggtgccccgccctggcggttcctctggtcgtcaggtcctcgcctttttgtgtgccgcgccggctgggtttccgccctccgccccccgtcgcccccttctcccccttccccccccccctctctggggcgtctgctttccccctcttgcgccgtcgtctcccgtcctggccgccccccctctcttctccccccccctctggctttctctccgccgcttgggggcccccccccccccccccnctcctctctgtctcgcccgcggtgtctcccgcgccccgcccccccccgttttccgccctctatcctccccctgacgctccccgccatctttatcccctcccccccacatcgagcgtatccgtccctcgcctccatgtccccctctccctttgcttctcccccctccgtcn

SEQ ID NO: 23984 - DNA, 618 bp, Zea mays
  misc_feature: Ceres CLONE 1394768-F
  misc_feature (19)..(19): n is a, c, t, g, unknown, or other
  misc_feature (22)..(22): n is a, c, t, g, unknown, or other
  misc_feature (46)..(46): n is a, c, t, g, unknown, or other
  misc_feature (618)..(618): n is a, c, t, g, unknown, or other
aagctggagctcaccgcgntgncggccgctctagaactagtggatnccccgggctgcaggtattcgcacgagaccattacctagaacatcctaatcgaaaaataagctctgctaggtcgtcgatcgcatgtgcatgtgtactttttaacttgttcgatcgatcatcatctccatccaccgcccgccgtagctagctagatctgctgccatggcttcctttggcgaggctcccggcggtgcactcggctcggcccacagcatcttcttacctggtgggcgctccatcatcccgtgtccctcgggccctccccctggtggctcccccgcctcctgcacccaaccgccccccttggttccctggggaccgcccccccccccgatcccttccccaaccaaacctcccctagctaccccccccccccaccccctaatattccctaacggccttttcaccctacctccagcccgtctctctctgcctgccccctccccatcgtaccccccccctgccccccctcccggcccccctctccgccccccacccctacactccttccacccccccccaccccctgtcctccccacccctcctccaacccttcctcccacccacctacn

SEQ ID NO: 23985 - DNA, 632 bp, Zea mays
  misc_feature: Ceres CLONE 1394775-F
  misc_feature (305)..(305): n is a, c, t, g, unknown, or other
  misc_feature (467)..(467): n is a, c, t, g, unknown, or other
  misc_feature (514)..(514): n is a, c, t, g, unknown, or other
  misc_feature (544)..(544): n is a, c, t, g, unknown, or other
  misc_feature (545)..(545): n is a, c, t, g, unknown, or other
  misc_feature (551)..(551): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
aagctggagctccccgcggtggcggccgctctagaactagtggatcccccgggctgcaggaattcgcacgagaccattacctagaacatcctaatcgaaaaaccacggaagaagccactagctctccgctctcgcctctcggccttctccttgtgccgccgaacaccctcacaagagtcggcctctcgatttcttagtccagccgcagcagcccccttccctccctcctccatcaggtgttgcctcccgcagatcccagtcggaattcggtccttcgtccccaaaccaccaatccggttgcattnctttgggtttgctcacagcgcacacaaagccattttactgctgggaaatggtggctggcacttagcgtctccggctcttgagtgatctccaagtcctttggaagctacagggaagtgaagtgaatgggggagtgcgaggacggcaggaatacaggtgctggnaggagctgctgcgggacgcgctgggcctcatcttccgcaactggcgntgcaggaggtgctcacggcccctgccgggnntggcantccctggnnnccggttggtggcccgcccctacttgttgcaggagatcaacatccaagaagggaccagcaggagaggggggg

SEQ ID NO: 23986 - DNA, 645 bp, Zea mays
  misc_feature: Ceres CLONE 1394776-F
  misc_feature: Encodes the peptide sequence at SEQ ID NO. 23987
  misc_feature (339)..(339): n is a, c, t, g, unknown, or other
  misc_feature (342)..(342): n is a, c, t, g, unknown, or other
  misc_feature (400)..(400): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (468)..(468): n is a, c, t, g, unknown, or other
  misc_feature (469)..(469): n is a, c, t, g, unknown, or other
  misc_feature (570)..(570): n is a, c, t, g, unknown, or other
  misc_feature (571)..(571): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (591)..(591): n is a, c, t, g, unknown, or other
  misc_feature (592)..(592): n is a, c, t, g, unknown, or other
aagctggagctccccgcggtggcggccgctctagaactagtggatcccccgggctgcaggaattcgcacgagaccattacctagaacatcctaatcaaaaaaatccccatcaaacccccggacatttctggtcgcaccctcctccggccctcccagccgctaagccctctggaaccttcgagagctcgatcggatcggagcccctgccatggccgacgaggcgaaggcgaagggtaatgcggcgttctcagccggccgcttcgaggaggcggcgcggcacttcacggacgccatcgcgctcgccccgggcaaccacgtcctctactccaaccggtcggnggngctcgcctcactccaccgctactccgacgctctcgccgacgcgcagaagacgtcgagnctcaagcctgactgggccaagggctactcccgcctcgggcggaccnnngnnnntcccgggggaacccnncaagggccgtcgccgaaaacgaagaagggccttgcgctcgaccccagcacgaaggtctcaaaggcgggggctcgaggaacgcaagaaaggcgcgccgcccnncccgggggggggggnnnntnnggcccccaagctttgggcaggatgtcccgggcccccgaactggggagcaagag

SEQ ID NO: 23987 - protein, 145 aa, Zea mays
  misc_feature: Ceres CLONE 1394776-F
  misc_feature (2)..(35): Pfam Name: TPR_2 Pfam Description: Tetratricopeptide repeat
  misc_feature: SWISSPROT Homolog: EC 3.1.3.16 Phosphoprotein phosphatase
  misc_feature (44)..(44): Xaa is any aa, unknown, or other
  misc_feature (45)..(45): Xaa is any aa, unknown, or other
  misc_feature (64)..(64): Xaa is any aa, unknown, or other
  misc_feature (80)..(80): Xaa is any aa, unknown, or other
  misc_feature (81)..(81): Xaa is any aa, unknown, or other
  misc_feature (82)..(82): Xaa is any aa, unknown, or other
  misc_feature (87)..(87): Xaa is any aa, unknown, or other
  misc_feature (121)..(121): Xaa is any aa, unknown, or other
  misc_feature (127)..(127): Xaa is any aa, unknown, or other
  misc_feature (128)..(128): Xaa is any aa, unknown, or other
MADEAKAKGNAAFSAGRFEEAARHFTDAIALAPGNHVLYSNRSXXLASLHRYSDALADAQKTSXLKPDWAKGYSRLGRTXXXPGGTXQGPSPKTKKGLALDPSTKVSKAGARGTQERRAAXPGGGGXXGPQALGRMSRAPELGSK

SEQ ID NO: 23988 - DNA, 682 bp, Zea mays
  misc_feature: Ceres CLONE 1394777-F
  misc_feature: Encodes the peptide sequence at SEQ ID NO. 23989
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (483)..(483): n is a, c, t, g, unknown, or other
  misc_feature (485)..(485): n is a, c, t, g, unknown, or other
  misc_feature (488)..(488): n is a, c, t, g, unknown, or other
  misc_feature (489)..(489): n is a, c, t, g, unknown, or other
  misc_feature (491)..(491): n is a, c, t, g, unknown, or other
  misc_feature (492)..(492): n is a, c, t, g, unknown, or other
  misc_feature (494)..(494): n is a, c, t, g, unknown, or other
aagctggagctccccgcggtggcggccgctctagaactagtggatcccccgggctgcaggaattcgcacgagaccattacctagaacatcctaatcgaaaaatctcctttctctctctacacatactcagacgagcagaagcagctagggacaccataggcaaactacttcagcaagaaattaaactatctcctacgcaagatcagaagaaactgtgtatggagcaagaagaggttggcctcgccctgggcctctccctcggctccggccaccaccaccaggagctcaagccccaacatccgtcgcatccgtgtgcggcgttgttggagccttctctgtcgctcagcggcccggcgaccaaggatgatggcccgaccgcaccggtgaggaggttcgctgccgtgaagagggagctgcagacgatggaggggaacgacgacgaggccaccggcagggattgcactcacnnngggggggggccgncnggnngnngnttactggcggacgaacgacgaagggttgcaacagcagccggaaagaagcctgaggctggcccaagggagcagtcggcgcgctggctggagggaccacttttcaaggagcacaggcacccctcaaaccctaaagaaggaagggctggctttggcccaagaccaactggaaccctgagccccaagggcca

SEQ ID NO: 23989 - protein, 154 aa, Zea mays
  misc_feature: Ceres CLONE 1394777-F
  misc_feature (84)..(84): Xaa is any aa, unknown, or other
  misc_feature (89)..(89): Xaa is any aa, unknown, or other
  misc_feature (91)..(91): Xaa is any aa, unknown, or other
  misc_feature (92)..(92): Xaa is any aa, unknown, or other
MEQEEVGLALGLSLGSGHHHQELKPQHPSHPCAALLEPSLSLSGPATKDDGPTAPVRRFAAVKRELQTMEGNDDEATGRDCTHXGGGPXGXXLLADERRRVATAAGKKPEAGPREQSARWLEGPLFKEHRHPSNPKEGRAGFGPRPTGTLSPKG

SEQ ID NO: 23990 - DNA, 575 bp, Zea mays
  misc_feature: Ceres CLONE 1394778-F
  misc_feature: Encodes the peptide sequence at SEQ ID NO. 23991
  misc_feature (316)..(316): n is a, c, t, g, unknown, or other
  misc_feature (362)..(362): n is a, c, t, g, unknown, or other
  misc_feature (466)..(466): n is a, c, t, g, unknown, or other
  misc_feature (487)..(487): n is a, c, t, g, unknown, or other
aaagtggagctccccgcggtggcggccgctctagaactagtggatcccccgggctgcaggaattcgcacgagaccattacctagaacatcctaatcgaaaaaatttccagacggcagtccactggtttttgcttgcatatcctttgtttaggccagagttgagttgtgttccaacttccaagtcttgggttgcggaatcgccggcctcgctcaatcgatggaaaaccataatccattacattctcagattgctgaagtgaaaatggacatctcagcatcagcttctgttgcatcaggaaacaaattctgcaagggntgtgcctgtgatttctctgattccagtaactcctcgaaagatgccnaggagagatccacgtccatgaggaagctttatatcgcagtgatcctttgcatcatattcatgaccgggtggaaggtgggtcgggggcatcaaaaggcaacaggncttgcccatcttagctgatgncgcgcaccttccttttctgatgggggcagattttgcccatatcggtattcctctctctgggcctggtggggatgggaaacacccccgg

SEQ ID NO: 23991 - protein, 88 aa, Zea mays
  misc_feature: Ceres CLONE 1394778-F
  misc_feature (49)..(49): Xaa is any aa, unknown, or other
MENHNPLHSQIAEVKMDISASASVASGNKFCKGCACDFSDSSNSSKDAXERSTSMRKLYIAVILCIIFMTGWKVGRGHQKATGLAHLS

SEQ ID NO: 23992 - DNA, 629 bp, Zea mays
  misc_feature: Ceres CLONE 1394779-F
  misc_feature: Encodes the peptide sequence at SEQ ID NO. 23993
  misc_feature (318)..(318): n is a, c, t, g, unknown, or other
  misc_feature (395)..(395): n is a, c, t, g, unknown, or other
tggagctccccgcggtggcggccgctctagaactagtggatcccccgggctgcaggaattcgcacgagaccattacctagaacatcctaatcaaaaaatctgccatcttcgtctatccctttcatctcagttttgcagtttctactgctgtcttcgctccgaaatccaaccgaaatctcagaggaaagtaggaaacctcgttcgggaacctgctttgagtgagactccaatccttgggcgccattgccgcctgttttttgtgctcggaaaggcgctgtctgattcctgtatatttattttggcaatgctttcagctgncacaaaactaaccatggatggcactagctttgacctgacagaggacgaaggttcaaatttggctccttttctactcnaacttttaatgagtgggatgatcgcaagacaagggggctggtttcaccatgacatcaagtcctgtggaacaaaggtgctacctgggagtacataattttgtgggaacattaattggagggacgggcccaaaagaggggcccactgggttcacaaggaaccaggttttccagcccttttgtaaggggaaagtccaatttacaaaaagtcccccccgttgggaggggatttttaaa

SEQ ID NO: 23993 - protein, 52 aa, Zea mays
  misc_feature: Ceres CLONE 1394779-F
  misc_feature (22)..(22): Xaa is any aa, unknown, or other
MDGTSFDLTEDEGSNLAPFLLXLLMSGMIARQGGWFHHDIKSCGTKVLPGST

SEQ ID NO: 23994 - DNA, 653 bp, Zea mays
  misc_feature: Ceres CLONE 1394787-F
  misc_feature: Encodes the peptide sequence at SEQ ID NO. 23995
  misc_feature (351)..(351): n is a, c, t, g, unknown, or other
  misc_feature (481)..(481): n is a, c, t, g, unknown, or other
  misc_feature (503)..(503): n is a, c, t, g, unknown, or other
  misc_feature (561)..(561): n is a, c, t, g, unknown, or other
  misc_feature (567)..(567): n is a, c, t, g, unknown, or other
aagctggagctccccgcggtggcggccgctctattatagtggatcccccgggctgcaggaattcgcacgagaccattacctagaacatcctaatcgaaaaatctatcccattctaagacgtagatcaagcatcggcgacaggacctctgcgtatggtgatgacttgtggtacctacgtcgctctgatagcctaccatggctgatctcccgcagagagagtatcgacgtcccgcaggatacggtgacctccatagctggggggtcttagccggcgaggggcagcagctccaaaaggagggcgccatgatgtgagcggtcaaggacgagacgggcgcgaccttctgcggttcnatgatggtgctgtccggtctgatcctgtccggcaccgagatctcgctcacgatggtcacccccgggcgggagaacttcaaccctgtgctggggacggtcagcattacgttgatgttcatggcagccgggntccgaacctccttggagcttcnggggcatctttgcatgcccggagtaaaaccagcaattaaaaaccccaatggcgcggtnaggggncccgcctccaaacccggaccaacccgaaccccccccccccgtaataaggttttttcctttcaatttgccccaaaacaataacaaaa

SEQ ID NO: 23995 - protein, 97 aa, Zea mays
  misc_feature: Ceres CLONE 1394787-F
  misc_feature (43)..(43): Xaa is any aa, unknown, or other
  misc_feature (50)..(50): Xaa is any aa, unknown, or other
MVLSGLILSGTEISLTMVTPGRENFNPVLGTVSITLMFMAAGXRTSLELXGHLCMPGVKPAIKNPNGAVRGPASKPGPTRTPPPRNKVFSFQFAPKQ

SEQ ID NO: 23996 - DNA, 633 bp, Zea mays
  misc_feature: Ceres CLONE 1394790-F
  misc_feature: SWISSPROT Homolog: EC 1.11.1.15 Peroxiredoxin
aagctggagctccccgcggtggcggccgctctagaactagtggatcccccgggctgcaggaattcgcacgagaccattacctagaacatcctaatcgaaaaagcagtcccatagtccaggaagcccgtgcccgacctgcaacgtacgccaccatgtcggggttcaccatacgcgacaccgtcacccacctggatttgggctccgcccacctttagtatcccaataccactaactacgacggagactttgacgctatcatcttctctcacgcagccgacttatcgcccgtgggcaatacggaaatggcgggaatgacgacatcacgcctcagtctgtctatacagcgtgcacatgaatatgctgtgcatctcgtgccacgacgatgcaagttgatggccacatgtgcctaggacgcggaacgcatagcttggtgaagcagattcacatgatcatacgacgataaaagtgatgttcccgtatgtgttcgtaccggctcgggacgccatcccgctgatgaacatggtggacctctacgacaaggacacgccggttctgattatgccgtcccgagcgatcctagtccttatgcccgactaggtcgttaagctgctatgcctgctgcccagcatcctg

SEQ ID NO: 23997 - DNA, 632 bp, Zea mays
  misc_feature: Ceres CLONE 1394794-F
  misc_feature: Translation starting site: 223
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (355)..(355): n is a, c, t, g, unknown, or other
  misc_feature (357)..(357): n is a, c, t, g, unknown, or other
  misc_feature (358)..(358): n is a, c, t, g, unknown, or other
aaagctggagctccccgcggtggcggccgctctagaactagtggatcccccgggctgcaggaattcgcacgagaccattacctagaacatcctaatcgaaaactcctccgcacaaacgcgtcgcatccgctccacaggatcctctgcgccaccgcaaccgtgtgaccgcccgtgccgccggcgatcccgatccgccgacccgtcccagccccgctcgcagccatgtcgccgtcggagccgacgcgggaggagagcgtgtacatggccaagcttgcggagcaggcggagcggtacgaggagatggtcgagttcatggagcgcgtccgcgctacccccggggggggccggnnnnntngnntactgatctatccgctggagtaacgcaacctgcttgtccctttgactacaagaaggtcaatccgggcccacgagctctcaagactgtatcatctccctgattacaaaaaataccacaacgccacccgtaacagggtctcaaatacatgcatcagaagcgtaacatgcctgagaatgaacttgaccgccgcgttccagcagtggataagcaagtctctgcccacgccatctcggctgttcagatagcacccgtcgtggcacgtgccttcgcctcc

SEQ ID NO: 23998 - DNA, 645 bp, Zea mays
  misc_feature: Ceres CLONE 1394796-F
tggagctccccgcggtggcggccgctctagaactagtggatcccccgggctgcaggaattcgcacgagaccattacctagaacatcctaatcgaaaaatctatctccctttcgactctcgaggtcccgatcctcctataccggttacactacgtatcgcgcggagcagcccgtttctacaactcccgagcgcctcggctcatgtcctgctgctccgcatgaggagcccagtcgacttggattacattggcctctagccggtgtcgctctgtctctatgactcacgatcacgtgaaggcgaccaactcgccagcttgatcagccgcgagctgatgcgccgtgtagccgagttgtgatttgcaccgcaagcatactgaagctgctcggcggtagaagcccgagagaggttcatctaatgaggcgccgacgaggtcggcctgtgtgtgttccagaaaggcgaatacgtcaacggatccggaggcgcgcacgtggactgcagcgtggacatcgccgagctcgaaggatcctgcggcgtcatagccatgaatcagaaagtactcggaccacgccatgtcgacggcccacctgaagcacaacaaggtggatgctgaggcctgccaggaccagcgggacgtgcgcatggaga

SEQ ID NO: 23999 - DNA, 644 bp, Zea mays
  misc_feature: Ceres CLONE 1394797-F
  misc_feature: Encodes the peptide sequence at SEQ ID NO. 24000
aaagctggagctccccgcggtggcggccgctctagaactagtggatcccccgggctgcaggaattcgcacgagaccattacctagaacatcctaatcgaaaaatctattttacgggcggataaagacgggcggtaaatcctagtcccatccaatcccgtcacgttcggcgaaacccgggttataaaaccggagcacctcgccccccctctaccaccaccgcagccgcagcacaatcgcctcgccttcccttccccaccagcccgtctctctcttctctctgactctctctctcgtagccgcgtccacctcgcagcagcaagcaagcgcgaccaaatggcgcctctaggagacggcggagctgctgccgcggcggcgtccaacaacctggtggtgtcgttcggcgagatgctgatcgacttcgtccccgacgtggccgggctgtcgctggccgagtcgggcggcttcgtcaaggcacccggcggcgcgcccgccaacgtcgcctgcgccatcgccaagctcggcggatcctccgccttcgtaggcaagttcggcgacgacgagttcgggcacatgctggtgaacatcctgaagcagaacaacgtgaacgcggaggggtgcctgttcgacaagcacgcgcggacgg

SEQ ID NO: 24000 - protein, 103 aa, Zea mays
  misc_feature: Ceres CLONE 1394797-F
  misc_feature: SWISSPROT Homolog: EC 2.7.1.4 Fructokinase
MAPLGDGGAAAAAASNNLVVSFGEMLIDFVPDVAGLSLAESGGFVKAPGGAPANVACAIAKLGGSSAFVGKFGDDEFGHMLVNILKQNNVNAEGCLFDKHART

SEQ ID NO: 24001 - DNA, 642 bp, Zea mays
  misc_feature: Ceres CLONE 1394812-F
  misc_feature: Encodes the peptide sequence at SEQ ID NO. 24002
aagctggagctccccgcggtggcggccgctctagatactagtggatcccccgggctgcaggaattcgcacgagaccattacctagaacatcctaaacaaaaacagcattcattcagctagcgagcgagagagaggggaacaaaaaggaagggcgaggaggacagggagccgagcgcaagagctgaggcttcgccgcgaaaccccagacctcgcgccgccccttcccctccgcggcgtcgtcctcgcacgctctccgatccaagatgtataagctggggagaggaaaccgcgacaaggcgcagcagttcatgaccattaccggggccagtgagaaggttgcccttcaggcactgaaagctagtgattggcacttggaaggagcttgtgacttcttctatagccaacctcaggtctctgtggacaatactcggcatcttgaagatattttcaacagatataaagaacctgatgctgatatgataatgctggaacgaatatctcaattttgcaatgatctgcaggttggatcctcagatattgccatgcttgtcatatcatggcacattgaagccgccacaatgtgtgaaattactcgtcagggattcattggcgggactgcaaccaattggggtagaatcaacc

SEQ ID NO: 24002 - protein, 126 aa, Zea mays
  misc_feature: Ceres CLONE 1394812-F
MYKLGRGNRDKAQQFMTITGASEKVALQALKASDWHLEGACDFFYSQPQVSVDNTRHLEDIFNRYKEPDADMIMLERISQFCNDLQVGSSDIAMLVISWHIEAATMCEITRQGFIGGTATNWGRIN

SEQ ID NO: 24003 - DNA, 626 bp, Zea mays
  misc_feature: Ceres CLONE 1394813-F
  misc_feature: Encodes the peptide sequence at SEQ ID NO. 24004
aagctggagctccccgcggtggcggccgctctagaactagtggatcccccgggctgcaggaattcgcacgagaccattacctagaacatcctaatcgaaaaacccccacgccccaccccaccaaacaatggcgccggcggcgacttccacagcctctgcgccctcctccttccactccactggtaggcatagggccagggtcggggcccggccatcgctcgtctctctccgcgtcagagcagccaatcccaacgttaccgccgatcccgcaccggacttccagtccgtcacggccttcgcgccagccaccgtcgccaacctcggcccgggcttcgacttcctcggatgcgccgtcgccgacgcctccctctccctgggtgacaccgtcaccgcaaccctggacccgtcactcccgcccgacaccgtctccatcgcctccatcacatccacgtcccgccccaacctcgccgagcgcctctctagggacccgctccgagactgcgcgggcgtcgccgccatcgccgcgctccgcgacctcggcgtacgctcccacgccgtgtccatccacctcacccagggcctgccgctcgggtcggggctcgggtcctccgcggcctccgccgccg

SEQ ID NO: 24004 - protein, 166 aa, Zea mays
  misc_feature: Ceres CLONE 1394813-F
  misc_feature: SWISSPROT Homolog: EC 2.7.1.39 Homoserine kinase
MAPAATSTASAPSSFHSTGRHRARVGARPSLVSLRVRAANPNVTADPAPDFQSVTAFAPATVANLGPGFDFLGCAVADASLSLGDTVTATLDPSLPPDTVSIASITSTSRPNLAERLSRDPLRDCAGVAAIAALRDLGVRSHAVSIHLTQGLPLGSGLGSSAASAA

SEQ ID NO: 24005 - DNA, 615 bp, Zea mays
  misc_feature: Ceres CLONE 1394817-F
  misc_feature: Encodes the peptide sequence at SEQ ID NO. 24006
aagctggagctccccgcggtggcggccgctctagaactagtggatcccccgggctgcaggaattcgcacgagaccattacctagaacatcctaatcgaaaaatcggtttcctcctcctcctcctctcccctcacgattccttctctctcccgctaaatggatggacacgctactgcgccggatttctccccagccggttccttcggtcacgcgaccgcgcgctcggaaaactccatggacagcgaaggaggcgaaccaagggcgacgtattccccgccggagaaggtaagtgtcgatccgccgtgacccgcgattcgtttgtcttgctccgagcggcgaacagcagtgggggtcgtcctcgcggatccgtcttcaagctttcgcggatccgccttcaagcttcgcggatcccacacgaaacctccgagttctctcgacaattcgatccgtctcaccgccgtcgaccgtccgccggtcggtcttgactgctccgtcgcacgtgggggttcgcagcacggaatctaccttgtgttgacagatccggggaaacccttgttcccggtcgttccggctcgaatcttctgcggactggcaatgtaagcgttctccattgga

SEQ ID NO: 24006 - protein, 49 aa, Zea mays
  misc_feature: Ceres CLONE 1394817-F
MDGHATAPDFSPAGSFGHATARSENSMDSEGGEPRATYSPPEKVSVDPP

SEQ ID NO: 24007 - DNA, 635 bp, Zea mays
  misc_feature: Ceres CLONE 1394818-F
  misc_feature: Encodes the peptide sequence at SEQ ID NO. 24008
  misc_feature (635)..(635): n is a, c, t, g, unknown, or other
aagctggagctccccgcggtggcggccgctctagaactagtggatcccccgggctgcaggaattcgcacgagaccattacctagaacatcctaatcgaaaacttttcctagggcttcgtcgattccagccgccgccgcgtccgcctcgacaagagcaacacccaccacagaacctcgctctctttctctcacgccatggcgactgggtctcaacaacaggaaaccctcaagctcttcaaccggtggacgttcaatgatgtctagtggaacgacatctcgatgaacgactacctctctgcgaacgcgacgaaacacgccatgtacctggcgtagaccgcggggggctactcctacaactgcctcctcaaggaccacggcccgatctgtgagcaccttacaatctccctcatgatgcacgagcagcacaactttaagaacgccatggttgtccgcataatcaagcatacactgcagatcattcacctgctcaccgatgccgacgccatccaggtctgcgtcgacactatcatcaacagtgacccccgtgcagatgccacccgtattgcatccgctgacgttgagagaagacagtgcgagcatatctcaccctgacgatggtgactcaggcatctacn

SEQ ID NO: 24008 - protein, 67 aa, Zea mays
  misc_feature: Ceres CLONE 1394818-F
MMHEQHNFKNAMVVRIIKHTLQIIHLLTDADAIQVCVDTIINSDPRADATRIASADVERRQCEHISP

SEQ ID NO: 24009 - DNA, 641 bp, Zea mays
  misc_feature: Ceres CLONE 1394820-F
  misc_feature: Encodes the peptide sequence at SEQ ID NO. 24010
tggagctccccgcggtggcggccgctctagaactagtggatcccccgggctgcaggaattcgcacgagaccattacctagaacatcctaatcgaaaaatttcacctaatacccagtaaatggacgctgtcgtggtgcggcagctggcgcgatcccaccctgccccctggcggtggaatcctccccgttcgccgcggcctctggggatcactcgcagtgcccggagatctcatcgccgacggctgtccgagtgtgagtcgcggcgaccagcctcaacttctgcacgtatcctccaggcggatgtaaagcaccaggagcggtccccgcttccgttcgtgcctgtatccaactactctggggagcgcaaatcagaccctcccggagtgcgtgggctccggcccggcgaccgcggatgctcctttaccggcctcgggtcctacgatgacttcatcgtcgacgaggataagcagctatttttggtgcctgatggatgcgacctgttcacagctggagctataccaggagcatttggcacatcacgtatgctccttgatcaccgactccaattgaatgctggccaggtgctacttgttcttgccgctgctaatggcgtcccagcatctgctgagagaataacacaaa

SEQ ID NO: 24010 - protein, 174 aa, Zea mays
  misc_feature: Ceres CLONE 1394820-F
  misc_feature: SWISSPROT Homolog: EC 1.6.5.5 NADPH:quinone reductase
MDAVVVRQLARSHPAPWRWNPPRSPRPLGITRSARRSHRRRLSECESRRPASTSARILQADVKHQERSPLPFVPVSNYSGERKSDPPGVRGLRPGDRGCSFTGLGSYDDFIVDEDKQLFLVPDGCDLFTAGAIPGAFGTSRMLLDHRLQLNAGQVLLVLAAANGVPASAERITQ

SEQ ID NO: 24011 - DNA, 636 bp, Zea mays
  misc_feature: Ceres CLONE 1394822-F
  misc_feature: Encodes the peptide sequence at SEQ ID NO. 24012
  misc_feature (591)..(591): n is a, c, t, g, unknown, or other
aagctggagctccccgcggtggcggccgctctagaactagtggatcccccgggctgcaggaattcgcacgagaccattacctagaacatcctaatcgaaaaattgatccctgaaacccatccacaattggtagctcgttgatccaaatccaagacctcacgtcaacgcactgtctcgcctgttaattagtcgtcgacgtcgtcgtctatgtccaggctgatggctgccatgctgctcggaggcgcgcgcgtcgccggcgccgcaaagctcaccggtaacggcaacgctgctggcatgcaggctcttcccatgccggcgtgcttccttccgccgcgcccgcaggcagcgacctggacccgcctctgcttgcaggctgcgccgagatcgtcccaggcatacgacaacgcgccggaagaccggagagaaataggggacaagtacaaggacgcgtcggaggaggcgaatgacgccaccggtgacgccaaggagcacgccaagaggatggtcgctgagacgaacagcagggcgcaggacaaggccggccgcgtggcgtaccaggcgtcgggcatggccgagcggccagccccccantctaaagggcgtggcggaggacgccgcggacacggcgtcccgggc

SEQ ID NO: 24012 - protein, 143 aa, Zea mays
  misc_feature: Ceres CLONE 1394822-F
  misc_feature (128)..(128): Xaa is any aa, unknown, or other
MSRLMAAMLLGGARVAGAAKLTGNGNAAGMQALPMPACFLPPRPQAATWTRLCLQAAPRSSQAYDNAPEDRREIGDKYKDASEEANDATGDAKEHAKRMVAETNSRAQDKAGRVAYQASGMAERPAPXSKGRGGGRRGHGVPG

SEQ ID NO: 24013 - DNA, 827 bp, Zea mays
  misc_feature: Ceres CLONE 1394826-F
gtgcccgggacaaaaaaaaacccccccacaccccccgcgcagtgggggccgctcaccccccccggccccctcaaactggagctcccgcggtgggggccgctctagtatagaggagccccgggctgcaggagttgcacgagacattacctacaaatcctaatcgaaaaatttggtgagactgagatatgggcccttgctctcctcggtccaccgctccacgccccggacgcacacgacccgcatatcgcaccctgtcggcgaggtcgttccccggtacgacggctgctctccgctcgacggcgtcggcttccgggcacctagtgcccacactcccggcgacgatggcgaccgacttggctctggacacccccgacccgagactgggggcctggatgccagcatcacgcgggatatgggccctcatcgggggagctcccggtcactttgttgccccgcggggcgggggggtataacggccgatcctctcccgtttcccccacccccaaagcctcgcccccggatcggggcaggtggggtgcccctgggcccgagggggcacctggaagggcccagagggagaccgccccccccccctccggcaaggactccccacagggccacggcaaagggggtctccccccctcccgggcaccccaccgaaggggggttagttgccctggcgtccacccaggggaagaagggcggccaacaaacaggtccacggccgccccgaggtcttctctgggatcgcacaacccccgcgaccgggcggcccttgcctggtcccggccgcaccacctagtgccccgcgcacgagacgtgccacc

SEQ ID NO: 24014 - DNA, 620 bp, Zea mays
  misc_feature: Ceres CLONE 1394827-F
  misc_feature: Encodes the peptide sequence at SEQ ID NO. 24015
aaagctggagctccccgcggtggcggccgctctagaactagtggatcccccgggctgcaggaattcgcacgagaccattacctagaacatcctaatcgaaaaattttgttgagacctagatacgggcccttgctctcctcggtccaccgatccacgccccgcacgcacacgacccgcataccgcaccctgtcggcgagctcgctcccgttcccgaccgctgctctccgctcgacgccgtcgtcttccgcgcagctagtgtctacactcccggcgacgatggcggaggacttggttttggacacggcgatccgagactgggtcctgatcccgctctccgtggttatggtcctcatcggcgtgctccgctactttgtctccaagctcatgcgctccccggtgacctctccgtctcccgaccccaagctcgttaaggaagggcaggtggtcatcagggcgaggaacctgaggaccaacgcacagttcatcccggtcaagggtttcaaggcacgcaaggtttattacaccaacgaggaaaatggattacttcatggtccaaaggaagacgcgcataaggctcaggcagccatgttttctgatccaaaaatggccatggacatga

SEQ ID NO: 24015 - protein, 114 aa, Zea mays
  misc_feature: Ceres CLONE 1394827-F
  misc_feature (2)..(114): Pfam Name: DUF850 Pfam Description: Eukaryotic protein of unknown function (DUF850)
MAEDLVLDTAIRDWVLIPLSVVMVLIGVLRYFVSKLMRSPVTSPSPDPKLVKEGQVVIRARNLRTNAQFIPVKGFKARKVYYTNEENGLLHGPKEDAHKAQAAMFSDPKMAMDM

SEQ ID NO: 24016 - DNA, 609 bp, Zea mays
  misc_feature: Ceres CLONE 1394829-F
  misc_feature: Encodes the peptide sequence at SEQ ID NO. 24017
  misc_feature (530)..(530): n is a, c, t, g, unknown, or other
  misc_feature (531)..(531): n is a, c, t, g, unknown, or other
  misc_feature (594)..(594): n is a, c, t, g, unknown, or other
aagctggagctccccgcggtggcggccgctctagaactagtggatcccccgggctgcaggaattcgcacgagaccattacctagaacatcctaatcaaaaaaaaacacacagcaagattccacgagaaccgtcaatgggttctataggaggacacacaaccacagctaccgccgaccggcgccgccgcgtgctgttcttcccgctcccgtaccagggccacatcaaccccatgttccaactcgccggcctcctccacttgcgcggtttctccgtcaccgtcttccacaccgacttcaacgctcccgacaagtcccgccaccctgcctacgacttcgtccccgttcccgtccgcggctgcttgccgaagggcagctcggatgccttgcaggtgaccgtggagcgcatcctcgtcgtgaaccgcgcctgcgaggctccgttccgggagcgcctggccgctctgctggcgcgggaggacgtcgcgtgcctggtcgctgacgcccacctgctgacgctgctggacgtggcgcgnnggctcggcgtgccgacgctggtgctgcgcaccggcagcgcggcgtgcctccgcatggtcgcgncgttccccgcgctct

SEQ ID NO: 24017 - protein, 158 aa, Zea mays
  misc_feature: Ceres CLONE 1394829-F
  misc_feature: SWISSPROT Homolog: EC 2.4.1.121 Indole-3-acetate beta-glucosyltransferase
  misc_feature (133)..(133): Xaa is any aa, unknown, or other
  misc_feature (154)..(154): Xaa is any aa, unknown, or other
MGSIGGHTTTATADRRRRVLFFPLPYQGHINPMFQLAGLLHLRGFSVTVFHTDFNAPDKSRHPAYDFVPVPVRGCLPKGSSDALQVTVERILVVNRACEAPFRERLAALLAREDVACLVADAHLLTLLDVARXLGVPTLVLRTGSAACLRMVAXFPAL

SEQ ID NO: 24018 - DNA, 692 bp, Zea mays
  misc_feature: Ceres CLONE 1394840-F
  misc_feature (348)..(348): n is a, c, t, g, unknown, or other
  misc_feature (466)..(466): n is a, c, t, g, unknown, or other
  misc_feature (509)..(509): n is a, c, t, g, unknown, or other
  misc_feature (510)..(510): n is a, c, t, g, unknown, or other
  misc_feature (581)..(581): n is a, c, t, g, unknown, or other
tccccccggtgggcggccgcttctagaactagaagtatccccaccccctggctgcaataattcacacgagacattacctaaaacatcctaatcggaaaacacaaagaaaaacataatactcataaataagtagggtttggagcctgcctgtccatttcgggtctgttcttaaacggcccacacaaggaatctggataaaataccctggttcaaaccatcccctctcatcgattcattgccacaaagcaactgattgctcacagcgttggatgtgagaaatggattccgacccaccgatcgatatgccgttcggccacacgcggctcgatgtccggcgtccgccgcaancgtcctaactctgctggtccacaaccaccgtcgccgtattactcgcgctctgcctggaggctgtgtgggatggcgtcctccatgctcgtatcccctgccgagtcccctcatttacagncaaaaggcgtcactgaggctcatgactctcctccttgccacgnnaagttaaacacggtatcagggatgcatacaccatatgatgcacactgctacacacattgcctctgtacaancagcatggatggtgaaatcagcacagaactttcatacagagcgcggacatggtcaccaagctgaacatctaacaggacgctaaagcaaagcttgacgtcagagtccactga

SEQ ID NO: 24019 - DNA, 728 bp, Zea mays
  misc_feature: Ceres CLONE 1394846-F
caaagctggagctccccgcggtggcggccgctctatactagtggatcccccgggctgcaggatttcgcacgagaccattacctagaacatcctaatcgaaaaaaaatagcaatttttccccctgggagcccgagacgcagcgcgaggtgcggccccggcccctcgccaccggaggagcaggacgactaggtggcgtcggcgcgaggtagtcgcgcgcctggaagagcggcggcatcggagtcgcaggcggaggcgaggaagtgaggggagagccctatagccaccgccgcggtgcgtcgtgctcgctgcacgcactcccaccattttgtcccaactcgaagctcagactcgtgctgtcgtgctgtgcacgacccctcccctagcatcccaagctcctaactgagaaaacaggagatgggaagagacggagaacagactacgcgccggagccgcaagagatcccgcgacgcctccccctcctcgtgcggattccgattccttcgactccccatcctctccgagaagtagccctgagcgacggatccgcagcagtaagcggaatagatcatcctcatcgcaccgccacagccgcaagaaaagcgaccggtcgcggagatcccgcgacgaggaccgccggcgagggagaacacggcgacaggagagaaagcggcacggtggggatgttggcaggtcctcctactcccaatcgtcggaggaggatagggcgg

SEQ ID NO: 24020 - DNA, 690 bp, Zea mays
  misc_feature: Ceres CLONE 1394852-F
  misc_feature: Encodes the peptide sequence at SEQ ID NO. 24021
  misc_feature (690)..(690): n is a, c, t, g, unknown, or other
tccccgcggtggcggccgctctagaactagtggatcccccgggctgcaggaattcgcacgagaccattacctgaacatcctaatcgaaaaataatttcgtcttcttccctctcccaccggtgtcctcgcctcgcctatccgatctgccacctcgccgtctcgcacgttcctttccccaactccccagcgcctctccgcgccgcgatccagatccaggttgttcagcatgggtctggtgaaggaaggcgtcgacatggaggagggaaccctagagatcggcatggagtacaggactgtatctggtgtggccgggcctctggttatcttggataaagtaaagggcccaaagtaccaagaaattgtaaacatccgacttggagatggcaccactcgccgtggtcaagtccttgaagttgatggagaaaaagctgttgtgcaggtttttgaaggaacttctggaatagacaacaaatacacaaccgtgcagtttacaggcggaggcctgggtggctacgggtgagagctgtctcactggagtcacgagggtcacggggaatcgaaacagtctctccgcatttggcggaggaaggctttgggcctgtggtttattccttccttagaccccacttcatgtggaggctcctgggggaagggggtcggcccccttttttaaagggttttcctccatan

SEQ ID NO: 24021 - protein, 97 aa, Zea mays
  misc_feature: Ceres CLONE 1394852-F
  misc_feature (24)..(90): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MGLVKEGVDMEEGTLEIGMEYRTVSGVAGPLVILDKVKGPKYQEIVNIRLGDGTTRRGQVLEVDGEKAVVQVFEGTSGIDNKYTTVQFTGGGLGGYG

SEQ ID NO: 24022 - DNA, 682 bp, Zea mays
  misc_feature: Ceres CLONE 1394853-F
  misc_feature: Encodes the peptide sequence at SEQ ID NO. 24023
  misc_feature (478)..(478): n is a, c, t, g, unknown, or other
  misc_feature (613)..(613): n is a, c, t, g, unknown, or other
aaagctggagctcaccgcggtggcggccgctctagaactagtggatcccccgggctgcaggaattcgcacgagaccattacctagaacatcctaatcgaaaaaccccgacggtgaattccccattcacatctgtagccgcgcctctccgtttcactccgcgcctctctcccgccaggccgccacccaagcaaccatggcgaccgcgctgctccgccgcgcgctccacctccgccgtgtgctcccctcgcccgccgtcaccgccgccgcctcccagcgcctcatccccgccttctcgaccacccccacgccgaccccgaccacctcccagcagaacgccgccaccactacgatcgacctctcctccgacgagagccgccgccgcctcctcaataggttggtgtaccggagcaagcaggcagcagtgcgtccaggcttgcgagcgccggcgacagcagcgcggcggcagccgtgactccnacgtcgacgaggacgacagcgaccggcggtgccagatgaaatgccggcgccacagcgatcggcaggcgaggcagtggtgcgtgcagcgctgcgagcgtaagcaacaggaggaggacgccgccgccgacgacgacnacagcggccggtgccagaagagatgccagcaccacagcgatcggcaggcgaaggcagtggtgcgtgcag

SEQ ID NO: 24023 - protein, 92 aa, Zea mays
  misc_feature: Ceres CLONE 1394853-F
MATALLRRALHLRRVLPSPAVTAAASQRLIPAFSTTPTPTPTTSQQNAATTTIDLSSDESRRRLLNRLVYRSKQAAVRPGLRAPATAARRQP

SEQ ID NO: 24024 - DNA, 662 bp, Zea mays
  misc_feature: Ceres CLONE 1394854-F
  misc_feature: Encodes the peptide sequence at SEQ ID NO. 24025
aaagctggagctccccgcggtggcggccgctctagaactagtggatcccccgggctgcaggaattcgcacgagaccattacctagaacatcctaatcaaaagacaaaatagtaaaaaactcgaccaggtgccccacggcggtgccggcgatggcaacccgctactggatcgtctctctccccgtgcagtctcccggcgccaccgcgacctcgctttggtcgcgcctgcaggatggcatctcccgccactccttcgacaccccgctgtaccggttcaacgtcccggacctccgcgtcggcaccctcgactccctcctcgcgctcagcgatgacctcgtcaagtcaaacgtgttcgtcgagggcgtttcgcacaagatccggaggcagatcgaagacctcgagcgcgccggaggcgtcgacagcggggccctcaccgtcgatggcgttcccgtcgacacctacctcaccaggttcgtgtgggatgagggcaagtaccccacaatgtcgtcgctcaaggagatcgtcggcagcatccagtcgcaggtcgccaagatcgaggatgacatgaaggttcgagcagcggaatataacaatgtaaggagccagcttactgcaatcaacagaaagcaaagtgggagcttagcagttcgtgacctttccaat

SEQ ID NO: 24025 - protein, 171 aa, Zea mays
  misc_feature: Ceres CLONE 1394854-F
  misc_feature (5)..(171): Pfam Name: V-ATPase_C Pfam Description: V-ATPase subunit C
  misc_feature: SWISSPROT Homolog: EC 3.6.3.14 H(+)-transporting two-sector ATPase
MATRYWIVSLPVQSPGATATSLWSRLQDGISRHSFDTPLYRFNVPDLRVGTLDSLLALSDDLVKSNVFVEGVSHKIRRQIEDLERAGGVDSGALTVDGVPVDTYLTRFVWDEGKYPTMSSLKEIVGSIQSQVAKIEDDMKVRAAEYNNVRSQLTAINRKQSGSLAVRDLSN

SEQ ID NO: 24026 - DNA, 890 bp, Zea mays
  misc_feature: Ceres CLONE 1394855-F
  misc_feature: Encodes the peptide sequence at SEQ ID NO. 24027
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (27)..(27): n is a, c, t, g, unknown, or other
  misc_feature (28)..(28): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (847)..(847): n is a, c, t, g, unknown, or other
  misc_feature (849)..(849): n is a, c, t, g, unknown, or other
  misc_feature (850)..(850): n is a, c, t, g, unknown, or other
tgccccccccnnnnnnnnnnnnncggnnccgcgcgnnnggcggtgctccgcgaaaagatggggctccaccgcggtggcggccgctctagaactagtggatcccccgggctgcaggaattcgcacgagaccattacctagaacttcctaatcgaaaaacctcaggtcttgttcagatctctccgggcgggttcatcttgacaccccgaaccgtcctcccggctctctcgtgaaggccgtcccacgagagggatggcggtcttgcgggctccggccggaacgactcctcgtcctcctgcgacctagcgtcggccggcgtcgtgagggacgacggctccgatctcaggtacatgattcaccgggaccgtacccggtctaggccaacacggtcgggtccattttcacaatcgccggggagaccaaaccgacatttttctacctgcgctttccgatcctccctgacgaaagtcgaatggaaaaagggccgacgacccctggggggaaggctcttccaatggggccatcgcgtaaaaacgagctcgcccactcacacattctcggatttcaccgccgacaaaaactctgcagccccccggcgctcctctttgccccccatatacccttttacccccacggggggcgtggccggcgctctctttctctgtaaatggcaatgtgttcatatagggatctaacttcccacccctctcccggcatcctcgcccgcgacttcccccactcgtgcttcggttattatattcctcctaatatctctaccatcctgtgcgtgctccggatgtccctaccgcactcgcggcgctataacacatttttcttcggcgatgttantnntgcagttgttcggtatgtagttacatatacggaccggccg

SEQ ID NO: 24027 - protein, 75 aa, Zea mays
  misc_feature: Ceres CLONE 1394855-F
  misc_feature (61)..(61): Xaa is any aa, unknown, or other
  misc_feature (62)..(62): Xaa is any aa, unknown, or other
MAMCSYRDLTSHPSPGILARDFPHSCFGYYIPPNISTILCVLRMSLPHSRRYNTFFFGDVXXAVVRYVVTYTDRP

SEQ ID NO: 24028 - DNA, 680 bp, Zea mays
  misc_feature: Ceres CLONE 1394857-F
  misc_feature: Encodes the peptide sequence at SEQ ID NO. 24029
tccccgcggtggcggccgctctagaactagtggatcccccgggctgcaggaattcgcacgagaccattacctagaacatcctaatcaaaaaacaatctttgtattatatataaatagcttgccagagccagcgaatgcagagcacaagatccaagaaacacaactgcaaaagcgaggatcggagcactccgatccttaattccttcttggattctcttctactctagagctctgctagaccgatctccagttaagtttcagacacatggagagcaacgcctcgtccaactgcgccaccgtgccgcagccgccgccgtcgacagggaagctgatcacgattctgagcatcgatggtggcggcatccgcggcctcatcccagccaccatcatcgcgcacctcgaggccaagctgcaggagctggacggcccagatgctcggatcgccgactacttcgacgtgatcgccgggacgagcaccggcgcccttctcacgtcgatgctgggcggcgccggaccagaacaaccggccgctgttcttcgcaaaggacctcaacacgtctaacctcgagaacgggcccaaatctccctcaaaaaaaaagggcccggttcctggaaaccccggtgcggaactgctggcccgtgtgggagaggggcccaagataaacagagggggtgttcct

SEQ ID NO: 24029 - protein, 98 aa, Zea mays
  misc_feature: Ceres CLONE 1394857-F
  misc_feature: SWISSPROT Homolog: EC 3.1.1.5 Lysophospholipase
MESNASSNCATVPQPPPSTGKLITILSIDGGGIRGLIPATIIAHLEAKLQELDGPDARIADYFDVIAGTSTGALLTSMLGGAGPEQPAAVLRKGPQHV

SEQ ID NO: 24030 - DNA, 711 bp, Zea mays
  misc_feature: Ceres CLONE 1394859-F
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (339)..(339): n is a, c, t, g, unknown, or other
  misc_feature (340)..(340): n is a, c, t, g, unknown, or other
  misc_feature (342)..(342): n is a, c, t, g, unknown, or other
  misc_feature (344)..(344): n is a, c, t, g, unknown, or other
  misc_feature (345)..(345): n is a, c, t, g, unknown, or other
  misc_feature (347)..(347): n is a, c, t, g, unknown, or other
caccgcggtggcggccgctctatgaactagtggatcccccgggctgcaggaattcgcacgagaccattacctagaacatcctaatcgaaaaccggacaactctgatctccctccgtacatctcatcatgatctttgtccctctcgggcaattcgccgaagacaccgcgcgtgtctcgactcccagagacagacgcctcgacggccaatgctggcgccggaatcgagcgcgaaaggatgaggtgcagagcgcagaggaggacctgctctacgagtcgctcagacgcatcctcatctcagcatgctactccacttctggctcggagggagagtgggnnntnntntnngncccccctccccgccgaaacaaacacgcggtggggcacccccacgggtgccccaacctcgcagttttcaccccaaaaaacccccggggaccccccccccacaaaaaaatctttggtagaagggcggcgccaggccccccaaaagcgggaaccccctgctaaacccggggggggggagattctcccccaaaccccgggggcccccccgctccccttataggaagagacgccccgcgggggggcgcccccccgccccataagggggctcccaaaattattcctccggggggggggggcgccccctctccgcccttgtttggtggagaaaaattatatttcttacccctccccgccccgcccgttttt

SEQ ID NO: 24031 - DNA, 681 bp, Zea mays
  misc_feature: Ceres CLONE 1394865-F
  misc_feature: Encodes the peptide sequence at SEQ ID NO. 24032
cgatcttcactaatggatcccccgggctgcaggttttcgcacgagaccattacctagaacatcctaataaaaatacgatccgtcgcgtgtataggattcctctctcaccatagagcccgctctgtcgcccttcgctcacctctccttgctctcctccctgcctgacagacgaaaggagaaggcacgaggcacaggagtgggccataccagacgccgggagacattggagctgggcctggcctccttcccctcccctgacccacgctgggtaaggatggagaaaaaaccgaccatgctcatgaacaggtacgacctcgaacgcacgctcgaagaaggcaccttcgccgaggcggatcacggacggaacctcgcgtccggcgagagagtgcccatcaaggtcatcgacaaggaaaaggtgatgcgcgtcggcatgatcgaccagatcgagctggagatattggtcatgcgactcgtgcgccatcccaacgtcgtgcacctgcaccaggagatggtcagctaataggaagaaatacctcgccaatgaaaaacgggccgggggggggggaggttttttcgccgggggggcccccccggaggggggttttaaaaagaggagacccccccccaaaaaaaaaatttttttcccccccccctcccttcgggggggggggcggggttttt

SEQ ID NO: 24032 - protein, 81 aa, Zea mays
  misc_feature: Ceres CLONE 1394865-F
  misc_feature: SWISSPROT Homolog: EC 2.7.11.1 Non-specific serine/threonine protein kinase
MEKKPTMLMNRYDLERTLEEGTFAEADHGRNLASGERVPIKVIDKEKVMRVGMIDQIELEILVMRLVRHPNVVHLHQEMVS

SEQ ID NO: 24033 - DNA, 675 bp, Zea mays
  misc_feature: Ceres CLONE 1394867-F
  misc_feature: Encodes the peptide sequence at SEQ ID NO. 24034
  misc_feature (429)..(429): n is a, c, t, g, unknown, or other
  misc_feature (490)..(490): n is a, c, t, g, unknown, or other
  misc_feature (507)..(507): n is a, c, t, g, unknown, or other
tccccgcggtggcggccgctctagaactagtggatcccccgggctgcaggaattcgcacgagaccattacctagaacatcctaatcgaaaaattaattaacaaagagaagacttcttccttcctcgtcgtctccagcccattccaattcttgattccatcgccccaccatccacaactcccctaatccttccaacctcctcgtcgtccagtccaccacctccacgcgcaatggccagcggctaggcggcaccaaccagatcacaaggattcgtttcatccggcagcgcagctctagagcctccatgggcagctacgcgtacaagtactgtatgtgcttcacgcgcaagttccgatccccggacgcccagccgccgccggacgtccgcgccgcccacctctcctttcgctctgacgcccatgccctccgncgcttcgtcgccggcgtccagggcgagtcccccgccgacgtcgaccgcatcctcgcatgcnttctcggggggcacagncatggaatcggcccgctcgtcacaagggcgcccggggggatcacggcccaggttcgaagattttttggctttcttttttcccccgaaccttaaccaccttggggaacaggtaaccaggaatggggcagggccggtctccacaaaattcgggggacccggggaaaattc

SEQ ID NO: 24034 - protein, 98 aa, Zea mays
  misc_feature: Ceres CLONE 1394867-F
  misc_feature (63)..(63): Xaa is any aa, unknown, or other
  misc_feature (68)..(68): Xaa is any aa, unknown, or other
MGSYAYKYCMCFTRKFRSPDAQPPPDVRAAHLSFRSDAHALRRFVAGVQGESPADVDRILACXLGGHXHGIGPLVTRAPGGITAQVRRFFGFLFSPEP

SEQ ID NO: 24035 - DNA, 653 bp, Zea mays
  misc_feature: Ceres CLONE 1394874-F
  misc_feature: Encodes the peptide sequence at SEQ ID NO. 24036
aaagctggagctccccgcggtggcggccgctctagaactagtggatcccccgggctgcaggaattcgcacgagaccattacctagaacatcctaatcgaaaaaccgtctcttctgttctgccctgctcgtgctcgtgcattcacccaccggggcgggcgtctctctcaccgccttgccacgccagcacgccactgtgctctgcctctgctcgactgctcctccatattaagaggccctcccgcgcgcccgcctctcgccgtgctcgtcgtcccttcgttacccgggtcagtgccgccgtcggtagcagaggagcagtaggtggccagtcagtcagccaattgtccgctcgtccactccgttcgagctctcctactcttcaccacccacccatccatccatccatccatcggcgagcgcgagagcacactgttgcattgctgatcgctccgtctccgctgccgacgaggacgaggaagaacgagggagagacgcagacaggctgcgttgcgccatgaggagagcaggggggctatcgcgcgcgggccacggcgcggcgccggcggcgggggtcatgcgggcggcggcgtccgcgttcttcgcggggtaccactgcttcacctccgtggcgacgctgctgacgctgccgatctcg

SEQ ID NO: 24036 - protein, 47 aa, Zea mays
  misc_feature: Ceres CLONE 1394874-F
MRRAGGLSRAGHGAAPAAGVMRAAASAFFAGYHCFTSVATLLTLPIS

SEQ ID NO: 24037 - DNA, 671 bp, Zea mays
  misc_feature: Ceres CLONE 1394887-F
  misc_feature: Encodes the peptide sequence at SEQ ID NO. 24038
  misc_feature (486)..(486): n is a, c, t, g, unknown, or other
  misc_feature (488)..(488): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (581)..(581): n is a, c, t, g, unknown, or other
  misc_feature (629)..(629): n is a, c, t, g, unknown, or other
tggagctccccgcggtggcggccgctctagaactagtggatcccccgggctgcaggaattcgcacgagaccattacctagaacatcctaatcgaaaaacggtccaccgacgactcttcttcctcacctcctcccgctccagctccagctcgtctctctcctcgcctcgcgtagggtttcgcttcccgtctcgccgccgtcagcatgggggacaactacgatgacgaaggcgagccgatcgtgaacctcgacgaacgggaaccctcccctgagcatcagccgtacgaagacctcgatgacgacctcgacggcggcggcgattggacccgcgaccgctctccgacccccgtccacggcgacgacggcggggcagggtcctcctccaagccccgaaagcgccttctcaagaagggcggcggtggaggcatgcccggcgatgacgggctggatgactttgggttggaggacgaggacgcggacccttcgngnctgaggcgaggaagaggaagggctcgtcgtcgctgagggacctcgcgaggggcggggcgggcagggagaagaggctaagaatgggggnnnggnaaaaaacaacgaaaagggggagggacacggggatggtgagggataggncggggattcaggaggaagggactcaggcggtaggatgaacca

SEQ ID NO: 24038 - protein, 106 aa, Zea mays
  misc_feature: Ceres CLONE 1394887-F
  misc_feature (95)..(95): Xaa is any aa, unknown, or other
MGDNYDDEGEPIVNLDEREPSPEHQPYEDLDDDLDGGGDWTRDRSPTPVHGDDGGAGSSSKPRKRLLKKGGGGGMPGDDGLDDFGLEDEDADPSXLRRGRGRARRR

SEQ ID NO: 24039 - DNA, 656 bp, Zea mays
  misc_feature: Ceres CLONE 1394888-F
  misc_feature: Encodes the peptide sequence at SEQ ID NO. 24040
cgcggtggcggccgctctagaactagtggatcccccgggctgcaggaattcgctcgagaccattacctagaacatcctaatcgaaaaagctgcggcgccaccctcggcctcgggccgtccgccgtcggcggccacgaccctggtgtaatctgctccatacgtggcggcgcctgcaaaagccacgctgctgccagtgccagccatggatgcagtggcggccagcgacgccgtactcctccttgctaccgtagctatctccctgctcatcactgccactttctggagcaggcatcgtcgtcagggcgaagcgccgagcccgccgtcgctaccgctgctgggccacctccacctgatcggcaacgagaagccgctgcaccacacgctggcgccgctggccatcgcgcgcggcaccgggggcgccccggtgccgctccatgtgctgagactggtcctccagcgccctctgctggcggattatcctgctcaggacgaagagtatctgacagaagcacgacgccgcgctggaggctgcggctcggattgtcgtaggcaatggcgtcacgtaaagcgactgaagcacgtcctggctcatctacgggatctgtgcgcgactcatgtactacgtcttcctgctcgcgcctaaccagacacctacg

SEQ ID NO: 24040 - protein, 146 aa, Zea mays
  misc_feature: Ceres CLONE 1394888-F
MDAVAASDAVLLLATVAISLLITATFWSRHRRQGEAPSPPSLPLLGHLHLIGNEKPLHHTLAPLAIARGTGGAPVPLHVLRLVLQRPLLADYPAQDEEYLTEARRRAGGCGSDCRRQWRHVKRLKHVLAHLRDLCATHVLRLPARA

SEQ ID NO: 24041 - DNA, 673 bp, Zea mays
  misc_feature: Ceres CLONE 1394893-F
  misc_feature (178)..(178): n is a, c, t, g, unknown, or other
  misc_feature (243)..(243): n is a, c, t, g, unknown, or other
aaagctggagctccgcggtggcggccgctctagaactagtggatcccccgggctgcaggaattcgcacgagaccattacctagaagatcctaatcgaaaaaaccgacttccagttccactctcgcttccttccctccctccctcccacgcaaatggtggccgctcgcctccgcctcgngctgatactctccgtctggctctgctccgcgtgggcgcgcccacgcctcgagaacggcatcccgnctgccgtcgcagggggcgggggggggcgaaaaaaacgaagacggcggcctccgggaacccctgggttgtggtcatcgaagggtccaaaggggtaataaaaataaaccgcaacaaaggggaaaatttgcctgggtaacagaaaatggaaaaaaggggggctcccagggagagaaaaatcatttgtcttctggtgacaagaaaatcttcccataaaccccgaaaaaaccaagggctgggggggatctattaaacaatcccccacaggggggggaaaactaaattttgggggggcgaaaaaaaattaaaaccgggggggaaaggtaaaaaacccaaaaaattttttccccgggtgggggcggggggaaaaaaaaaaatttcctcccagggggggagaaacacaaaaaaagtttgggacaaagaggccccccca

SEQ ID NO: 24042 - DNA, 681 bp, Zea mays
  misc_feature: Ceres CLONE 1394897-F
  misc_feature: Encodes the peptide sequence at SEQ ID NO. 24043
  misc_feature (515)..(515): n is a, c, t, g, unknown, or other
tccccgcggtggcggccgctctagaactagtggatcccccgtgctgcaggaattcgcacgagaccattacctagaacatcctaatcgaaaaacatcccagtgccgagtgtccccacacaaccaagcggaagcttcggtcgaacagagggagtaagcagttgcgtttcgcattgcgcggcgccgatgggggcgtcggggaagtggatcaagtcgctggtggccctgaaggcgcccgagaaggcggcggggcacaagggcggtcgcaaatggcgtctctggcggagctcgtcggccacgtccagggccagcgccggcgagggcagtgcgctggcgtccgagtcttcttcggcgtcggccgactcgttcaactcggtcctcgccgccgtggtccgcgcgccgcccagggatttcctgctcatcaggcaggaatgggccgccgtccgcatccataccgccttccgcggattcttggcgagacgggcgttgaaggcgctgaggggcatcgtccggctgcnagcgctggtgcgcggccggcgcgtgcgcagcaactggccgtcacgcttcaggggatggacgcactggtgcgggtgaggaaaccgccccggaaaggcccgggggggctccccccggtgtggggccccgttttccaagggcccagaagggggcccttcccgggggggg

SEQ ID NO: 24043 - protein, 135 aa, Zea mays
  misc_feature: Ceres CLONE 1394897-F
  misc_feature (111)..(111): Xaa is any aa, unknown, or other
MGASGKWIKSLVALKAPEKAAGHKGGRKWRLWRSSSATSRASAGEGSALASESSSASADSFNSVLAAVVRAPPRDFLLIRQEWAAVRIHTAFRGFLARRALKALRGIVRLXALVRGRRVRSNWPSRFRGWTHWCG

SEQ ID NO: 24044 - DNA, 647 bp, Zea mays
  misc_feature: Ceres CLONE 1394903-F
  misc_feature: Encodes the peptide sequence at SEQ ID NO. 24045
  misc_feature (380)..(380): n is a, c, t, g, unknown, or other
  misc_feature (384)..(384): n is a, c, t, g, unknown, or other
  misc_feature (464)..(464): n is a, c, t, g, unknown, or other
  misc_feature (553)..(553): n is a, c, t, g, unknown, or other
  misc_feature (572)..(572): n is a, c, t, g, unknown, or other
  misc_feature (601)..(601): n is a, c, t, g, unknown, or other
tggagctccccgcggtggcggccgctctagaactagtggatcccccgggctgcaggagagaccattacctagaacatcctaatcgaaaagtccttccctccgcctccgcccccgcccactcctggcttccaccactcctgtcacctcttcccgcgccgacgcagccgccatggaccccgtctccacatgggggctaaccccgctcgcgggcgccgacccggagatctacgacctcctggagcgcgagaagcggcgccagcgtcgcggcatcgagctcatcgcctccgagaacttcacctccttcggcgtcatggaggcgctcggctccgcgctcactaacaagtactccgaaggcatggcccggcgcccgctactacggngggnacgacgtcatcgacgagatcgagaaactctggcggtcacgcgcggtcggtggcttccaacttggaagcgcgttcctgggngtgcaacgtggagaccctaatcggggtcccccggccaattcgccggctataacgggctggtctaaccggacgaacaggatcatggtggntcgaacctccccttcgggnggacactctactctacggtactacacggnccgccggggaaattaaaaaacatccccccaacatccatttaaaatt

SEQ ID NO: 24045 - protein, 104 aa, Zea mays
  misc_feature: Ceres CLONE 1394903-F
  misc_feature: SWISSPROT Homolog: EC 2.1.2.1 Glycine hydroxymethyltransferase
  misc_feature (71)..(71): Xaa is any aa, unknown, or other
  misc_feature (72)..(72): Xaa is any aa, unknown, or other
  misc_feature (99)..(99): Xaa is any aa, unknown, or other
MDPVSTWGLTPLAGADPEIYDLLEREKRRQRRGIELIASENFTSFGVMEALGSALTNKYSEGMARRPLLRXXRRHRRDRETLAVTRGRWLPTWKRVPGXATWRP

SEQ ID NO: 24046 - DNA, 698 bp, Zea mays
  misc_feature: Ceres CLONE 1394905-F
  misc_feature: Encodes the peptide sequence at SEQ ID NO. 24047
  misc_feature (555)..(555): n is a, c, t, g, unknown, or other
  misc_feature (624)..(624): n is a, c, t, g, unknown, or other
aaagctggagctccccgcggtggcggccgctctagaactagtggatcccccgggctgcaggaattcgcacgagaccattacctagaacatcctaatcgaaaaaagtaatccatttctcctttccttcgtctcttccttccattctcctcctcatcaactccatcgcattgctattccagtcctcgccagagaagaatcccgcgagcgagcgagcgcgcgaggcggcaaggacgagcccaagacgtacgatggcgaggaggctggcgtacacgacggcgctgaccacgctcttcagctacgggctgctcttcgccttcggccagctcagggatctcttccgccacctgctcggctgcttcagacccaacaaggacgacgacgtcaagcaggggtacgcgccgatctgcgtcggcctggaggatttcttcgtgcgacgactctacctgcgggttcaggattgcttcggcaggccaatcgctagcgcaccggactcatggttcgatgtggtggagcgtacctcagacgacaacaacaagacattgcagcgcacctcanagaccactagatgcctgaacctgacgtcctacaactacctcgggttcgccgcggccgatgagtactgcngtccacgcgttgtcgactccctcaagaaatactcggcgagcacctgcagtgctcgtggtgatggcggcacgacc

SEQ ID NO: 24047 - protein, 150 aa, Zea mays
  misc_feature: Ceres CLONE 1394905-F
  misc_feature: SWISSPROT Homolog: EC 2.3.1.50 Serine C-palmitoyltransferase
  misc_feature (103)..(103): Xaa is any aa, unknown, or other
  misc_feature (126)..(126): Xaa is any aa, unknown, or other
MARRLAYTTALTTLFSYGLLFAFGQLRDLFRHLLGCFRPNKDDDVKQGYAPICVGLEDFFVRRLYLRVQDCFGRPIASAPDSWFDVVERTSDDNNKTLQRTSXTTRCLNLTSYNYLGFAAADEYCXPRVVDSLKKYSASTCSARGDGGTT

SEQ ID NO: 24048 - DNA, 721 bp, Zea mays
  misc_feature: Ceres CLONE 1394907-F
  misc_feature (406)..(406): n is a, c, t, g, unknown, or other
  misc_feature (691)..(691): n is a, c, t, g, unknown, or other
  misc_feature (692)..(692): n is a, c, t, g, unknown, or other
cgctctagaactagtgcatcccccgggctgcaggaattcgcacgagaccattacctagaacatcctaatcgaaaatacgaagcttcgtccaccatttggctcccgcagcaccgatttgtttactgctctctccaaggcgcggcggcggatctccctactactactgaaccatgtgagacggctcgatccttgcccaccttcgcgagacggagacacacacagacacagagcgaaacatctgtccagacaagaacaagctcatgaggggcggcctccgtccgaggtgctcgttcgtcggcggaggacgatgaggacttctaggccgacttttacgtctctccacgtcacagctccagtgattgcagatttggagcatcgatggatcgactgactgacgacttccctncatatcaagccctgtcactgccgagaggactgtcgccatcgatggcgtacgcatccatgactagtgctgtagcaaggtcagccgagaggaagagaaagaatctatacgggaatatccagcagaggcctcgctgcaagtgccctgctgagatcagagatcctcacaatgctgtctacgaatgccactggactgtcatatacctgagcgagatgctggacttatgatgctgaaggcgcagtagtcgtgacatgacggcaagctaacctttctgatgcacagaagtgnncatagcggctatctgctacacttcgctaa

SEQ ID NO: 24049 - DNA, 711 bp, Zea mays
  misc_feature: Ceres CLONE 1394908-F
  misc_feature (289)..(289): n is a, c, t, g, unknown, or other
  misc_feature (356)..(356): n is a, c, t, g, unknown, or other
  misc_feature (411)..(411): n is a, c, t, g, unknown, or other
  misc_feature (423)..(423): n is a, c, t, g, unknown, or other
  misc_feature (546)..(546): n is a, c, t, g, unknown, or other
caaagctggagctccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggntgggcgtcggtgctcaaggaccggcgggtggtcgacggccctcccgccggggcccttccgggttggnccggttggtggggggaacctgggtcccaggtgatccttgcagcgacgggccttcnatggtacgtggntgcgcgacctcccgggaaggaaagtacggggccccatcttcaccaatgtccggaaggggggcagcgcacccttcactccgtggtcacacttcggcgggaactcatccacccaagcggctttgntgaaacaaagggcccccctggttcgcgcaggccccggcccgaagaacaggccccaccccggcttctcttttagggggtggggaaagtggcaacggtcaactcgcggggcctacgggcccccctgttggggttggttctggggccgcaaacttccgttgccccaaa

SEQ ID NO: 24050 - DNA, 725 bp, Zea mays
  misc_feature: Ceres CLONE 1394909-F
  misc_feature: Encodes the peptide sequence at SEQ ID NO. 24051
  misc_feature (725)..(725): n is a, c, t, g, unknown, or other
tggcggccgctctagaactagtggatcccccgggctgcaggaattcgcacgagaccattacctagaacatcctaaaaaaaaagcaggccaaacacgcaacgcaacactcgccttcccctcccaaccctccgaaccgaagcagcaaagctagacgatgacgctgacgatcccggacgaggtgcgcgccaaggcggaggtgtacgtgggcgacgcggcggggcaggagaagacgcggctgctcctccaggagacgggcctcccgagcgggctgctcccgctgcgggacatcatcgagtgcggctacgtggaggagacgggcttcgtgtggctccggcagcgccgcaaggtggaccactacttcgccaaggccggccgccacgtgtcctacggcgccgaggtgtcggcggtggccgacaagggccggctcaagaagatcacgggcgtcaagggcaaggagatgctgctgtgggtcaccctccacgagatctgcgtcgacgacccgcccacgggtaagctccactgcaaggccatcggcggcctgtcccgcagcttccccgtcgaggtcttcgaggccgaggagccggcgccgcccggagacggcggtgtcgttaccaggtacgcggaggaagatgaggagctggacaacgagaagggaacaagttgactccaacccagtaggtgaaacgaatgtctacaagactgctacgcccgcaatgctcatcagn

SEQ ID NO: 24051 - protein, 169 aa, Zea mays
  misc_feature: Ceres CLONE 1394909-F
  misc_feature (2)..(149): Pfam Name: DUF538 Pfam Description: Protein of unknown function, DUF538
MTLTIPDEVRAKAEVYVGDAAGQEKTRLLLQETGLPSGLLPLRDIIECGYVEETGFVWLRQRRKVDHYFAKAGRHVSYGAEVSAVADKGRLKKITGVKGKEMLLWVTLHEICVDDPPTGKLHCKAIGGLSRSFPVEVFEAEEPAPPGDGGVVTRYAEEDEELDNEKGTS

SEQ ID NO: 24052 - DNA, 647 bp, Zea mays
  misc_feature: Ceres CLONE 1394916-F
  misc_feature: Encodes the peptide sequence at SEQ ID NO. 24053
  misc_feature (576)..(576): n is a, c, t, g, unknown, or other
  misc_feature (631)..(631): n is a, c, t, g, unknown, or other
  misc_feature (635)..(635): n is a, c, t, g, unknown, or other
cgctctagaactagtggatcccccgggctgcaggaattcgcacgagaccattacctagaacatcctaatcgaaaaatcactagtcaccacttccccgcgctgccctcccactcccacacaccttctgctgcctctcgccgcggccgatgggctgcttccttggctgcttcgggggggccaaggagcgccgccgccgccgccgcaagcggtcgccgtcacagtcccccaacggccgtgctcgggccttgctgcgggttacgccgaacaaggttgatctggatggggaggccgtctccgccgccgcgccgctactagcgacgctcctcgagttgagggactccacggacgacatgtgcctggccctcgtgaagaagaaggtgacattcgaccccaacgtcaccacattcgaggcggccccgatcccggaggacgacggcgaggaagccgatccggaggatgggggggatagcagggagaaggggtggatgctggcgtcggagtgcgccaagtccgaggccttccccttgaaccacaggtacagcaagctcgccggcagcggcaacgtcagcgactacnaggacgccgagagagaatttttcctaaaaaacgaaggagaaggaggacgacacancccnagggagggagag

SEQ ID NO: 24053 - protein, 167 aa, Zea mays
  misc_feature: Ceres CLONE 1394916-F
  misc_feature (144)..(144): Xaa is any aa, unknown, or other
  misc_feature (162)..(162): Xaa is any aa, unknown, or other
MGCFLGCFGGAKERRRRRRKRSPSQSPNGRARALLRVTPNKVDLDGEAVSAAAPLLATLLELRDSTDDMCLALVKKKVTFDPNVTTFEAAPIPEDDGEEADPEDGGDSREKGWMLASECAKSEAFPLNHRYSKLAGSGNVSDYXDAEREFFLKNEGEGGRHXPREGE

SEQ ID NO: 24054 - DNA, 677 bp, Zea mays
  misc_feature: Ceres CLONE 1394922-F
  misc_feature: Encodes the peptide sequence at SEQ ID NO. 24055
  misc_feature (463)..(463): n is a, c, t, g, unknown, or other
  misc_feature (591)..(591): n is a, c, t, g, unknown, or other
  misc_feature (613)..(613): n is a, c, t, g, unknown, or other
  misc_feature (664)..(664): n is a, c, t, g, unknown, or other
aaagctggagctccccgcggtggcggccgctctagaactagtggatcccccgggctgcaggaattcgcacgagaccattacctagaacatcctaatcaaaaaaaccagcaccttttgcctaccccggcaccaccccgcctttgccttggtgttgaaaagtcgccgcgttcctcttgcctgatgaaatcaatcctcttctcgtctagatctgagcctccgcgtggcttccagatcagatgcttggtccgatcaacgacggtgagtcttgctctgttagttgattgttcgaaatgcatggttttgtttttgtgatgatgtgcaggttccgatcagtttcgtttgattgatgagttgacgcatcggttcgaagcgagacgaggctgcatggtttttgtgcctggaggtttctgatcagcgtgtttaaggaaactggatgctacaatttgttatctgcagaccttanaaagctgcgacgttccggctttcccggggggatctgggatcttggctgactggacaattgcgagggcgttgacgggcttctaaagcgtgggctggaattgctggatctcctttctgccccgcgactcngatgatatctctttgtattggntaaatatttggatgaaatttcgataattattaattccgaaaagatgtgggntcccccggcggtc

SEQ ID NO: 24055 - protein, 43 aa, Zea mays
  misc_feature: Ceres CLONE 1394922-F
MKSILFSSRSEPPRGFQIRCLVRSTTVSLALLVDCSKCMVLFL

SEQ ID NO: 24056 - DNA, 698 bp, Zea mays
  misc_feature: Ceres CLONE 1394923-F
  misc_feature: Encodes the peptide sequence at SEQ ID NO. 24057
  misc_feature (468)..(468): n is a, c, t, g, unknown, or other
  misc_feature (499)..(499): n is a, c, t, g, unknown, or other
  misc_feature (500)..(500): n is a, c, t, g, unknown, or other
  misc_feature (517)..(517): n is a, c, t, g, unknown, or other
  misc_feature (596)..(596): n is a, c, t, g, unknown, or other
  misc_feature (675)..(675): n is a, c, t, g, unknown, or other
  misc_feature (698)..(698): n is a, c, t, g, unknown, or other
aaagctggagctccccgcggtggcggccgctctagaactagtggatcccccgggctgcaggaattcgcacgagaccattacctagaacatcctaatcgaaaaatccgacccagtatccccgacaaagtcaatgcgatgcgtctcctccttgctctatcgactatcgtagccgattccccgttgcaagtaactaaaactaagtctcaagtctgcagagtaaccggagtagcatagcactagcaagcaatggccgctctcacttccgctctcctcttcgccgccctcctcgtggccgcccagtacgtgctccgcttgctccactccttcctgtgggtcccgttccgcctggaacgccgcttccggcggcagggaatccggtggccaccacgaagcctggtctccggtaacgcagccgactaccgcgacctgctagccgccgccaggtccgcgcccctctcctccttccgnccaaaacgggcgtcgtcgcccggcccaccgnnaaaatacggggtctggnttggcggggacaggccgggccgttctgggaatagtggtttcggcccgggccgggggtttggtgatctccgacacggagnctcgtgaaagggccgtgatgacgacctccacggggggggctttggaataagggcgggcctcgggcgggcaacaacccgnctcgccaggcagttcaaatcggn

SEQ ID NO: 24057 - protein, 118 aa, Zea mays
  misc_feature: Ceres CLONE 1394923-F
  misc_feature (85)..(85): Xaa is any aa, unknown, or other
  misc_feature (91)..(91): Xaa is any aa, unknown, or other
  misc_feature (117)..(117): Xaa is any aa, unknown, or other
MAALTSALLFAALLVAAQYVLRLLHSFLWVPFRLERRFRRQGIRWPPRSLVSGNAADYRDLLAAARSAPLSSFRPKRASSPGPPXKYGVWXGGDRPGRSGNSGFGPGRGFGDLRHGXS

SEQ ID NO: 24058 - DNA, 745 bp, Zea mays
  misc_feature: Ceres CLONE 1394926-F
  misc_feature: Encodes the peptide sequence at SEQ ID NO. 24059
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (16)..(16): n is a, c, t, g, unknown, or other
  misc_feature (17)..(17): n is a, c, t, g, unknown, or other
  misc_feature (21)..(21): n is a, c, t, g, unknown, or other
  misc_feature (745)..(745): n is a, c, t, g, unknown, or other
atttaaatcccnnncnncaanaccccacaccaaccccacaacaacaccaccaccacccgatactccccgcggtggcggccgctctagaactagtggatcccccgggctgcaggaattcgcacgagaccattacctagaacatcctaatcgaaaaaccagtcagcactcagcacacagagtccgcctccgccgcggctccggcgcccgcatccgtctcaggagtcccttctccccgcgggtggagacatcttgatcatttctgagattaaactgatgatgctgatgctcgtttagttatcttggtttggagatatatcagatatgggtgatcggaatcatggacgctctctccctctactgctctatctacatcttttgctgccaatacttccgtttgctatggcagatatagcctccgagaagcaagcactccttgcttttgcctctgcagtctaccatggcaacaaactgaattggagccaaaatatcccagtgtgctcatggcatggtgtgacatgctcactggatcgatcgtgtatattggcccttagggtgccagggcgctgggtttgattggcaccattcctgctgatactcttgggcaggccttggggcccctccaagtttttaagcatgaggtcctaacccgtttggaggtggaagcctttccgaaacgatggttgcctccacttcccttcctttacaaaggccatattttgcttcaggcacaaccgcaaactggtcn

SEQ ID NO: 24059 - protein, 83 aa, Zea mays
  misc_feature: Ceres CLONE 1394926-F
  misc_feature (30)..(67): Pfam Name: LRRNT_2 Pfam Description: Leucine rich repeat N-terminal domain
MGDRNHGRSLPLLLYLHLLLPILPFAMADIASEKQALLAFASAVYHGNKLNWSQNIPVCSWHGVTCSLDRSCILALRVPGRWV

SEQ ID NO: 24060 - DNA, 680 bp, Zea mays
  misc_feature: Ceres CLONE 1394929-F
  misc_feature: Encodes the peptide sequence at SEQ ID NO. 24061
  misc_feature (458)..(458): n is a, c, t, g, unknown, or other
  misc_feature (517)..(517): n is a, c, t, g, unknown, or other
  misc_feature (559)..(559): n is a, c, t, g, unknown, or other
  misc_feature (566)..(566): n is a, c, t, g, unknown, or other
  misc_feature (580)..(580): n is a, c, t, g, unknown, or other
  misc_feature (619)..(619): n is a, c, t, g, unknown, or other
  misc_feature (623)..(623): n is a, c, t, g, unknown, or other
cgcggtggcggccgctctagaactagtggatcccccgggctgcaggaattcgcacgagaccattacctagaacatcctaatcgaaaaaacacaacgcttatattacttacaacaaaagataagcccacgaatcagtagatcgaggtcccgcccagtccagcagaagcgcacacggagatgtcccagctgagccctgctggccacatggctgcgacgctcctcctcatcctcctggcctccgcagcagcagcagcggtgtcagctgaccaacaggtctctgcctgccagaatgacatagacgcactgtggcgcagctgcaagcagttcgtccagaaggaggggcccaagatgcctccgtccgaggactgctgcaaaaccatcaaggccttagacgcgcacgcgtcctgcatctgcgactacgtcggctccccggacgccaggaataagctagacctggnacaagggtgttcttcgttaccaaacagtggcggcgtcaccgtcccccaagggctgcggnatcaaaagcaggactggaagagcggctggaatctgaatgggnagcaagnttggctaacatacngcacggcagctacaaatacttatagaataaaaataaggntgcnaaactgttggggttctaggggggggggtgagaaaacaaaaaagtggtactgttctta

SEQ ID NO: 24061 - protein, 167 aa, Zea mays
  misc_feature: Ceres CLONE 1394929-F
  misc_feature (94)..(94): Xaa is any aa, unknown, or other
  misc_feature (114)..(114): Xaa is any aa, unknown, or other
  misc_feature (128)..(128): Xaa is any aa, unknown, or other
  misc_feature (130)..(130): Xaa is any aa, unknown, or other
  misc_feature (135)..(135): Xaa is any aa, unknown, or other
  misc_feature (148)..(148): Xaa is any aa, unknown, or other
  misc_feature (149)..(149): Xaa is any aa, unknown, or other
MSQLSPAGHMAATLLLILLASAAAAAVSADQQVSACQNDIDALWRSCKQFVQKEGPKMPPSEDCCKTIKALDAHASCICDYVGSPDARNKLDLXQGCSSLPNSGGVTVPQGLRXQKQDWKSGWNLNGXQXWLTYXTAATNTYRIKIRXXNCWGSRGGGEKTKKWYCS

SEQ ID NO: 24062 - DNA, 663 bp, Zea mays
  misc_feature: Ceres CLONE 1394930-F
  misc_feature: Encodes the peptide sequence at SEQ ID NO. 24063
  misc_feature (551)..(551): n is a, c, t, g, unknown, or other
  misc_feature (552)..(552): n is a, c, t, g, unknown, or other
gctctagaactagtggatcccccgggctgcaggaattcgcacgagaccattacctagaacatcctaatcgaaaaaaaaatctagccaaaaaagcccaaccaaaatgctgcctgcccgccccctcctcgtggccgccgccgtcttcctcctcctcctccccgttcacgtcgccatcgtcgccgcacaggggtttcgcggcttctcttacctcctaaactgtggcgcggcgtcccccaccaccgacagccgcggcctccgctgggatcccgatggcgactatgtctctgccggtacccccggcgtggtctcgctctcgggcctcatcaaccccacgcttgccacccttcgcaccttcccgctccgctacggggccaagttctgctacgagctccccgtggatcggaaccgccgctacctcatccgccccacattcttctacggcgcgctcttcgcctcctcctctgcaccgccgccgcccgtcttcgacctggaatcgtggacggtaccttcctggaccgccgtcaccaccaccgaatgacgcgctggccggnngccgcgcttcctaaaaggaagggcgtgttcccccggcgaagtggcaggaacattgagtttttgtggtctccggggtggaacccggacttatacccgacgcccaggcccatt

SEQ ID NO: 24063 - protein, 144 aa, Zea mays
  misc_feature: Ceres CLONE 1394930-F
MLPARPLLVAAAVFLLLLPVHVAIVAAQGFRGFSYLLNCGAASPTTDSRGLRWDPDGDYVSAGTPGVVSLSGLINPTLATLRTFPLRYGAKFCYELPVDRNRRYLIRPTFFYGALFASSSAPPPPVFDLESWTVPSWTAVTTTE

SEQ ID NO: 24064 - DNA, 661 bp, Zea mays
  misc_feature: Ceres CLONE 1394931-F
  misc_feature: Encodes the peptide sequence at SEQ ID NO. 24065
  misc_feature (661)..(661): n is a, c, t, g, unknown, or other
cgcggtggcggccgctctagaactagtggatcccccgggctgcaggaattcgcacgagaccattacctagaacatcctaatcgaaaaaccaaaatgtaagaaaacgcacgccccggcgctggccgctagtcaccccaaagctccgcctccgcaccttctctcactcgcccagccgcggctatggcggccaccacatccacggcggcggcggcagtatccttctccctcccctcaccaccgcactgccgcggggcccggcgccgccgcgcgccttccctcctccgtgccgcctccaccgccgcgcccccctcccccgacctctccatccagctctcgccccgcgcgtccccgcccgcgtctaccaacggcgccgccaccgcgcttggaccccccgtgtccgcctcctttgcccgtgaccgcgccgaggacctgcaggccgaggcccgcgcgatggcccgcgccgctggcgccacagtctacagtcccgagctcctcgccgcccgctacggatcccgccccttccaggaggcgctccgggcaggggaggagctgccccaagttgccggcccttcggggcgaaaggtcttaatggaacgagcggagaggggagtccgacaccggagaggaacgtgccgccagcgccgaggtaggatgcgcaccn

SEQ ID NO: 24065 - protein, 70 aa, Zea mays
  misc_feature: Ceres CLONE 1394931-F
MARAAGATVYSPELLAARYGSRPFQEALRAGEELPQVAGPSGRKVLMERAERGVRHRRGTCRQRRGRMRT

SEQ ID NO: 24066 - DNA, 697 bp, Zea mays
  misc_feature: Ceres CLONE 1394932-F
  misc_feature: Translation starting site: 191
  misc_feature (368)..(368): n is a, c, t, g, unknown, or other
  misc_feature (517)..(517): n is a, c, t, g, unknown, or other
  misc_feature (630)..(630): n is a, c, t, g, unknown, or other
  misc_feature (634)..(634): n is a, c, t, g, unknown, or other
  misc_feature (635)..(635): n is a, c, t, g, unknown, or other
  misc_feature (640)..(640): n is a, c, t, g, unknown, or other
aaagctggagctccccgcggtggcggccgctctagaactagtggatcccccgggctgcaggaattcgcacgagaccattacctagaacatcctaatcgaaaaatctcatatcattcgtctgttctgtccttgatgtgctaaacgcgtgcatgcaggcgcgatctgcgggccggcgagcctggtgaacgcgatgatggacctgcaggagggggcgctgatgctgctgggccccacgatgaacgccaaggtggcgttcgagctgtcggagcggctgccacacctgccgctgcggatgcaggagcactcgcgccgcgcgctggcgttcgccgagcggatgcaggggctgggcctgcgcgtgctgtacccgnggcctcccgggccacccgcaccacgcgcgcctggccgccatgggcaacccgggctacggctgcggcgggcatgctgtgcctcgacatggggcaccgaggagcgcgccaaccgcctcatgcaccacctccgaacaccaacccagttcggncctcatggccgtcagcctcggctactacgagacgctcatgtcctgctccggcagcacaccaggcagcgagaggccgcccgaggaccgcggcgcgcgcgggcatctccccgggntcgnnccccnaattggccgtcggctacaacgcacgctggaaacaggccttttggcccaattttcgac

SEQ ID NO: 24067 - DNA, 688 bp, Zea mays
  misc_feature: Ceres CLONE 1394936-F
  misc_feature: Encodes the peptide sequence at SEQ ID NO. 24068
  misc_feature (541)..(541): n is a, c, t, g, unknown, or other
  misc_feature (605)..(605): n is a, c, t, g, unknown, or other
aaagctggagctccccgcggtggcggccgctctagaactagtggatcccccgggctgcaggaattcgcacgagaccattacctagaacatccatcgaaaactaactacttccctgtacgtggacgaggaccaatgagacagagagaaagagctggacgcgtcgcccaccgtcgcctcgacagacggctccaccatcctccctccccatcgacttcacaaatccgatccagatctcctcgtcctctggaccattctcttcatctccatgcatggatgaacaagagacggagggagacagatgcaaacatcgagactggggttgttatctgtctttgtagcagaagaaacagtccgtaaaaaagaatggagagatcctcagataggagcaacgattctcatgggaaccacctgggttatgcaagaagtacatccctggattccactggtcctcagttagctgggacgtctagatcaatgttgagtaggacaagtatcatataggtatcaaggggatccatcagcctctcacgggagatggggnactccaaaatggagctcaatggaggcattctcttcagtcggcggatcaattgctaggagacatncgatgagctcagtctctggctaacttcatcgaaaggtgggtcgagttctatcacccgaaaaggcgatgttgatgaggatacaa

SEQ ID NO: 24068 - protein, 45 aa, Zea mays
  misc_feature: Ceres CLONE 1394936-F
MERSSDRSNDSHGNHLGYARSTSLDSTGPQLAGTSRSMLSRTSII

SEQ ID NO: 24069 - DNA, 554 bp, Zea mays
  misc_feature: Ceres CLONE 1394938-F
  misc_feature: Encodes the peptide sequence at SEQ ID NO. 24070
  misc_feature (283)..(283): n is a, c, t, g, unknown, or other
  misc_feature (313)..(313): n is a, c, t, g, unknown, or other
  misc_feature (425)..(425): n is a, c, t, g, unknown, or other
ggagctccccgcggtggcggccgctctagaactagtggatcccccgggctgcaggaattcgcacgagaccattacctagaacatcctaatcgaaaagccacctctaccactggcctcaatctgcaaaccctagccctcgtcgccggcggccatggccgagaccgtcgacgacaaggtcagctactttcaggccgtcaccggcatctccaacacggacctctgcacggagatcctcgccgcgcacaactgggacctgcagctcgcgggtgtccaccatcaccgnccaaccccctcctcgcccctccgcttcggncctccacctcctcgcgtgaccccggcccctttccgctccgttgggggtagatgcggagtacgtcggggccccgcccgccgctgtgccgtggcggttgccgcccccacaacanccgggagatcggggggaaaattgggggaagttccccccttccacggggttctccgggggggcgcccgccctcttcccccggaacaatttcccccctttgggggcccggggggaacccccgggggggggg

SEQ ID NO: 24070 - protein, 134 aa, Zea mays
  misc_feature: Ceres CLONE 1394938-F
  misc_feature (92)..(92): Xaa is any aa, unknown, or other
MAETVDDKVSYFQAVTGISNTDLCTEILAAHNWDLQLAGVHHHRPTPSSPLRFGPPPPRVTPAPFRSVGGRCGVRRGPARRCAVAVAAPTTXGRSGGKLGEVPPFHGVLRGGARPLPPEQFPPFGGPGGTPGGG

SEQ ID NO: 24071 - DNA, 745 bp, Zea mays
  misc_feature: Ceres CLONE 1394939-F
  misc_feature: Encodes the peptide sequence at SEQ ID NO. 24072
  misc_feature (655)..(655): n is a, c, t, g, unknown, or other
  misc_feature (711)..(711): n is a, c, t, g, unknown, or other
  misc_feature (714)..(714): n is a, c, t, g, unknown, or other
tggagctccccgcggtggcggccgctctataactagtggatcccccgggctgcaggaattcgcacgagaccattacctagaacatcctaatcgaaaaaccgtctcttctgttctgccctgctcgtgctcgtgcattcacccaccggggcgggcgtctctctcaccgccttgccacgccagcacgccactgtgctctgcctctgctcgactgctcctccatattaagaggccctcccgcgcgcccgcctctcgccgtgctcgtcgtcccttcgttacccgggtcagtgccgccgtcggtagcagaggagcagtaggtggccagtcagtcagccaattgtccgctcgtccactccgttcgagctctcctactcttcaccacccacccatccatccatccatccatcggcgagcgcgagagcacactgttgcattgctgatcgctccgtctccgctgccgacgaggacgaggaagaacgagggagagacgcagacaggctgcgttgcgccatgaggagagcaggggggctatcgcgcgcgggccacggcgcggcgccggcggcgggggtcatgcgggcggcggcgtccgcgttcttcgcggggtaccactgcttcacctccgtggcggcgctgctggcgctgccgttctcgccggcgntgctggtggccgaggcggtcgtcggcgtcaccagcgcccgcgccagtggcgctggncgnggttagcggtgcgggtgggcgccgtagttcc

SEQ ID NO: 24072 - protein, 70 aa, Zea mays
  misc_feature: Ceres CLONE 1394939-F
  misc_feature (50)..(50): Xaa is any aa, unknown, or other
MRRAGGLSRAGHGAAPAAGVMRAAASAFFAGYHCFTSVAALLALPFSPAXLVAEAVVGVTSARASGAGRG

SEQ ID NO: 24073 - DNA, 669 bp, Zea mays
  misc_feature: Ceres CLONE 1394945-F
  misc_feature: Encodes the peptide sequence at SEQ ID NO. 24074
caaagctggagctccccgcggtggcggccgctctagaactagtggatcccccgggctgcaggaattcgcacgagaccattacctagaacatcctaatcgaaaaaatgaccattgcgtgatagatcgcaccggtctcggtctccgtgtctcactctcaagttgcagcagccagtcatttcgttggcaaccagggcagaaataaatatccgtggataagagctgcgctgtgtgctgctgagatatcaagaacggtagggtggaagacaaggccccgttctcgattaacccaagcaaaggagtcagagggagagagagagagagagtcgtattggtcgtcacctgtcgaaggttttcggtgtctcctgagccacagctgctgctgctgctggaaccatggagatggaggccgtggagtcgcacggcggcgccggtcgccggacgcccaagagggatcgcggcatctcctgggcctgcgtcttcatcctggcgagtaactgcttccagttcatcgcctacttcgccgtgtcgacgaacctggtgaactacctcaaggaccgcctgcaccagggcagcaaagccgccgcgaacggcgcacccaactggatgggcacgagcgccatcacgccgctcgtcgccgccttcctcgccgacgctttcctcggcagatac

SEQ ID NO: 24074 - protein, 92 aa, Zea mays
  misc_feature: Ceres CLONE 1394945-F
MEMEAVESHGGAGRRTPKRDRGISWACVFILASNCFQFIAYFAVSTNLVNYLKDRLHQGSKAAANGAPNWMGTSAITPLVAAFLADAFLGRY

SEQ ID NO: 24075 - DNA, 928 bp, Zea mays
  misc_feature: Ceres CLONE 1394948-R
ggccccgctgggggcgcctgaatcctaccccctctgctttgtttgaggtgtaacataccgctcagcctcacacttgggatcactcataatactccctgtaaaagttcctaatttcaaagcagactgcattaacgttatcctggtcaatctcacaagagatctgtccaattgaagttacaaatcagaaaaggttgaagaatcaagcttactccttgtgctctctgcctttctttctcttccatttgagatatatttggatagagaggcctaagaagaccatcacagcactaccccattgcttcaaaagataatggattgccactgatggacggatggaaaccacaatggctcatgaatttacggggggtaggtgattgtcgtgttagtaagaaaagcacacccggctgaatggttagaaaggatggaagatcctacccccacggggccacttgtggctgtaatagggaaaaatggccccaaggcccccttctgggggggtcctcctggaaaaattttccaatgccctgcaaaaacccatggttggaatattggccaagtttactgggaaataggaatttgtgtgggctccaatccttgtcttacccctctgttatattcttttgcgccccccccagaaaggggtttcatggccaaaagccattaaatatatcccagagggggggatgtctttttctggggtaccgcgggaactttcttgttaaaactccccggggggacggtggtgtggtcctccccccccctcctaaaaactctaagggttgtgggaaccccccatgtgggggtttgaccataaaaagtgtggcctctctaggggtggaggcaagatagctttttttaggtgcgcgctgcgaggggaggggggctctctggagtacacggcgataggagggagaaccgcccacccgcg

SEQ ID NO: 24076 - DNA, 727 bp, Zea mays
  misc_feature: Ceres CLONE 1394952-F
  misc_feature: Encodes the peptide sequence at SEQ ID NO. 24077
  misc_feature (631)..(631): n is a, c, t, g, unknown, or other
cgctctagaactagtggatcccccgggctgcaggaattcgcacgagaccatacctaaaacatcctaatcgaaaaaggacagcgtttagatttatcacttcgttgattatttgatcgaatcagagctccaaacatcgcaatcaaagatcgtctggtcgcacggatcgacagggcgggggcgcgggcaaggttggcaatggcgaacaaggccgtctcgggggcgcggagcccgctgaacctggtggtggccatggcgctgtgctgcttcttctacgtgctcggcgcgtggtagcgcagcggctacggcaagggcgatcgcatcgccgccgcggtgagccggcagacggactgcggcgacgtcgccgcggtgctcagattcgagacgcaccacggcggagccggagacatcaacgcgtcgtcgtcgctgcccttcggggccgacgcggcgccgccggcgttcgcgacgtgcgcggaggcgctagcggaccacacgccgtgccaccaccaggaccgcgccatgaagttcccccgcaagaacatggtgtaccgagagcggcactgcccctccgacggtgagcggctgcggtgcctggtgcccgcgccgccggagtacgtgacgccgttcgcgtggncccggagccgcgactacgtgtacttcgccaacgcgccgtacaagagcctctacgtcgagaaggcgtccataactgggtgcagtactagggctgcgc

SEQ ID NO: 24077 - protein, 70 aa, Zea mays
  misc_feature: Ceres CLONE 1394952-F
  misc_feature (39)..(39): Xaa is any aa, unknown, or other
MKFPRKNMVYRERHCPSDGERLRCLVPAPPEYVTPFAWXRSRDYVYFANAPYKSLYVEKASITGCSTRAA

SEQ ID NO: 24078 - DNA, 647 bp, Zea mays
  misc_feature: Ceres CLONE 1394956-F
  misc_feature: Encodes the peptide sequence at SEQ ID NO. 24079
  misc_feature (470)..(470): n is a, c, t, g, unknown, or other
cggtggcggccgctctagaactagtggatcccccgggctgcaggaattcgcacgagaccattacctagaacatcctaatcgcaaagtcgtcgtccactcgttcgtcgctgctccctcctccaccaccttccagtcctgtccagtgccgccgccttgccctgccctcccctcccttcccccgattaccctcgcggttgacctcgccaatccggtcccgcctccgtataaatccgcccttctcgcccccgctccgaccacaaaccctagcggcgcgccccggcatgggctagggttcccgcggcgatggagtgggacagcgattctgacggcggcgatgacgaggaggaagaagaggccgccccgggggtggggacgggggcccggggttctcgctggccatcgagggcgtgctgggcgcggcggccatggtggtctccgacgcgctcgagcccgacttcccatcatctagnaaaaccgcgggttcgagagctcactgatacagcgcccgaagaggtgctgggaaggaactggccggtcctacaatgcaaaggaccttttgctcagaggagcatccccttggtggaggcggcagtggtacaagaatccggaaaagtttaaagggaggactggattttttgggggattgg

SEQ ID NO: 24079 - protein, 104 aa, Zea mays
  misc_feature: Ceres CLONE 1394956-F
  misc_feature (56)..(56): Xaa is any aa, unknown, or other
MEWDSDSDGGDDEEEEEAAPGVGTGARGSRWPSRACWARRPWWSPTRSSPTSHHLXKPRVRELTDTAPEEVLGRNWPVLQCKGPFAQRSIPLVEAAVVQESGKV

SEQ ID NO: 24080 - DNA, 682 bp, Zea mays
  misc_feature: Ceres CLONE 1394957-F
  misc_feature: Encodes the peptide sequence at SEQ ID NO. 24081
  misc_feature (636)..(636): n is a, c, t, g, unknown, or other
tggagctccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcggtgtcgacggcctcccgccggggcctccgggttggccggtggtggggaacctgttccaggtgatcctgcagcgacggcccttcatgtacgtggtgcgcgacctccgggagaagtacgggcccatcttcaccatgcggatggggcagcgcaccctcatcgtggtcacctcggcggagctcatccacgaggcgctggtgaagcagggccccatgttcgcgagccggcccgaggacagccccacccgcctcctcttcagcgtcggcaagtgcaccgtcaactcggcgccctacggcccccctgtggcgtgctctgcgccgcaacttcgtcgnccgagatcgtgtccccgcaccgcgtcaaggcttctcctgggaaacc

SEQ ID NO: 24081 - protein, 152 aa, Zea mays
  misc_feature: Ceres CLONE 1394957-F
  misc_feature: SWISSPROT Homolog: EC 1.14.99.9 Steroid 17-alpha-monooxygenase
MDVNDVLLVVLAAALAAMWWRRCSKTGGVDGLPPGPPGWPVVGNLFQVILQRRPFMYVVRDLREKYGPIFTMRMGQRTLIVVTSAELIHEALVKQGPMFASRPEDSPTRLLFSVGKCTVNSAPYGPPVACSAPQLRRPRSCPRTASRLLLGN

SEQ ID NO: 24082 - DNA, 834 bp, Zea mays
  misc_feature: Ceres CLONE 1394958-F
  misc_feature (47)..(47): n is a, c, t, g, unknown, or other
  misc_feature (48)..(48): n is a, c, t, g, unknown, or other
  misc_feature (76)..(76): n is a, c, t, g, unknown, or other
ggagccccccgcgggcccccccccccccccccccccccccgaacacnnccacagtggagctccccgcgggggcggncggtcaatacgtagaggggcccccgggctgcaggatttcgcacgagaccattacctagaacatcctaatcgaaaaagtccggcgcgggagctccccgccaaccgcctccgccccgtctccgtgtccccggcgggcctcgctcgtcactcggagtctcggagacaggcgccagcgcctcgagccggcgaagccagccgggtccatgggcggcggagccgtgcgaccgcctcgggcggcccgggtggcgctcgacggcgccctctccggcgggtcgtccgagcaactgtctctcctcggcccctccgatcggctcccgcaggcagcggctgctggtgctgggggtgcggcgccgggaggcgaggggaccagaacctcacgggatccccccggcgactgtagccgccccgcaagcggcgcggggtggacgtaatggccccaccacacgaggacgaacagcggcgatgcccgtctgcggttccggcgggggggggggaagcccgaagaggcgccgcgcgccgggaggcgccaagcgtgggcgggaagctgggcgaacgcgcggggcgcccccgtggccggcgggggggcagacgctggcggctacgggccccgggagtgtcgttgggcggcccggggcctgaggtgggcacagaagttggcgaggggaaaggcgggccccacggagggcgggggagccgggaccggacgccgcggccgatacacgtttaaccccccggaaaccggaaccccgccggtgccag

SEQ ID NO: 24083 - DNA, 710 bp, Zea mays
  misc_feature: Ceres CLONE 1394963-F
  misc_feature: Encodes the peptide sequence at SEQ ID NO. 24084
  misc_feature (640)..(640): n is a, c, t, g, unknown, or other
  misc_feature (695)..(695): n is a, c, t, g, unknown, or other
  misc_feature (710)..(710): n is a, c, t, g, unknown, or other
cgctcagaactagtggatcccccgggctgcaggaattcgcacgagaccattacctagaacatcctaatcgaaaaaccatcatcacactcgaaacccaacagcttccttcctggagatccaattaacggcttctcttctgagctcagcacgaacaatggccaccatcctcaccgtcgcaagcttctgtctgacttgtgtgcatctctcaacaagcgagggctgcgaactacacgttcatgaaggaagaggtgcacgcgccgcgtacgggcttctaccactacatcataatcggcggcgagacagcgggatgcccgctggcggccaccctgtcggcccgcgcgcgagtgctgctgctggagcgcggcggctctccggacgaggacgcgcgcgtcctgaacatggcccacttctcggacgtgctgggggacacgtcggtgtcgtccccatcgcatcggctcgtgtcagaggacggcgtgatcaactcccgaccgcgcgtgctgggcggcggcagctgcatcaacgccggtttcttcacgcgcgacggtgcgggctacgtcagggccgccggctgggaccccaggaaggtgcgcgcgtcgtaccggtgggcggacgacgtggtcacgtctcgcccggctctggntccgtggcatgtcgccgaagcggatgggcctgctgggagatccgcgcgctgcatngacaacgctcacacn

SEQ ID NO: 24084 - protein, 158 aa, Zea mays
  misc_feature: Ceres CLONE 1394963-F
  misc_feature: SWISSPROT Homolog: EC 4.1.2.10 Mandelonitrile lyase
  misc_feature (135)..(135): Xaa is any aa, unknown, or other
  misc_feature (153)..(153): Xaa is any aa, unknown, or other
MKEEVHAPRTGFYHYIIIGGETAGCPLAATLSARARVLLLERGGSPDEDARVLNMAHFSDVLGDTSVSSPSHRLVSEDGVINSRPRVLGGGSCINAGFFTRDGAGYVRAAGWDPRKVRASYRWADDVVTSRPALXPWHVAEADGPAGRSARCXDNAHT

SEQ ID NO: 24085 - DNA, 671 bp, Zea mays
  misc_feature: Ceres CLONE 1394965-F
  misc_feature: Encodes the peptide sequence at SEQ ID NO. 24086
  misc_feature (484)..(484): n is a, c, t, g, unknown, or other
gctctagaactagtggatcccccgggctgcaggaattcgcacgagaccattacctagaacatcctaatctaaaactcttcgtcgtcctatcttataatcgcatttcgaaatccccaaacggaggcctcgccactcttccgaacctgaacaatcaccaccgttattaagaagatgatgcgctgcgctgcaacgggcggcgggtgcgtcgcttcgtggagcggcgattggagattgccggcggtcaacccctgcagcgtgcggatgccgacgggcaacgatgggtggtgcgccggcctgaggtcgcgggcggcggatctcgccggcctcgagatggccaacctgcgcggcggcgtcggggggctcttccgcgcgagcccgcgctacgggcgcttgcaagccacggcggcagttgaccctgaagatattcaattggaggaaggttcaagttaaatcctcaggacatgttctgccatatgttggcggntgctttgtttgggggctaatttctgtttggtaccatcctttggtggtggtcaatggcgcacttgatatcttcgcggaaggaatcttgggattgcttgaaagctgtcttgtgagggaggtggggggggggtaaccacatcccttggctgtgggaaacccctaggcttttttttaatggggggggctct

SEQ ID NO: 24086 - protein, 92 aa, Zea mays
  misc_feature: Ceres CLONE 1394965-F
MMRCAATGGGCVASWSGDWRLPAVNPCSVRMPTGNDGWCAGLRSRAADLAGLEMANLRGGVGGLFRASPRYGRLQATAAVDPEDIQLEEGSS

SEQ ID NO: 24087 - DNA, 853 bp, Zea mays
  misc_feature: Ceres CLONE 1394966-F
  misc_feature (22)..(22): n is a, c, t, g, unknown, or other
  misc_feature (23)..(23): n is a, c, t, g, unknown, or other
  misc_feature (26)..(26): n is a, c, t, g, unknown, or other
  misc_feature (33)..(33): n is a, c, t, g, unknown, or other
  misc_feature (36)..(36): n is a, c, t, g, unknown, or other
  misc_feature (41)..(41): n is a, c, t, g, unknown, or other
  misc_feature (42)..(42): n is a, c, t, g, unknown, or other
gtccctccccccctcccttttnnatnaccaaantanaaaannggtgcaaagtggagctccccgcggtggcggccgctctagaactagtggatcccccgggctgcaggaattcgcacgagacctttacctagaacatcctaatcgaaaaaccggtggtatcgccgcgccgcgtcgtcgcggacctccagccgcggcccgcccccatcatatccatcgcccgcggttttttcaccacacgacccactggcgctgcctttattctagcgtgccggctctgctcccctcgcatggtcctgctcattcccagccgcgccgccggctcctgcccgctttcctcggcgcaaggccgggactccgacaggagacttcgggcgtggatttaaggatataccccccacagccggacccggccctcgccgcgaaaggccgaaccgtgtatcccgctcctcatccctggtacctgtctgctaagctgcctggctgcctgtcccgcggccgtcccggtccccccgcgacgggacggaggaggagggggcacggggcaccccgatgccccggcccacgggaccacgagcacaactatgtacagcgatgcgctcggctgcccccctcggccccgccccccagccgccccccgccccgcccccacaccaccgcgcgcccccacagccccgcttccggcaccgcctggtttttccgatgactcagaaccttccgactccctgctgccctcagtacccaattgggacatgcagcaagcaccggcaacatagcccgccgggacccatgggtaaggcgccacacacaactcgtgatgcacctacacaccacacttaccggggcgcgccccgcc

SEQ ID NO: 24088 - DNA, 709 bp, Zea mays
  misc_feature: Ceres CLONE 1394967-F
  misc_feature: Encodes the peptide sequence at SEQ ID NO. 24089
gctctagaactagtggatcccccgggctgcaggaattcgcacgagaccattacctagaacatcctaatcgaaaaatcttgctttgatcctctggcccgtggacatggcgtcgtccatgctctccgctaccaccgtgacactccatgagggggcggcgctgtccgagctctctggtctcatgagctccgcgtctgtgcccatgctccggaatggcacctccgacgacttcgtgtccgccgtctccttcaggacccacgcggctgttacgaggggctggccgcgacggctgtcgacgcaggcgaagctgaaggtgtgcatcaatggcgtcggccgcatcgaacgcaacttcctgcgatgctggcacggacgcggcgacgcctcgcccctcgacgtcatcgccatcaacgacaccggaggcgtcaagcaggggtcccacctgatcaagtacgactcctcgctcggcatcttcgatggcgacgtcaagcccgtcggcgacaactccatctgcgtcgacggctaggtcatcaaggtcgtgtccgatcgcaaccccaggaacctgacgtggtgcgagctcggcatcgacctcgtcatcgagggtaccggtgtcttcgtctaccgcgagggctaggctaagcacatccaggcgtgtgacaagaaggtgctcatcacggagcccggcaagagcgacatccccatctacgtcgtagga

SEQ ID NO: 24089 - protein, 138 aa, Zea mays
  misc_feature: Ceres CLONE 1394967-F
  misc_feature (68)..(139): Pfam Name: Gp_dh_N Pfam Description: Glyceraldehyde 3-phosphate dehydrogenase, NAD binding domain
  misc_feature: SWISSPROT Homolog: EC 1.2.1.13 Glyceraldehyde-3-phosphate dehydrogenase (NADP(+)) (phosphorylating)
MASSMLSATTVTLHEGAALSELSGLMSSASVPMLRNGTSDDFVSAVSFRTHAAVTRGWPRRLSTQAKLKVCINGVGRIERNFLRCWHGRGDASPLDVIAINDTGGVKQGSHLIKYDSSLGIFDGDVKPVGDNSICVDG

SEQ ID NO: 24090 - DNA, 643 bp, Zea mays
  misc_feature: Ceres CLONE 1394968-F
  misc_feature: Encodes the peptide sequence at SEQ ID NO. 24091
  misc_feature (78)..(78): n is a, c, t, g, unknown, or other
  misc_feature (171)..(171): n is a, c, t, g, unknown, or other
  misc_feature (305)..(305): n is a, c, t, g, unknown, or other
  misc_feature (467)..(467): n is a, c, t, g, unknown, or other
  misc_feature (601)..(601): n is a, c, t, g, unknown, or other
gctctagaactagtggatcccccgggctgcaggaattcgcacgagaccattacctagaacatcctaatcgaaaatccnagaagagcacgcccactcctccggctcttcttctccaccggcaccagtccaccacctcctgccaccgcgcggccccaaccaaccacaccgcancgcagcaatggcgggcaacggcgccctcgtggagagcgacccgctgaactggggcgcggcggcggcggagctggccgggagccacctggacgaggtgaagcgcatggtggcgcaggcccggcagcccgtggtgnaagatcgagggctccaccctccgcgtcggccagggtggccgccgtcgcctccgccaaggacgcgccggggccgtcgctgtcgagctccgacgaggaggcccgcccccgcgtcaaggcccagcagcgagtggatcctcgactgcatcgcccacggcggcgacnatctacggcgtcaccacccggcttcggcggcacctcccaccgccgcaaccaaggacgggcccgcgctccaggtcgagctgctcaggcatctcaacgccggaatcttcggccccggcagcgacgggaacctgttncccctcggagtcacccgcgcgggggaatgttggtgcgcatcc

SEQ ID NO: 24091 - protein, 155 aa, Zea mays
  misc_feature: Ceres CLONE 1394968-F
  misc_feature: SWISSPROT Homolog: EC 4.3.1.5 Phenylalanine ammonia-lyase
  misc_feature (43)..(43): Xaa is any aa, unknown, or other
  misc_feature (97)..(97): Xaa is any aa, unknown, or other
  misc_feature (141)..(141): Xaa is any aa, unknown, or other
MAGNGALVESDPLNWGAAAAELAGSHLDEVKRMVAQARQPVVXDRGLHPPRRPGWPPSPPPRTRRGRRCRAPTRRPAPASRPSSEWILDCIAHGGDXLRRHHPASAAPPTAATKDGPALQVELLRHLNAGIFGPGSDGNLXPLGVTRAGECWCAS

SEQ ID NO: 24092 - DNA, 569 bp, Zea mays
  misc_feature: Ceres CLONE 1394970-F
  misc_feature (261)..(261): n is a, c, t, g, unknown, or other
aaagctggagctccccgcggtggcggccgctctagaactagtggatcccccgggctgcaggaattcgcacgagaccattacctagaacatcctaatcaaaactttctgctgcccagccgccgtccgtccgcgcttcactatccttcattccctcccctgtcagcgacgactgggtaggctaccgccgccgccctacgctaggtgcccatctcttcgccggcgaagagcgcccaccaagctccggccaaggggcgtgatggncgctggtagcagctttgaacccgggaatggaaactcttcatgtgcaggactacaaggacgcgctccgccaaggccggaaaaagctccacggcatgaaaactgctgggcagatacaggaaccccccgcccagggggggcccccccccaaggaatttacccggggggaaaaccgggggggggaaacaggggggaaaggtttttggggtttcccctttttccataaaccatgggggtgggggggacccccccccggccgggggggggcaaaacccccttgggggacacttgggggaagaaaagggtttccc

SEQ ID NO: 24093 - DNA, 626 bp, Zea mays
  misc_feature: Ceres CLONE 1394973-F
  misc_feature: Translation starting site: 205
  misc_feature: Pfam Name: Tic22 Pfam Description: Tic22-like family
  misc_feature (480)..(480): n is a, c, t, g, unknown, or other
  misc_feature (573)..(573): n is a, c, t, g, unknown, or other
  misc_feature (603)..(603): n is a, c, t, g, unknown, or other
aaagctggagctccccgcggtggcggccgctctagaactagtggatcccccgggctgcaggaattcgcacgagaccattacctagaacatcctaatcgaaaaatcttcttcctcgtgcgcgtgcagccgccttgcttgcggccctgcctctctcctctcctgctctcccaccggccaccgtcgccggccgccaccgtcgccgccatgcctttccgattccagttcccatggctcaagaacccaactacaaacggcggcacctccaacatagacactaaccctagcccccgcttccccaaccccttcctccctatccagcccatgtcacctccttcttctcctccttcccccgggcgctcccgccgccgccgccctgggcgcgcatcacctcgccagcctccacctccggggccctacctacctctgagatcgaggagcggctcgccggggtgcccgtgtacgcgctcgccaacgccgccnaagagttcgtgcttgtgtcgtccacacgcgtgggaaggcagggggcgagagcgtgagtccaacgcccgcgctcgggctgctctgcttccgaangaagatgctgacgcgctgcttgaaaaatgnatggcgattgcgcgccggctctt

SEQ ID NO: 24094 - DNA, 711 bp, Zea mays
  misc_feature: Ceres CLONE 1394980-F
  misc_feature: Encodes the peptide sequence at SEQ ID NO. 24095
gctctagaactagtggatcccccgggctgcaggaattcgcacgagaccattacctagaacatcctaatcgaaaacttgccttcgtctccgcctcccgtctttcctcaagaagtcgattcccttccccaagaacccaagcccccaccatgacaagctcctcctctccttcccgaaaggagctgagcaagatcgcttgcaatcggatgcacaaggaactcgacgagtggcaactcaacccccctgctggattcaagcacaaggtctccgataacctacaaaggtgggtaattgaggtcactggagcgggggccaccctttacgccggcgagacctaccagttgcaggttgacttccctgagcattatcctatggaggcacctcatgtcatttttctcaatccagcgccaatgcatccacacatctacaggaacgggaacatctgcttagatattttgtatgactcgtggtctccagcgatgaccgtgagctctgtctgtatcaggatcctgtctatgttgtctagctcgccagcaaagcaacgtccagtggacaatgaccgctatgtcaggaactgccgcaacgcgaggtcgccgaaggagaccagatggtggctgcatgacgacacggtgtaattgagcgcctgacagccttccttgctgaggtatatcttgtcaaggcgagatcggcgatgatttacgtctatttgtaaga

SEQ ID NO: 24095 - protein, 161 aa, Zea mays
  misc_feature: Ceres CLONE 1394980-F
  misc_feature (19)..(158): Pfam Name: UQ_con Pfam Description: Ubiquitin-conjugating enzyme
  misc_feature: SWISSPROT Homolog: EC 6.3.2.19 Ubiquitin--protein ligase
MTSSSSPSRKELSKIACNRMHKELDEWQLNPPAGFKHKVSDNLQRWVIEVTGAGATLYAGETYQLQVDFPEHYPMEAPHVIFLNPAPMHPHIYRNGNICLDILYDSWSPAMTVSSVCIRILSMLSSSPAKQRPVDNDRYVRNCRNARSPKETRWWLHDDTV

SEQ ID NO: 24096 - DNA, 523 bp, Zea mays
  misc_feature: Ceres CLONE 1394983-F
  misc_feature (225)..(225): n is a, c, t, g, unknown, or other
  misc_feature (237)..(237): n is a, c, t, g, unknown, or other
  misc_feature (309)..(309): n is a, c, t, g, unknown, or other
  misc_feature (317)..(317): n is a, c, t, g, unknown, or other
  misc_feature (320)..(320): n is a, c, t, g, unknown, or other
  misc_feature (328)..(328): n is a, c, t, g, unknown, or other
tcaccgcggtggcggccgctctagaactagtggatcccccgggctgcaggaattcgcacgagaccattacctagaacatcctaatcgaaaaatccaatacccccacgaacccactctctctccccacgatggcaaaaatggcgatggcgtcctcccgcctcccggctctcctctgcctcgccgccgtcgccgtcgccgtcgcggcggaggccgccgccgccgccnggagaaggcggnctccgctgcccgcgacgcacgtcccggggcgcaggcgagcggtcatcgcgcgtcaactcctgctaagagaangagcgggncgncgcggcgncgcgacggcccagcgtgcggcccgggagagtccaaaagggtccggcccggttgccggggggccccccccggggttcggggaaaattcgggcaacacaaagggggggaaaaatttttcccccgggggggggaaaaaacaagggaggccaaaaaaagggttttttttttttttttttctaaaaaggggggggggaaa

SEQ ID NO: 24097 - DNA, 543 bp, Zea mays
  misc_feature: Ceres CLONE 1394985-F
  misc_feature (95)..(95): n is a, c, t, g, unknown, or other
  misc_feature (250)..(250): n is a, c, t, g, unknown, or other
aagctggagctcaccgcggtggcggccgctctataactagtggatcccccgggctgcaggaattcgcacgagaccattacctagaacatcctaantcgaaaaaaaagcactcgcgagctgctgccatggcaggcgccggtgcgcccgcagttccccaggccggtcgcccagcccccaactttcgacgtcatcgtgggtgggcgccggcatcatgggcagctgcacggcgcacgcggcagcgtctcgcggncgcccgcggtcctggctgcttgaaagggtttcaaccttggtccacccgttggggttctccgaaggggaatcccgatttttccggaagcatatcgaagccggggaccccccagtgggggccccccccccccccttgggcccccccaaaaccaaaacctataccgggggtccccccgagcccccctctcctgggccccggggaaaaggttttttttgcgcgcccatataaaaatgtggggggggggggggggggaggaaccccctttcccgggggggggggggggcctctcctcc

SEQ ID NO: 24098 - DNA, 680 bp, Zea mays
  misc_feature: Ceres CLONE 1394990-F
  misc_feature: Encodes the peptide sequence at SEQ ID NO. 24099
  misc_feature (500)..(500): n is a, c, t, g, unknown, or other
  misc_feature (604)..(604): n is a, c, t, g, unknown, or other
cgcggtggcggccgctctagaactagtggatcccccgggctgcaggaattcgcacgagaccattacctagaacatcctaatcgaaaagaatgatcatttcatcctcgcagtcgcagacatacattgtcccgttctctcgcggcgggcgcctgacgatctcgtcctccgcgtccgccctcctcgttgcccacgcacgcctgaaggcgacggcggcgctggctgcgcggaggaagcccgagcggacattccgtttgctcgcaggccggattgcaaggccccctctcccaaattgcaaggatagtcaggaagctaattaacagtgttcgaaagatggtccaccgcgagccggccgaggcggcggcggcggcagcagcaggaggcgagaccagcatctctacgcagcctccctcatcatcccagcaggctgcgccaccaccggccgtgttagtgtacaaggtcgggtatcctccccggaggagctgggccacggagttcaccangcacgctgagggagaccttcttccacgacagcccgctgaagcagtgcagggacccagtccgtgtccacgaagctccagatgggcctgcagtcttggtcccgggntctttgggtttgggggcagaacctacagcctgagcagttttcaggggcgattcctcgtttgccggggctgacaatg

SEQ ID NO: 24099 - protein, 34 aa, Zea mays
  misc_feature: Ceres CLONE 1394990-F
  misc_feature (9)..(9): Xaa is any aa, unknown, or other
MGLQSWSRXLWVWGQNLQPEQFSGAIPRLPGLTM

SEQ ID NO: 24100 - DNA, 766 bp, Zea mays
  misc_feature: Ceres CLONE 1394994-F
  misc_feature: Encodes the peptide sequence at SEQ ID NO. 24101
  misc_feature (732)..(732): n is a, c, t, g, unknown, or other
  misc_feature (733)..(733): n is a, c, t, g, unknown, or other
aaagctggagctccccgcggtggcggccgctctagaactagtggatcccccgggctgcaggaattcgcacgagaccattacctagaacatcctaatcgaaaactccctccctcctccattggactgcttgctccctgttgaccattgggtattctgaaccatcgagccatggctgccaagctgactcgcctccacagtcttcgcgaacgccttggttgcaccttctcctcccatcccaatgaactgatagcactctttttccagtattgtcacccagggcaagggattgcttcagggccatcagctgctggcggagtttgatgccctgtttgtaagtgacaagggaaaatttgccccctttaaaaaatttttcccggcgtgctgaaaaaaaaattggcccccccccagggggtgcctttttataaaaggcaaaggggggggggggggaataaattccgggaaaaaaaaaaaaaacccccttgtggggaaaaaaaagaattcttttttaaaaacttgtttttaaaaaaaaaaggggggggggggaaaaaaaccaaacaaaaccgttgggggggggggggttttttggaaacacaaagggcgcctcttctcccccccccccgcgcgggggggcacccgggagggggggggggccttctcttccccccccccccccccccccctttttctttaaacaaaaaaaaagaaaaacgcccccctctcgtgtttttctcnngggggccaaattaaaccagccgcgggggggggg

SEQ ID NO: 24101 - protein, 50 aa, Zea mays
  misc_feature: Ceres CLONE 1394994-F
  misc_feature: SWISSPROT Homolog: EC 2.4.1.13 Sucrose synthase
MAAKLTRLHSLRERLGCTFSSHPNELIALFFQYCHPGQGIASGPSAAGGV

SEQ ID NO: 24102 - DNA, 732 bp, Zea mays
  misc_feature: Ceres CLONE 1395000-F
  misc_feature: Translation starting site: 277
  misc_feature: SWISSPROT Homolog: EC 5.4.2.1 Phosphoglycerate mutase
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (25)..(25): n is a, c, t, g, unknown, or other
  misc_feature (34)..(34): n is a, c, t, g, unknown, or other
  misc_feature (61)..(61): n is a, c, t, g, unknown, or other
gggaaaccccccccccccnnnctanttcagagtncatcaagacgcgcgcatccaccacttnaactccccgcggtggcggccgctctagaactagtggatcccccgggctgcaggaattcgcacgagaccattacctagaacatcctaatcgaaaaataatatcgccgcggcctcgcacctccatctgttctatatcgccccattgctcgctcgccaagagttcttcttgttaggcaaggcaaaagcagaagcaaaaaaagaaaggtcttgttgccgatggggagctcagggttctcgtggacgcttccggaccaccccaagctccccaaggggaaaccggtggctgtcgtcgtgctggacggatggggcgaggccaaccccgaccagtacaactgcatccatgtcgctcagactcctgtcatggactcgctaaagaatggcgctcctgagaaatggagactagtgaaggctcatggaaacagctgtgggtctcccatctgatgatgacatggcaaccagtgaagttggtccaatggcacttggtgctgggtcgaattttcgcccaaggtgctaaagctttgtcgatcaagctcttgcctccggaaagattatggagggggaaatgggttcaactacatcaaagatctttttggaaaggggatcttcccctttaattgggttttaaaaaaaaaggggggggggtccccctccccgcctggatcaagtggaaag

SEQ ID NO: 24103 - DNA, 678 bp, Zea mays
  misc_feature: Ceres CLONE 1395001-F
  misc_feature: Translation starting site: 266
cgcggtggcggccgctctagaactagtggatcccccgggctgcaggaattcgcacgagaccattacctagaacatcctaatcgaaaaaattcgaagccttcccggttaccccttcggcctccacctatcaccacccgggacgtcttccatggcctcctcgtagtagaatagctctatctcaccgcaacaactcctcattacatcctttatgagaggctgatcgattggtagatacgtactcgggtggagcagaacaacgagagacatggcgacgacgacgcgtgttgccgccaccgccgccggcgtgctgctggtcctgtcggcgttggcgaccctggcgcgggccgaggacccgtacctgttcttcgagtggaaggtgacgtacgggaccaagtccctgctgggcgtgccccagaaggtcatcctcatcaacggcgagttccccggccccaggatcaactgctcctccaacaacaacattcgtcgtcaatgtcttcaaccagctcgaccatccgctccttttcacctgggaacgggatgcagcacaggaagaaactcgttggattggacgggatgcagggcacggcagtggtccgatcctgcctaacaccaatttcacgtacaagtggcagcccaaggggaccagatcggcagcttctttctacttcccgtcctggg

SEQ ID NO: 24104 - DNA, 669 bp, Zea mays
  misc_feature: Ceres CLONE 1395001-R
  misc_feature: SWISSPROT Homolog: EC 1.10.3.3 L-ascorbate oxidase
cgattgggtaccgggccccccctcaaggtcgacggtatcgataagcttttttttttttttttttgtaacgatagaacatgcatacccaatgacttgctggtggaaataaatggtgagataaagttatatatataactcccattacatgattttttgagaaccccggtacagagatttgagagggcatgcatctcaatactatatatatccactcatgcttctttcgtatttgttcttttgagtttggattggatggtcagaccacgaggagaaaacgaggccttcgtcatcttagcgcgcgggggcgtaggacggcggcagcggcagccccacgaccttgccgcagcggagggcgttgtcgggcatgttgtactcgtcgcgcagtgatcgcgccggcgagacgacgctgatgtagaactgctccccgaggtagtaccgctcccagatgttggaatgcacgctccacatgcccgcgttgtcgaacgtcagcatgattgccgtccatgaccgcgggtacacctggatcgtgtgccggctcaccgtgtccagcaggttgtacgtcttcctcacctccggcgaccacttcccggggcccatcccgacgccgaagaaggcgtagccatcgacgtggagggagtctatgctcttctctgggttctcgaagacgat

SEQ ID NO: 24105 - DNA, 635 bp, Zea mays
  misc_feature: Ceres CLONE 1395002-F
  misc_feature: Encodes the peptide sequence at SEQ ID NO. 24106
  misc_feature (489)..(489): n is a, c, t, g, unknown, or other
  misc_feature (500)..(500): n is a, c, t, g, unknown, or other
  misc_feature (508)..(508): n is a, c, t, g, unknown, or other
  misc_feature (565)..(565): n is a, c, t, g, unknown, or other
  misc_feature (572)..(572): n is a, c, t, g, unknown, or other
  misc_feature (618)..(618): n is a, c, t, g, unknown, or other
gctctaaactagtggatcccccgggctgcaggaattcgcacgagaccattacctagaacatcctaatcgaaaaagagcagccgacaactctctaccgtccgagaccccaagcaccagcgcggcggcggcggcggcggcgaccatggctgtcgggaagaacaagaggatctccaagggaaagaagtttaagatctgttccacagatcacgcgtgcgcgctcgcgaatcgggggttccacacatagcttcgtcgttttgaatttgatgtactaatggagtctaagggtggcaagaagtctagcagtagtcgttccatgatgtatgaagctccccttggctacagcattgaggacgttcgacctgccggaggcgcgaagaagttccagtctgctgcttactccaactgcgcaaagaagccatcctgatatcccttttggcttcctcgttctagtagtttaggatttcttttctgacacttcgattcttaccnatccccctggnctgctgcnttccctgacatcgaccagttccccagtcttgctccctgcagtcctccctcctcatcntcagcgntgtggtctgactcacctgcaccatggctgggtcttctgctggtggnggctccccggctcaatt

SEQ ID NO: 24106 - protein, 50 aa, Zea mays; identical to SEQ ID NO: 23071
  misc_feature: Ceres CLONE 1395002-F
  misc_feature (1)..(50): Pfam Name: AdoMetDC_leader Pfam Description: S-adenosyl-l-methionine decarboxylase leader peptide

SEQ ID NO: 24107 - DNA, 638 bp, Zea mays
  misc_feature: Ceres CLONE 1395003-F
  misc_feature: Encodes the peptide sequence at SEQ ID NO. 24108
  misc_feature (315)..(315): n is a, c, t, g, unknown, or other
  misc_feature (321)..(321): n is a, c, t, g, unknown, or other
  misc_feature (335)..(335): n is a, c, t, g, unknown, or other
  misc_feature (424)..(424): n is a, c, t, g, unknown, or other
aaagtggagctccccgcggtggcggccgctctagaactagtggatcccccgggctgcaggaattcgcacgagaccattacctagaacatcctaaaaaaaaaaccgagtcgagtccacagtccacaccaccaccgcgaggtccactaaaaaaacaagagcattaccggcaccaatcaatcaggctggcagtggagtgacagcggcggcaacaccacgcccacgcggcgccggagccgatcccccgatggatctcccgccgctctcccaccaggccctcttcgccgccgtccgatccgccgacgcgcccgccgtcgncgcggntccctggccgacgnccgaggcgtcggccacctccttggccgcgctcgccgccgctcagacggacgccggggaaaccgcgctgtacgttgccgcggaggcggcnagcgaaggaggtcgtgcgcctcctcctccctctctacgacttcgaggcagccaccgtccgctcacgccttgacctcgacgccttccatgtcgccgccaagcagggcacaaccggggtttgtgaaagagtcccttgggggcggtgccccagggctttggctcaggccgggggaatcttttccaaacataaatccccccttaatagcggggggggg

SEQ ID NO: 24108 - protein, 83 aa, Zea mays
  misc_feature: Ceres CLONE 1395003-F
  misc_feature (24)..(24): Xaa is any aa, unknown, or other
  misc_feature (26)..(26): Xaa is any aa, unknown, or other
  misc_feature (31)..(31): Xaa is any aa, unknown, or other
MDLPPLSHQALFAAVRSADAPAVXAXPWPTXEASATSLAALAAAQTDAGETALYVAAEAASEGGRAPPPPSLRLRGSHRPLTP

SEQ ID NO: 24109 - DNA, 714 bp, Zea mays
  misc_feature: Ceres CLONE 1395004-F
  misc_feature: Encodes the peptide sequence at SEQ ID NO. 24110
  misc_feature (329)..(329): n is a, c, t, g, unknown, or other
  misc_feature (362)..(362): n is a, c, t, g, unknown, or other
  misc_feature (386)..(386): n is a, c, t, g, unknown, or other
  misc_feature (387)..(387): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (414)..(414): n is a, c, t, g, unknown, or other
  misc_feature (427)..(427): n is a, c, t, g, unknown, or other
  misc_feature (441)..(441): n is a, c, t, g, unknown, or other
  misc_feature (485)..(485): n is a, c, t, g, unknown, or other
aaagctggagctccccgcggtggcggccgctctacaatagtggatcccccgggctgcaggaattcgcacgagaccattacctagaacatcctaatcgaaaaatcaaccatattattgagaccaacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttncaccctataggctcccaacagcaatcgcagcangcaacatacctttatcacccttgnntnnncacatcgccagccctaatcttgntgcagtcattggntacaaccatcaggncacagcagctgcagcaattcggggctacttgggatccaaccagnagttctttggaaacttttcttcctattttaagaaaaaaaatttctttccatttcacccaattggctactttggaacggggttgtttaattggggcaaacaataattaaacatttcccccgtttggtttggggtaaacttcaaaaaaaaaaaaattttttccatttaaccaattgggcgccacataaaacccccgtttttatttttggggaaaaaaaaacaaaaaaaatt

SEQ ID NO: 24110 - protein, 139 aa, Zea mays
  misc_feature: Ceres CLONE 1395004-F
  misc_feature (54)..(54): Xaa is any aa, unknown, or other
  misc_feature (65)..(65): Xaa is any aa, unknown, or other
  misc_feature (73)..(73): Xaa is any aa, unknown, or other
  misc_feature (74)..(74): Xaa is any aa, unknown, or other
  misc_feature (82)..(82): Xaa is any aa, unknown, or other
  misc_feature (91)..(91): Xaa is any aa, unknown, or other
  misc_feature (106)..(106): Xaa is any aa, unknown, or other
MATKIFSLLMLLALSACVANATIFPQCSQAPIASLLPPYLPSMIASVCENPALXPYRLPTAIAAXNIPLSPLXXHIASPNLXAVIGYNHQXTAAAAIRGYLGSNQXFFGNFSSYFKKKNFFPFHPIGYFGTGLFNWGKQ

SEQ ID NO: 24111 - DNA, 581 bp, Zea mays
  misc_feature: Ceres CLONE 1395012-F
  misc_feature: Encodes the peptide sequence at SEQ ID NO. 24112
aaagctggagctccccgcggtggcggccgctctacaactagtggatcccccgggctgcaggaattcgcacgagaccattacctagaacatcctaatcgaaaactcttcttttccccctcctcccgctgccctcggctcccacgacgcccggctagggttttgcctccttcccgctgccgccgtctcagcgagcgagactgagctgtgcttagtaagccatgtcgctgcgcccgagcgagcgggtcgaggtgcggcggaaccgctacaaggtggcggttgacgcggaggaggggcggcggcggcgcgaggaacatatggtggagatccgcaagagcccgccccaaggaaaaagccttttctaaaaagggcccgaaggggtccaagccaggtctggcccccccggggcaaaaaaatttaaaccccctctggggggggggtttttgggggaaaaaacccccctggggggccccccagttttcaagggtttttttaaaaagggcccccccccttgagaaaaatacacaaccggggggccccccaatatggggggggcccccacaaaagagatttccccccccccc

SEQ ID NO: 24112 - protein, 47 aa, Zea mays
  misc_feature: Ceres CLONE 1395012-F
MSLRPSERVEVRRNRYKVAVDAEEGRRRREEHMVEIRKSPPQGKSLF

SEQ ID NO: 24113 - DNA, 709 bp, Zea mays
  misc_feature: Ceres CLONE 1395013-F
  misc_feature: Encodes the peptide sequence at SEQ ID NO. 24114
tccccgcggtggcggccgctctatacctagtggatcccccgggctgcaggaattcgcacgagaccattacctagaacatcctaatcgaaaagcctaataaaattccccattccaatacacagatctcgcacccggaagtggcgacgaatctcgcggtgcggaggcgcgacagaggcggcgtcgactccgacggactcgcagccaccggaggagacgccccaccggcgcactcctccaacgttcatagtttaagggattgatttggataattagtcatcaacagaagcgataaaaaatggtggctcttgcagcatcaatcgtttcaaagtcgggaaaagcacttgtttcaagaaagtttgttgacatgtctcgaataacaattgaaggattacttgctgtgctcccgaaactggatgaaactgggaagcagcacacttatgtcgaaactgaaaatgtgcgatatgcttatcaacctattgaaggtttatatcttctacttatcacaaacaagcacagcaatattcttgaagatctggacactttgaggctcctctccaagatcgtgtctgaatactccccttcattggatgaggagggcatatgcaaaacagcatttgagattatatttgctttccatgttgccatatctcttgcgaacgaggaaaatgtaacagtggaacaagtcaaacgatattgtgagatggagagc

SEQ ID NO: 24114 - protein, 138 aa, Zea mays
  misc_feature: Ceres CLONE 1395013-F
MVALAASIVSKSGKALVSRKFVDMSRITIEGLLAVLPKLDETGKQHTYVETENVRYAYQPIEGLYLLLITNKHSNILEDLDTLRLLSKIVSEYSPSLDEEGICKTAFEIIFAFHVAISLANEENVTVEQVKRYCEMES

SEQ ID NO: 24115 - DNA, 677 bp, Zea mays
  misc_feature: Ceres CLONE 1395016-F
  misc_feature: Encodes the peptide sequence at SEQ ID NO. 24116
  misc_feature (633)..(633): n is a, c, t, g, unknown, or other
aaagctggagctccccgcggtggcggccgctctagaactagtggatcccccgggctgcaggaattcgcacgagaccattacctagaacatcctaaaaaaaatcttatttcactgccagccctctgaaaaaaaaattaaaaaatgaggtcccagttccacccacctagagagccaaaagagccggcggtggccggcagccaaaacccacgttggattttgccgccgccgcctggagctaggggacaaggcaacgccggccggtgcaacatttatgcgtgtaccaggcagaccagcccggcagccacgcgtacacttctgccgcaaagctaaacgcgccactccgcggcaagctgctctgctgctcccaccagccaccgcaccgagtgccaatggcgactgcagcgagttcgacgccggcggcgcggcagcctactctggtctgcgcgtcactgaccgcgcgggtgccccgggagatggcagcggaggttgccgccgctgcggcgctcggtgccgacgtggcggagctccaggtcggctgcctcgacagcttcgagccatgcagggacctgcccgtgcttctcgcccagccccgctcgctccccgtcatcgtcaccacaggcccgcaaaatttgnaagggaggccagtacgcaggcgaagatgagccacggtttgaggc

SEQ ID NO: 24116 - protein, 90 aa, Zea mays
  misc_feature: Ceres CLONE 1395016-F
  misc_feature (82)..(82): Xaa is any aa, unknown, or other
MATAASSTPAARQPTLVCASLTARVPREMAAEVAAAAALGADVAELQVGCLDSFEPCRDLPVLLAQPRSLPVIVTTGPQNLXGRPVRRRR

SEQ ID NO: 24117 - DNA, 679 bp, Zea mays
  misc_feature: Ceres CLONE 1395018-F
  misc_feature: Encodes the peptide sequence at SEQ ID NO. 24118
  misc_feature (477)..(477): n is a, c, t, g, unknown, or other
  misc_feature (492)..(492): n is a, c, t, g, unknown, or other
  misc_feature (494)..(494): n is a, c, t, g, unknown, or other
  misc_feature (496)..(496): n is a, c, t, g, unknown, or other
  misc_feature (499)..(499): n is a, c, t, g, unknown, or other
  misc_feature (512)..(512): n is a, c, t, g, unknown, or other
  misc_feature (605)..(605): n is a, c, t, g, unknown, or other
aagctggagctccccgcggtggcggccgctctagaactagtggatcccccgggctgcaggaattcgcacgagaccattacctagaacatcctaaaaaaaatctctcgtctctatcgccgcatcgcttctctgccggagctccaacaacctcgcctcgcgcagcactccgctgaccctccctgactccctccctgccgctgggatggccgggaaacgagttacgggccgcgatgggcaagacgagggcggcgcctaggtcgggctcccggcgatggacctctccctcgcgttcccgcaggccacacctgcctccattttcccgccgtccgcttcggattattaccagtctgatgatttgctgaccagtgaagagcgctctatcaggatgaaggtcaggggtattatggaaaaagaaattgctcccattatgtcagcgtactggggaaaagggcagagtttccatttaatggcattccntaaacttgcaagccntngntgntgctggtgggacnataaagggggtatgggtgcccaggactttccattacaggcagtgctggtacaatgtcagaaaatgcacgggtagatgcaagctggtcacattnaactggtggactccttccctgcgatggtgacaatagtcttttgggatccaaggttcaaagcaaaatacttgcct

SEQ ID NO: 24118 - protein, 104 aa, Zea mays
  misc_feature: Ceres CLONE 1395018-F
  misc_feature: SWISSPROT Homolog: EC 1.3.3.6 Acyl-CoA oxidase
  misc_feature (69)..(69): Xaa is any aa, unknown, or other
  misc_feature (74)..(74): Xaa is any aa, unknown, or other
  misc_feature (75)..(75): Xaa is any aa, unknown, or other
  misc_feature (76)..(76): Xaa is any aa, unknown, or other
  misc_feature (81)..(81): Xaa is any aa, unknown, or other
MDLSLAFPQATPASIFPPSASDYYQSDDLLTSEERSIRMKVRGIMEKEIAPIMSAYWGKGQSFHLMAFXKLASXXXCWWDXKGGMGAQDFPLQAVLVQCQKMHG

SEQ ID NO: 24119 - DNA, 620 bp, Zea mays
  misc_feature: Ceres CLONE 1395019-F
  misc_feature: Encodes the peptide sequence at SEQ ID NO. 24120
aaagctggagctccccgcggtggcggccgctctagaactagtggatcccccgggctgcaggaattcgcacgagaccattacctagaacatcctaatcgaaaaaagggctctacacgaagttaggcggccaagtgttcgcaaccaacccctcttcctcgcccactgaaaggttcagaggctcccgttttagcatagcgaccgagacgaaggagtgggggggcggagagctttgggccctggccaggatgaagtttatgagactcggcacccggccggacaccttcttcaccgccgccgactccgtgaggtctgtctgcacggaggtggccacggacctgcagatcctcgtggataactgccctctaccatcctccacaaagggaattaacttccaagggacgttaaaaaacttgcccccccttggccttatccgggatttaaatttttagtagggaccgtcccaaaagggggaacccccccaagggtttttttgcggttttcccccgttgggggacccccaaaaaaatctctcccggcggcggggaaccctcccccgaatatattaaaaaaacatttgggggagaggggggaacaaaaaacacccgcgggttttttttccc

SEQ ID NO: 24120 - protein, 67 aa, Zea mays
  misc_feature: Ceres CLONE 1395019-F
MKFMRLGTRPDTFFTAADSVRSVCTEVATDLQILVDNCPLPSSTKGINFQGTLKNLPPLGLIRDLNF

SEQ ID NO: 24121 - DNA, 675 bp, Zea mays
  misc_feature: Ceres CLONE 1395020-F
  misc_feature: Encodes the peptide sequence at SEQ ID NO. 24122
  misc_feature (339)..(339): n is a, c, t, g, unknown, or other
  misc_feature (340)..(340): n is a, c, t, g, unknown, or other
  misc_feature (351)..(351): n is a, c, t, g, unknown, or other
  misc_feature (392)..(392): n is a, c, t, g, unknown, or other
  misc_feature (398)..(398): n is a, c, t, g, unknown, or other
gcggtggcggccgctctagaactagtggatcccccgggctgcaggaattcgcacgagaccattacctagaacatcctaatcgaaaacttgtgaacatcgcagtgctgtagcctccttcgtcttgagcgagcatggagatgtcagccatggaggaagccctccccaaggcgatggagaggaggaagggaggcctcagaaccattccgttcatcatcttaaacgagatattcgagaaggtggccacgttcgggctgtcggccaacatgatcctgtacctcaccgagcggtatctcatgaccaacgcctttgccaccgtcgtcctctacttctgggatggcnntctccactccntggccatcttaggcgccgtgctcgccgacgcccgcctcggncgggtnccgggtcatcaacctcggttcctgggtaacctcctcggaaagggcctggctgggttgacgggaacccttcgggggacaaaaaaccccccgagtggggcccgggcggcccggaaagggggccggggttcccggggaaaatgccctcccctttccgggggttcggttatggcccccgggagggggggattccggccccggccggggggtttcgggcccacaccgtggaaagggggaacaaccgctcaaaaaggggggcccggggactccttcttagggg

SEQ ID NO: 24122 - protein, 181 aa, Zea mays
  misc_feature: Ceres CLONE 1395020-F
  misc_feature (70)..(70): Xaa is any aa, unknown, or other
  misc_feature (74)..(74): Xaa is any aa, unknown, or other
MEMSAMEEALPKAMERRKGGLRTIPFIILNEIFEKVATFGLSANMILYLTERYLMTNAFATVVLYFWDGXLHSXAILGAVLADARLGRVPGHQPRFLGNLLGKGLAGLTGTLRGTKNPPSGARAARKGGRGSRGKCPPLSGGSVMAPGRGGFRPRPGGFGPTPWKGGTTAQKGGPGDSFLG

SEQ ID NO: 24123 - DNA, 686 bp, Zea mays
  misc_feature: Ceres CLONE 1395021-F
  misc_feature: Encodes the peptide sequence at SEQ ID NO. 24124
  misc_feature (568)..(568): n is a, c, t, g, unknown, or other
  misc_feature (608)..(608): n is a, c, t, g, unknown, or other
caaagctggagctccccgcggtggcggccgctctagaactagtggatcccccgggctgcaggaattcgcacgagaccattacctagaacatcctaatcgaaaaaagggttttagcggcagcggcagcggcagccggagatgggggagcgggcgaaggaatggctcctcgcagcaggcgccggcgccgccgtcggcgcgctctctgccgccgctgtcatggatcttctctcgagatccaagcgcagagagaggtacgcgcgggacctgctggagtccaatgcaatgacgactggtacgcgtgcagggaacactcggtccagcaagcacctgggctctgttgctagctcggctccttctctctgatgaagtggtctctgaacagcttacaaggaatatacaattttttggcatggactctcagaagaaagtgactgaatcctatgtttgtggttattggtctttgggaggggggttggcagtcatgcagcatcatgctcctgaaaatctggtggttggcaggttgcttccttggtggatttttgatcaggtatcactctcatcactaaantcggcatgctgtggcaaccagaagatgacgttggaactcnaaaaagcgttgtgcctcaagaagcatttttcaatgaaaatacccagagtgccaaatagatgcaaaagtgcaattgtat

SEQ ID NO: 24124 - protein, 74 aa, Zea mays
  misc_feature: Ceres CLONE 1395021-F
MGERAKEWLLAAGAGAAVGALSAAAVMDLLSRSKRRERYARDLLESNAMTTGTRAGNTRSSKHLGSVASSAPSL

SEQ ID NO: 24125 - DNA, 691 bp, Zea mays
  misc_feature: Ceres CLONE 1395031-F
aagctggagctccccgcggtggcggccgctctagaactagtggatcccccgggctgcaggaattcgcacgagaccattacctagaacatcctaatcgaaaaagatccccgtccccggtttccacttttgcctccgccccaattcggatgaacaaacccctccgcctcgtcgcgtctcctcctcagccgtaggcgatccggtagagagagggagagggagggactgagggaggatgagtggggttcaggtcccggtcgcccgggcggctgcgcgattcgattgcaactatcgtatccgggggtcccacaggatggtgcgttggaaaacacaaatgaatgggatagaaaatgcgagcagcctccagggatgcttctgccaagggctgaaacgacctgctcaagaaggcggtctcagatctccaccctctgagactcccagcgcggcctccctagtcttcctctacgcatggaaagctcgacgaattcgcctgcataagagcgcccaagacgatgtgatcgttctagaacatacgcgaaggataatgtctgcaacgagaccgagcagcaggatattgaacgagtaatatctgatgcgcgatgactgctttaaaaacactaaggacttgaatgttaggggaggagactattgggcgagagtgcgcaagaatgctcctttgaaggactgcatagtt

SEQ ID NO: 24126 - DNA, 727 bp, Zea mays
  misc_feature: Ceres CLONE 1395034-F
  misc_feature: Translation starting site: 182
aagctggagctccccgcggtggcggccgctctagaactagtggatcccccgggctgcaggaattcgcacgagaccattacctagaacatcctaatcgaaaactgctcctctaccccttcctctcccggagaccagctggcctctcctttgttgaggtgagagacccccacccgatccggcgatggacgccgcgtccaggccgcctccgccccacggagcagggggccgcgtccgcgccccgctggtggagtctgtctcctgctactgcggattagatacgggtcttaaaactgttgttgaggccaggaagtttgttcctggcgcgaaaatgtgcatgcaacctgaaggccaacaaaacaagcgcaagtcaaggggctcaaacaaggagaggtgcaggactcaagcaccacttttacctggccttcctgatgatcttgctattgcctgcgcttatacgagttcctcgacttgaacagcccatactcaggatgggttgcaaaagatggaaccgtcttgtgtgtgagaattacttttactccgtgcgtaagaaaattggagtggcacaacaatgggcgtatgtctttaacagggaccgtgaagggaagatatcctggtatgcctttgatccactccaccagctatggaagtcgctcccgccaggtccacaagagtattcagaagcattgggctttgcgtgtgccgttctgagtggctgctatatgcactt

SEQ ID NO: 24127 - DNA, 701 bp, Zea mays
  misc_feature: Ceres CLONE 1395040-F
  misc_feature: Encodes the peptide sequence at SEQ ID NO. 24128
  misc_feature (347)..(347): n is a, c, t, g, unknown, or other
  misc_feature (350)..(350): n is a, c, t, g, unknown, or other
  misc_feature (384)..(384): n is a, c, t, g, unknown, or other
  misc_feature (478)..(478): n is a, c, t, g, unknown, or other
  misc_feature (480)..(480): n is a, c, t, g, unknown, or other
  misc_feature (481)..(481): n is a, c, t, g, unknown, or other
cagagctggagctccccgcggtggcggccgctctagaactagtggatcccccgggctgcaggaattcgcacgagaccattacctagaacatcctaatcgaaaaacaacccttgtggcattattgcccccctcttccgttcccaacccattacatttgcaagcccttttacattgcagagcctcgctcgctctcggaacagagctaggcagctaacagacgaagaagaagcaagccaagcagcaagcgaagcgagagagaggcgaggacgtggcgacgacggcagccgcgatggcgacaacgacagacctggggttcgaggcgacggagctccgcctgggcctgcggnggncagcgggcgggggaggggaaaggggagctgcgcntgtggcggcgaggggaggagctcgtcctccgcctccggcaagaggggcttcgccgagaccatcgacctgaagctgaagctggagccgcggcgtncnnggggaagcggagtaggaggaggaggaccacggcgttgctgtttgcccttgagaagggaggaggaggtcgggaaaaatgaagcggtccccgagccagagcagcgtcgccgccgccgccgtgctggctgaccccgccgagaagccgcgcgccgcagggatcagggtggagggatgtccacccggaccggtctggtccggaagaacatcatgtgcgtgcagtc

SEQ ID NO: 24128 - protein, 48 aa, Zea mays
  misc_feature: Ceres CLONE 1395040-F
MKRSPSQSSVAAAAVLADPAEKPRAAGIRVEGCPPGPVWSGRTSCACS

SEQ ID NO: 24129 - DNA, 672 bp, Zea mays
  misc_feature: Ceres CLONE 1395041-F
  misc_feature: Encodes the peptide sequence at SEQ ID NO. 24130
  misc_feature (512)..(512): n is a, c, t, g, unknown, or other
aagctggagctccccgcggtggcggccgctctagaactagtggatcccccgggctgcaggaattcgcacgagaccattacctagaacatcctaatcgaaaaatacttccggcgcggcggagatcgaatcgagcgcccgccacggcgatggcgactagagtcctgccgccggctctgctctctttcatactcctcctgctgctctcgctctcagcccgcgacaccgtcgccgcgggcgaggatttcccacgcgacgggcgggtgatcgacctcgacgacagcaatttcgaggcggcgctgggcgccatcgactttctcttcgtcgacttctacgccccttggtgcggccactgcaagagacttgcgcccgagttagatgaagctgcaccggtgttgtcagggttgagtgagcctattgttgttgccaaagtcaacgctgataaatacagaaaactcggatcaaaatatggagtggatggattccctaccctcatgctctttatcccatgaggntcaacttgatacctgggtcgaggaagctgaccacctggtcgcaactgaagaagtcgtttcgccgatggtctatcttgagtccaatctgggaaaagaacttgatgaaatgtgggaaaagttcccgaattcttgggtttgggggaagagcccttgttgcggg

SEQ ID NO: 24130 - protein, 120 aa, Zea mays
  misc_feature: Ceres CLONE 1395041-F
  misc_feature (38)..(121): Pfam Name: Thioredoxin Pfam Description: Thioredoxin
  misc_feature: SWISSPROT Homolog: EC 5.3.4.1 Protein disulfide-isomerase
MATRVLPPALLSFILLLLLSLSARDTVAAGEDFPRDGRVIDLDDSNFEAALGAIDFLFVDFYAPWCGHCKRLAPELDEAAPVLSGLSEPIVVAKVNADKYRKLGSKYGVDGFPTLMLFIP

SEQ ID NO: 24131 - DNA, 716 bp, Zea mays
  misc_feature: Ceres CLONE 1395043-F
  misc_feature: Encodes the peptide sequence at SEQ ID NO. 24132
  misc_feature (609)..(609): n is a, c, t, g, unknown, or other
  misc_feature (615)..(615): n is a, c, t, g, unknown, or other
aaagctggagctccccgcggtggcggccgctctagaactagtggatcccccgggctgcaggaattcgcacgagaccattacctagaacatcctaatcgaaaaatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagccgagcgccatgttccagccgctcccggcacagtgctgccagcagcagatgaggatgatggacgtgcagtccgtcgcgcagcagctgcagatgatgatgcagcttgagcgtgccgcttgcgccagcagcagcctgtacgagccagctctgatgcagcagcagcagcagctgctggcagcccagggtctcaccccatgcccatgatgatggcgcaaacatgcgggncatggntggactcaaacagaacaggtgcccaggtaccgcaccaaccccgggggggtctccggttgcatccgggcatataatgattctgaaatttgggaattcccccc

SEQ ID NO: 24132 - protein, 142 aa, Zea mays
  misc_feature: Ceres CLONE 1395043-F
MKMVIVLVVCLALSAASASAMQMPCPCAGLQGLYGAGAGLTTMMGAGGLYPYAEYLRQPQCSPLAAAPYYAGCGQPSAMFQPLPAQCCQQQMRMMDVQSVAQQLQMMMQLERAACASSSLYEPALMQQQQQLLAAQGLTPCP

SEQ ID NO: 24133 - DNA, 686 bp, Zea mays
  misc_feature: Ceres CLONE 1395044-F
  misc_feature: Encodes the peptide sequence at SEQ ID NO. 24134
  misc_feature (433)..(433): n is a, c, t, g, unknown, or other
  misc_feature (494)..(494): n is a, c, t, g, unknown, or other
  misc_feature (626)..(626): n is a, c, t, g, unknown, or other
  misc_feature (627)..(627): n is a, c, t, g, unknown, or other
tccccgcggtggcggccgctctagaactagtggatcccccgggctgcaggaattcgcacgagaccattacctagaacatcctaatcgaaaaatcattgcaaaagcgaagcaaagcaatcggaattctctgcgatttctctagatctcgactaccccccactagttttggttcctcctttcgttcgagagagcgattctggtggcaatggcgaagagcgagggtccggcgatcgggatcgacctcggcaccacctactcgtgcgtcggcgtgtggcagcacgaccgggtggagattatcgccaacgaccaggggaaccgcaccacgccgtcctatgtcggcttcaccgacaccgagcggctcatcggcgacgctgccaagaaccaggtcgccatgaaccccaccaacaccgtcttcgatgccaagcggttgatnccggcaggaggttctctggatccgtcagtgcagagtgcatgaaggctatggccgttcaggntcatcccaggggcctggtgacaagcccatggattgtagtgaactacaagggcgaaggaagaagcagtttggctgggctgaggagatcctcctccatggtcctcatcaaagaagggaaggagattgctgaggnncttaccttggttccccatcagaaaacgcaaagggttggacaggtgccggcctacttcaa

SEQ ID NO: 24134 - protein, 89 aa, Zea mays
  misc_feature: Ceres CLONE 1395044-F
  misc_feature (76)..(76): Xaa is any aa, unknown, or other
MAKSEGPAIGIDLGTTYSCVGVWQHDRVEIIANDQGNRTTPSYVGFTDTERLIGDAAKNQVAMNPTNTVFDAKRLXPAGGSLDPSVQSA

SEQ ID NO: 24135 - DNA, 724 bp, Zea mays
  misc_feature: Ceres CLONE 1395047-F
  misc_feature: Translation starting site: 317
  misc_feature (704)..(704): n is a, c, t, g, unknown, or other
cgctctcgaactagtggatcccccgggctgcaggaattcgcacgagaccattacctagaacatcctaatcaaaacgaacgaaactgctcgtgctcgccgtccccggcgcgtggagcgcgtcccgtccgccacacgcaccgaccatcccctgccctcatcaggaatccccggcccgcagcgtacaaatacacgcgccccgccgctccgacctcactttccccgcctccatcaccaattcacgatctcctttcccgaaccgcgccacggatcgtcggctcgcaattccagagttaaattcccctccaccggaaccgtcatgggaggctcccacagtcgcgaggacgtcgatctcacctcctccgaccaagaggaggaactccaggacgactatcacgcccgatcacccatcgcggaggccgcatcgagcgaggagcagtgcgacaactacctcctccggaccgccacagcttcctcgtttgaggacatcgacgccaaggtcaggtagctggatctcaagcaccagagacctaccgtcgccaaggtctacctccacggcggcgggggctcgacttccgcgcgctgtgagcccgtcgagcccgcgcgacctactcattcgtagatcagtcgagcgaagacgacgcctcgcccaggtggttactagaggatgggtcagggccgcgcgtctccgcgccagtggactcggngctccatctgtagacgatac

SEQ ID NO: 24136 - DNA, 675 bp, Zea mays
  misc_feature: Ceres CLONE 1395048-F
  misc_feature: Encodes the peptide sequence at SEQ ID NO. 24137
  misc_feature (274)..(274): n is a, c, t, g, unknown, or other
  misc_feature (465)..(465): n is a, c, t, g, unknown, or other
  misc_feature (487)..(487): n is a, c, t, g, unknown, or other
  misc_feature (496)..(496): n is a, c, t, g, unknown, or other
  misc_feature (535)..(535): n is a, c, t, g, unknown, or other
  misc_feature (558)..(558): n is a, c, t, g, unknown, or other
aaagctggagctccccgcggtggcggccgctctagaactagtggatcccccgggctgcaggaattcgcacgagaccattacctagaacatcctaatcgaaaaattattgccccctcttcccttcccaacccaacccattgcatttgcaagcccttttacattgcagagcgccagagcctcgctcgctctcggaacagagctaggcagctaacagacgaagaagaagcaagccaagcagaattgagagagaggcgaggacgtggcgacgacggcngccgcgatggcgacgacgacggacctggggttcgaggcgacggagctccgcctgggcctgcccggcgggggaggtggaggggagccggcgctgggcggcgaggggaggagctcttcctccgcctccggcaagaggggcttcgccgagaccatcgacctgaagctgaagctggagccagcggccggcgtggnaggcggaggaggaaggaggagnaccacggcngtgctgttgccccttgagaagggagaggaggccgggaanatgaagcggtccccgagcagagnagggtccccgcgccggcgccgcctgctggctgaccccgcgaaaagccgcggccgccaggcttcgggggtgggaatggcccccgggccggtcggtccggaaaaaattagggccgggag

SEQ ID NO: 24137 - protein, 131 aa, Zea mays
  misc_feature: Ceres CLONE 1395048-F
  misc_feature (62)..(62): Xaa is any aa, unknown, or other
  misc_feature (69)..(69): Xaa is any aa, unknown, or other
  misc_feature (85)..(85): Xaa is any aa, unknown, or other
  misc_feature (93)..(93): Xaa is any aa, unknown, or other
MATTTDLGFEATELRLGLPGGGGGGEPALGGEGRSSSSASGKRGFAETIDLKLKLEPAAGVXGGGGRRXTTAVLLPLEKGEEAGXMKRSPSRXGSPRRRRLLADPAKSRGRQASGVGMAPGPVGPEKIRAG

SEQ ID NO: 24138 - DNA, 690 bp, Zea mays
  misc_feature: Ceres CLONE 1395053-F
caccgcggtggcggccgctctagtacaaagaatcccccgggctgcaggaattcgcacgagaccattacctagaacatcctaatcgaaaaagatggctgataggctgagacggtcgactgccgcatgtccgcgctatctgctccggtctgcgttggtatgctagggctcggactttggattgtatccgccccgccgaaccgccatcgtagccggcgcagtgccgcacagccggcactcccgtattggtcttgccgccagcctccctcgggcctcgatcatcggccgctcgctggatcgccgagacagcgatttggaatcaaccgtcgtcgcgtctgcgatggccagcgtataaggggcgagcttcacgcctccaggcatctgcgcccgccctcctccgccgacacgccgatagtagagcgaccgagcaccacgatccccagcgcccaacaagttagaaggctgcaggcatgctgtcgttgatgatgagtcctctgagtagagctgaatgcccggaaggctatcaggtctgaagaaactgaacgaaaagggggcaattcaggaaacccgcgttgaaatgctattttagacatgataaacagtgaagtactgtatggcagacccgtcaaaaagatctcaagttcttgaaagagtaataacgtatcacttgaaagcagcgaaactttgcatctg

SEQ ID NO: 24139 - DNA, 636 bp, Zea mays
  misc_feature: Ceres CLONE 1395054-F
  misc_feature: Encodes the peptide sequence at SEQ ID NO. 24140
  misc_feature (559)..(559): n is a, c, t, g, unknown, or other
  misc_feature (593)..(593): n is a, c, t, g, unknown, or other
  misc_feature (610)..(610): n is a, c, t, g, unknown, or other
aaagctggagctccccgcggtggcggccgctctagaactagtggatcccccgggctgcaggaattcgcacgagaccattacctagaacatcctaatcgaaaaatcacaattcactccactcatcttttctcgtttagaacctctaaaatttcccccactcgccagtcgcagcagcacctgtagcagtcatggacgccagcggagccggtagcaaggggaagaagggggcggccgggcgcaaggcaggcggccccaggaagaagtcggtgacgcggtccgtcaaggccgggctgcagttccccgtcggccggatcgggcgctacctcaagaagggccggtacgcgcagcgcgtgggcactggcgcccccgtctacctcgccgccgtcctggagtacctctccgtcgcttcagtcatggcaggaatggcacctgagggttctcagttcgatgctaagcactatgattctaagatgcaggagctgctgagcaccggtgagactgaggagttcttcacttcatatgatgaagtttttgagagttttgatgatatgggcctccnagagaatcttctgagaggcatttatgcttatggntttgagaaagcatctgncattcagcagagaggaatttgtcctc

SEQ ID NO: 24140 - protein, 149 aa, Zea mays
  misc_feature: Ceres CLONE 1395054-F
  misc_feature (124)..(124): Xaa is any aa, unknown, or other
  misc_feature (141)..(141): Xaa is any aa, unknown, or other
MDASGAGSKGKKGAAGRKAGGPRKKSVTRSVKAGLQFPVGRIGRYLKKGRYAQRVGTGAPVYLAAVLEYLSVASVMAGMAPEGSQFDAKHYDSKMQELLSTGETEEFFTSYDEVFESFDDMGLXENLLRGIYAYGFEKASXIQQRGICP

SEQ ID NO: 24141 - DNA, 665 bp, Zea mays
  misc_feature: Ceres CLONE 1395055-F
  misc_feature: Encodes the peptide sequence at SEQ ID NO. 24142
  misc_feature (665)..(665): n is a, c, t, g, unknown, or other
tacccgcggtggcggccgctctacaactagtggatcccccgggctgcaggaattcgcacgagaccattacctagaacatcctaatcgaaaaaaaaaaacactaaccgaaaaacctcctctacagccccatctaggcgcccctcctcggctccgatccagtttcgccggtggtcatgtatcagccggtgtcgacggtggccgcgacggcgcagccgcagggtcgcggccccgcgcctagactagggtgacctggggcagaccatcgcaggaatcgcgtggatggcgtcgctctggtactttgctctaaagatcttcgtttccaagcgtccacccgcgtacccctggatgatcatgtcctacctcttccagatgggcaagccaatggatatgtgaatgtatttgtcagagaacgatcagatcaacgattttgttaatgaggatgttcttatttggtacgaggaaaacataccaatacgcagctcgcgaagctaccagcactagaacacggacattaacataagatccgtcttaggctctcaagcataatggctctttgaatgatcttgtttactatccccgatcgagtaatctggtggaccctatatatccggaaaaagagtaaaaaccttccgttggacgcaccccctcggtacagagcctccttn

SEQ ID NO: 24142 - protein, 37 aa, Zea mays
  misc_feature: Ceres CLONE 1395055-F
MASLWYFALKIFVSKRPPAYPWMIMSYLFQMGKPMDM

SEQ ID NO: 24143 - DNA, 618 bp, Zea mays
  misc_feature: Ceres CLONE 1395057-F
  misc_feature: Encodes the peptide sequence at SEQ ID NO. 24144
gctctagaactagtggatcccccgggctgcaggaattcgcacgagaccattacctagaacatcctaatcgaaaaaacgcctccaccacgaggcacgcaacaattagaacacatcttgccgccgccgaggacgacggcgatgatgtggcgttcgcgagctcgtgcgctgctcctactccgctcgaccattacccggccaccgccaccacctccacaaccatatcccactcgaaccctaacccgagtcccacctccccgcttcctgtcctcctccccggatcccatccccgattcctcctccgccgccgccgcggatcccttccctgaagccttctcctccccgaccaaggcttctcaagatgccgctgaggccggagaggacaacctgagctcgatgtgggaagaaacttggggacgcccaacaaaatttttttgccccccccggaaaggcccccaccccccaaacccccccccttttttgggggggggtttcccccccctctttttgtgggcgcccccgggggggggggcgtatcccccccccccccccccaccacggcaaaaaaaaaaatagatatccctgcccctttctatgtgttgttggtattagactgcgcgg

SEQ ID NO: 24144 - protein, 144 aa, Zea mays
  misc_feature: Ceres CLONE 1395057-F
MMWRSRARALLLLRSTITRPPPPPPQPYPTRTLTRVPPPRFLSSSPDPIPDSSSAAAADPFPEAFSSPTKASQDAAEAGEDNLSSMWEETWGRPTKFFCPPRKGPHPPNPPPFLGGGFPPLFLWAPPGGGAYPPPPPPPRQKKK

SEQ ID NO: 24145 - DNA, 726 bp, Zea mays
  misc_feature: Ceres CLONE 1395058-F
gctctagaactagtggatcccccgggctgcaggaattcgcacgagaccattacctagaacatcctaatcaaaaagaaggaacctgctcggcctcgccgtccccggagcgtgaagcgcgtcgcgtccgccacacgcagagagaatcacctgacctcatcagcaatccccggcccgcagcgcacaaatacacgctccccgccgctccgacctcactttccccgcctccatcaccaattcacaatctcctttcccgcaccgcggcccggatcggcggatcgcaatgtccggagttaaattcccctccgacgtaaccgttatgggcggttcccacagacgcgaggacgtcgatcgtcacctcctccgacgaataggaggaattcgaggacgactatgacgcccgatcacccatctgggaggccgcagcgagcgcgggcgagctcgacgacaacctcctccgcaccgacacaacttcctcgcttgaggacatcgacgccaagctcaggtcgctggatgctcaagtaccagagacctaccgtcgtgtagttctacctccacggagatggtgtctctgcttccgcgcgctgggtgaacgacgagcccgcgcgacctacgaattcgtcgagcagacgagagaagaagcctcctcccccaagcggctcatagaggttgcgtcggagtcgcgggactccgcgtccgtgaactcggcgcgtcagatgagacgatccc

SEQ ID NO: 24146 - DNA, 2029 bp, Zea mays
  misc_feature: Ceres CLONE 1395060
  misc_feature: Encodes the peptide sequence at SEQ ID NO. 24147
aacccccctttcccgccacaccatctcctcgccgcttcccgccacctctctcccatggcggcgccgtcggcggccacgcgcaggaaactgcagcgcaagttccgcctacgaggcttcaccctcaaggtggacgccctcgaggaggccgccgccttcctcgaccgcttccccgacgccgaggacgacgcgctcgatctcctcctcgacgagctcgacaaggaaccgctgcagtcgtcgatactggaccgggacgcggtcaggcgcgtggtggcgctgcttgtcgaggccgaggaggcgctcgatgtggcgtcgccagcggccacaagcgcaaggtctgcgctgcgggtggtggacgcgttcctcgtgccgcggttccactacgatccaatcaagaaagtattttacgagcacacaggcagattagctgtccatggagaagctggagataaagcttccctttatagggataggtatcaagtgctgctgcagagactgtctcgtgataaatatttctctaagccggcttttgacacagttgcgaccgaacactgtagttgcgagataacttctgtacagtcgctaattgggtgcactgggcggagatggattatgggggtcatttcgcagttggaggagcgacagttctacttggaggatcttactggagcagttccaattgacttatctaatgccaaaatcacgtcaggtttttttgttgaaaatactgtaatcgtagccgaaggtgagctgctttcaaatggcattttccaggtaaatacatgtggatttcctcccctggaggacagagaagcgtcagtctcattgctcatgggttttgatttctttgggggaggtgtaataccaactgaagaaacactaaggttatcatcactggaaaaaaaggctgtgaatgatatgtttgtcattctttcggatgtgtggctggacaatcctgagactatggagaagttggctgttgttcttgacgggtatgatagtgtggaagttgtgccttccctctttgttttaatgggcaatttctgctcccggccttgcaatctagcgttcaattcatttgaagaactcagatttcagttcggaaagcttggcgagatgattgcagctcgatctagattaaaggaacatagtcgtttcttattcattcctggacctgatgatgcaggtccttctaaagccctcccaagatgtgcacttccaaaatatctaattgaagaacttcagaagcacataccaaattcaatcttcgtaagcaacccctgcagggtgaagttttacacacaagaaattgtgtttttccggcaagatctcctttacaggatgcggcggtcatgtctcattccaccaacaacggaagaaacaagtgacccttttgaacacctggtagcaactatcacccatcagagccatctttgtccattgcctcttactgttcaacctatcatatggaattatgatcattgccttcggttgtatccaactcctcacacgattgtattgggtgacaaaagcgagcagaaagccttcaaatatactgggatcacttgctttaatccaggttcgtttgcgaatgacagcaccttcgcagcatatcgtccttgcaccaaagaggttgagctttctgcgttggaaggctaataaagggagaataaactgaagttctccaatttgatgaagtgtaaagtcttcgacaaattaaagaattgccacttccacacaaggagccgtgaaaatagcatgactttcatgacgatgtggtgtttctgtgaagagaactgatgctgatatctcatcataggctcagcaaagcagtaggagcagcacattggtgtttgtgcagcatctctagctgtttgtaacaatctttaaatactgcacgttagaccagactattttacttgtactgtttagtttttcattgaatcatggtaacaactaacaagattactttctgacagtgctcataactgctctatcttaatattttgatcacaaaaaaaaaaaaaaaaaa

SEQ ID NO: 24147 - protein, 533 aa, Zea mays
  misc_feature: Ceres CLONE 1395060
  misc_feature (289)..(499): Pfam Name: DNA_pol_E_B Pfam Description: DNA polymerase alpha/epsilon subunit B
  misc_feature: SWISSPROT Homolog: EC 2.7.7.7 DNA-directed DNA polymerase
MAAPSAATRRKLQRKFRLRGFTLKVDALEEAAAFLDRFPDAEDDALDLLLDELDKEPLQSSILDRDAVRRVVALLVEAEEALDVASPAATSARSALRVVDAFLVPRFHYDPIKKVFYEHTGRLAVHGEAGDKASLYRDRYQVLLQRLSRDKYFSKPAFDTVATEHCSCEITSVQSLIGCTGRRWIMGVISQLEERQFYLEDLTGAVPIDLSNAKITSGFFVENTVIVAEGELLSNGIFQVNTCGFPPLEDREASVSLLMGFDFFGGGVIPTEETLRLSSLEKKAVNDMFVILSDVWLDNPETMEKLAVVLDGYDSVEVVPSLFVLMGNFCSRPCNLAFNSFEELRFQFGKLGEMIAARSRLKEHSRFLFIPGPDDAGPSKALPRCALPKYLIEELQKHIPNSIFVSNPCRVKFYTQEIVFFRQDLLYRMRRSCLIPPTTEETSDPFEHLVATITHQSHLCPLPLTVQPIIWNYDHCLRLYPTPHTIVLGDKSEQKAFKYTGITCFNPGSFANDSTFAAYRPCTKEVELSALEG

SEQ ID NO: 24148 - DNA, 670 bp, Zea mays
  misc_feature: Ceres CLONE 1395068-F
  misc_feature: Encodes the peptide sequence at SEQ ID NO. 24149
  misc_feature (446)..(446): n is a, c, t, g, unknown, or other
  misc_feature (515)..(515): n is a, c, t, g, unknown, or other
  misc_feature (539)..(539): n is a, c, t, g, unknown, or other
  misc_feature (670)..(670): n is a, c, t, g, unknown, or other
gctctagaactagtggatcccccgggctgcaggaattcgcacgagaccattacctagaacatcctaatcgaaaaagttcgccaccatcgtgctccgtacacgctccgctccggccatggccgccgccgcggcctccttttcggccctgccgttccttctacttttgctgctggtgccgtcgctcgacggcgcctccaatgtgacgtacgaccaccgctccctcatcatctccggccgccgccgcctcgtcatctccacctccatccactacccccgcagcgtccccgagatgtggcccaagctggtggctgaagccaaagacggcggcgccgactgcatcgagacctacgtcttctggaacggccatgagatcgccccaggccagtactacttcgaggaccggtttgaccctggtggcggttcgtgaaggtcgttagagacgctgnggctgctcttgatcctgcgcatcgggccctatgtcgccgccgagtggaatttatggaggcgtgcccggntgtggttgcactacggccaaggancgggttttcaggacaaacaacgagccattcaaaaccattaatgaagagtttcacgacatacattcgtggaatattgatgaagaaagagcagctcttcgctttctcaggggagggaacattatcctagctcn

SEQ ID NO: 24149 - protein, 103 aa, Zea mays
  misc_feature: Ceres CLONE 1395068-F
  misc_feature: SWISSPROT Homolog: EC 3.2.1.23 Beta-galactosidase
MAAAAASFSALPFLLLLLLVPSLDGASNVTYDHRSLIISGRRRLVISTSIHYPRSVPEMWPKLVAEAKDGGADCIETYVFWNGHEIAPGQYYFEDRFDPGGGS

SEQ ID NO: 24150 - DNA, 679 bp, Zea mays
  misc_feature: Ceres CLONE 1395072-F
  misc_feature: Encodes the peptide sequence at SEQ ID NO. 24151
  misc_feature (357)..(357): n is a, c, t, g, unknown, or other
  misc_feature (441)..(441): n is a, c, t, g, unknown, or other
  misc_feature (469)..(469): n is a, c, t, g, unknown, or other
  misc_feature (470)..(470): n is a, c, t, g, unknown, or other
  misc_feature (481)..(481): n is a, c, t, g, unknown, or other
tggagctccccgcggtggcggccgctctagaactagtggatcccccgggctgcaggaattcgcacgagaccattacctagaacatcctaatcgaaaaattgacgcggtccgcaactcctctaaacccttcctctccctccggcgccggcgccgacatggccgtccactacctcctccgccgcggggtctccggtggctcactgctccaccctatccgcggtctcttcctcgcctccaaggagcttgggaggcgtccgttgggctctgcggcggcgggagacgcagcggccgagctgaggggcgcgcgggaggacgtcaggcagctgctcaaggccacctcctgcatcccatcctggnttcgattaggttggcatgatgctggtacatatgacaagaacattaccgagtggcccaaagtgtggtggagctaatggtagctgnaagattcgaagtcgagttgaagatgggnnccatggctggntcttgtgaatggctctgaagctgatccaaccatcaaggaaaagggtttttcaggtgtacctaatggcagaatctgtttcagcttgccagcgccacagccattcaggggaagcaggtggccccaaattctatgatcctattgggagaggggttgtggtgttatttgcccccgaacaatgcccacccagagggggaggtt

SEQ ID NO: 24151 - protein, 91 aa, Zea mays
  misc_feature: Ceres CLONE 1395072-F
  misc_feature: SWISSPROT Homolog: EC 1.11.1.11 L-ascorbate peroxidase
  misc_feature (68)..(68): Xaa is any aa, unknown, or other
MAVHYLLRRGVSGGSLLHPIRGLFLASKELGRRPLGSAAAGDAAAELRGAREDVRQLLKATSCIPSWXRLGWHDAGTYDKNITEWPKVWWS

SEQ ID NO: 24152 - DNA, 681 bp, Zea mays
  misc_feature: Ceres CLONE 1395074-F
  misc_feature: Encodes the peptide sequence at SEQ ID NO. 24153
aaagctggagctccccgcggtggcggccgctctagaactagtggatcccccgggctgcaggaattcgcacgagaccattacctagaacatcctaatcgagaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcacaagctcctatagcttcccttcttcccccgtacctctcaccagtggtgtcttcggtatgtcaaaacccaattcttgaaccctacaggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaacaactaccattcagccagctacctgctgcctacccccagcaatttcttccattcaaccaactggcagcattgaactctcctgcttatttacagcagcaacaactactaccacagttgttg

SEQ ID NO: 24153 - protein, 174 aa, Zea mays
  misc_feature: Ceres CLONE 1395074-F
  misc_feature (1)..(174): Pfam Name: Zein Pfam Description: Zein seed storage protein
MAAKIFCLLMLLGLSASAATATIFPQCSQAPIASLLPPYLSPVVSSVCQNPILEPYRIQQAIAAGILPLSPLFLQQSSALLQQLPLVHLLAQNIRAQQLQQLVLANLAAYSQQQQFLPFNQLAALNSASYLQQQQLPFSQLPAAYPQQFLPFNQLAALNSPAYLQQQQLLPQLL

SEQ ID NO: 24154 - DNA, 601 bp, Zea mays
  misc_feature: Ceres CLONE 1395075-F
  misc_feature: Encodes the peptide sequence at SEQ ID NO. 24155
  misc_feature (317)..(317): n is a, c, t, g, unknown, or other
aaagctggagctccccgcggtggcggccgctctagaactagtggatcccccgggctgcaggaattcgcacgagaccattacctagaacatcctaatcgaaaacaaaactgagtaagcagctatggagggatccgccgccgctccgctccgcacgcgcatctgcatcatcgggagcggtcccgctgcgcacacggcagccatctacgcggcccgcgcggagctcaagcctgtgctcttcgagggctggatggccaacgacatcgccgcgggcggcagctcacaccaccacgacgtcgagactttcccggctccccacncatcaggggcgcgacctcatggacactgccggcgcagtcctgcgcttttgcaccacatcctctccgagaccgtcacgccgtcgacttttcggctggccatccgaggtaaggaaaaatcacaacggtcctgccgatggggttatccgtgccacggaagacgtcgggggggccccccatccccggggccaagggaaaatggaaccccgggatttccgccttggccgcttggggaaggggccccccccatttttcggaaaaaagccctcccccgcaaaggggggggg

SEQ ID NO: 24155 - protein, 160 aa, Zea mays
  misc_feature: Ceres CLONE 1395075-F
  misc_feature: SWISSPROT Homolog: EC 1.8.1.9 Thioredoxin-disulfide reductase
  misc_feature (66)..(66): Xaa is any aa, unknown, or other
MEGSAAAPLRTRICIIGSGPAAHTAAIYAARAELKPVLFEGWMANDIAAGGSSHHHDVETFPAPHXSGARPHGHCRRSPALLHHILSETVTPSTFRLAIRGKEKSQRSCRWGYPCHGRRRGGPPSPGPRENGTPGFPPWPLGEGAPPIFRKKALPRKGGG

SEQ ID NO: 24156 - DNA, 700 bp, Zea mays
  misc_feature: Ceres CLONE 1395077-F
  misc_feature: Encodes the peptide sequence at SEQ ID NO. 24157
  misc_feature (665)..(665): n is a, c, t, g, unknown, or other
aaagctggagctccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggctggtgaaccacggagtgccggaggagctgatgggcggcatgctccgcggggtgcgccagttcaacgagggccccgtggaagggcgaagcaggcgctcctactcgagggacctcgctcgcaacctgcgcttcgcctccaacttcgacctcttcaaggctgctagcggccgactggcgcgacacgtccttttccggcgaaggtggctccgaaccgccgnccgacggtaggaagctgccgtagccactcaagaac

SEQ ID NO: 24157 - protein, 175 aa, Zea mays
  misc_feature: Ceres CLONE 1395077-F
  misc_feature: SWISSPROT Homolog: EC 1.14.11.20 Desacetoxyvindoline 4-hydroxylase
  misc_feature (173)..(173): Xaa is any aa, unknown, or other
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGFFWLVNHGVPEELMGGMLRGVRQFNEGPVEGRSRRSYSRDLARNLRFASNFDLFKAASGRLARHVLFRRRWLRTAXRR

SEQ ID NO: 24158 - DNA, 665 bp, Zea mays
  misc_feature: Ceres CLONE 1395078-F
  misc_feature: Encodes the peptide sequence at SEQ ID NO. 24159
  misc_feature (620)..(620): n is a, c, t, g, unknown, or other
aaagctggagctccccgcggtggcggccgctctagaactagtggatcccccgggctgcaggaattcgcacgagaccattacctagaacatcctaatcgaaaacgaaaaattcgaaagatccctccaggaaagatttttcttccctcctccgacgccccagcccaccaacacactctataaagcagccctcagtcacacacagaacgcacaagcgcaagccgggcaagaaaactccgtaggccagtctgcgagttggatggccttcttcttggccctcgtgtgcatcctcatcttgctagccatcgcctcctacgtccagtacactcgctggcaaaaggggaaaggccgcttcggcggccatgggaggtctgctcccttgaagctgcctcctggctccatgggctggccttaccttggcgagaccctccagctttactcccaggaccccagcttcttcttcgcttccaaacagaagaggtacggcgagatcttcaagacgcaccttctgggttgcccgtgcgtgatgctggcgagcccggaggcggcgcggttcgtgctggtgacgcaggcgcacctgttcaagccgacctacccgcggagcatggagcgcatgatcgggncgtcggctctcttctttcacagggcgactaccactccgtctccgc

SEQ ID NO: 24159 - protein, 136 aa, Zea mays
  misc_feature: Ceres CLONE 1395078-F
  misc_feature: SWISSPROT Homolog: EC 1.14.13.93 (+)-abscisic acid 8'-hydroxylase
  misc_feature (122)..(122): Xaa is any aa, unknown, or other
MAFFLALVCILILLAIASYVQYTRWQKGKGRFGGHGRSAPLKLPPGSMGWPYLGETLQLYSQDPSFFFASKQKRYGEIFKTHLLGCPCVMLASPEAARFVLVTQAHLFKPTYPRSMERMIGXSALFFHRATTTPSP

SEQ ID NO: 24160 - DNA, 652 bp, Zea mays
  misc_feature: Ceres CLONE 1395083-F
  misc_feature: Encodes the peptide sequence at SEQ ID NO. 24161
  misc_feature (450)..(450): n is a, c, t, g, unknown, or other
  misc_feature (464)..(464): n is a, c, t, g, unknown, or other
  misc_feature (549)..(549): n is a, c, t, g, unknown, or other
tccccgcggtggcggccgctctagaactagtggatcccccgggctgcaggaattcgcacgagaccattacctagaacatcctaatcgaaaaatcccacgctgccctcggcgctgcgcctggacccggcacctacctcccccctccccacctcgccgccggcgggtggagtcgggctggagcagccgctctcctctgttacccccctaaccccctataaagaaaaagaaaaaaaaacagagagagagagcgagcgaccggcggctcggcagccatggggcacggcgtcagctgcgcccgcaccggcgacgagcacgactacttcgccgcggcgcaggtcggggacctcgaggccctggacgcgctcctcgacgccgacccctctctcgcccgccgcgccacgctctacgaccgcctctccgcgctccacatcgccgccgcgaatggcccgnctcgaggtgctgtncatggtctgggatcacggggtgccggccggacgtggtggatcggcacaagcagacgccgctgatgctcgcggcgatgcacgcagnactgactgcgtgctgaacctcctgcagggcggcgcaatatccctcatgttcgattcccagcacgggcgggacctgctgggacacgcggtctaattcgggccag

SEQ ID NO: 24161 - protein, 84 aa, Zea mays
  misc_feature: Ceres CLONE 1395083-F
  misc_feature (60)..(60): Xaa is any aa, unknown, or other
MGHGVSCARTGDEHDYFAAAQVGDLEALDALLDADPSLARRATLYDRLSALHIAAANGPXRGAVHGLGSRGAGRTWWIGTSRRR

SEQ ID NO: 24162 - DNA, 678 bp, Zea mays
  misc_feature: Ceres CLONE 1395084-F
  misc_feature: Translation starting site: 290
  misc_feature (478)..(478): n is a, c, t, g, unknown, or other
  misc_feature (479)..(479): n is a, c, t, g, unknown, or other
  misc_feature (554)..(554): n is a, c, t, g, unknown, or other
  misc_feature (574)..(574): n is a, c, t, g, unknown, or other
  misc_feature (575)..(575): n is a, c, t, g, unknown, or other
  misc_feature (589)..(589): n is a, c, t, g, unknown, or other
  misc_feature (590)..(590): n is a, c, t, g, unknown, or other
ctggagctccccgcggtggcggccgctctagaactagtggatcccccgggctgcaggaattcgcacgagaccattacctagaacatcctaatcgaaaaagagcagagctgagctgcctccaactccgacccacacccacggcacggcagtcggcagcagccagcgttgagcgcagtgccctcttgtctgctgcctcctacctccccgcccagtctcactcacacgctcccacttccgagtctcgctcgcagcctgttctcctggggtccgatcggaggggggtgaggagatggagccagattcggcgacgacgaggctcgcattgctggcgctgcttctcctggcggcgcccgcccgcccggcctcggcggctccggtggaggatggcctgctcagcaatggtgactttgagacgcaccagccggcggttttgtaagatctgcgtctgttgctgagggtgcatcgtcaatccctggtnngggacatcatggcacagtcgagctcatttcagcaggccagcacccaggtggcatgatcctgattgttccacaggnagaccatgctgtaaggctannggatgatgctagcnngtgggcaggtggtggacgtcgagaagggctcggactacgctgtcacattcagcgctgcccggacatgtgcacaactggaggcactgaa

SEQ ID NO: 24163 - DNA, 678 bp, Zea mays
  misc_feature: Ceres CLONE 1395085-F
  misc_feature: Encodes the peptide sequence at SEQ ID NO. 24164
  misc_feature (374)..(374): n is a, c, t, g, unknown, or other
  misc_feature (595)..(595): n is a, c, t, g, unknown, or other
  misc_feature (599)..(599): n is a, c, t, g, unknown, or other
  misc_feature (600)..(600): n is a, c, t, g, unknown, or other
tccccgcggtggcggccgctctagaactagtggatcccccgggctgcaggaattcgcacgagaccattacctagaacatcctaatcgaaaaatcccaagaagagccgccctacctattccttctcccagccgtcgagctgcccaacccagagcaccagcagccctcaccttcttcctctcggccggtccttcaaacgagcccgctcgtcttggagccgccgccggtctcgttctggacgaacgttcaaggagattgcatttgtggatgctctaatggagtcgaaaggtggcaagaagtctagtagtagtagtagtaatttcatgtacgaagctccccttgggctacagatcgaggacgttcgcccagccggagnaatcaagaagttccagactgctgcttattccaactgcgtccgccagccatcctgatatcgcctcacatgcaattcgcggtagagtagatttttaattcagttttcctcttgtggtcggtagttttccgttggctctggctgccttcctctgcttctggagatcccacttgtcttgcccatctctccttttctctctcatcctctctttctgcacacgcatnccannggggcgatgtctcagcaagaatccttgggtctcttctctgctcccctatttgggctttgagggctatgaaaacgcctc

SEQ ID NO: 24164 - protein, 51 aa, Zea mays
  misc_feature: Ceres CLONE 1395085-F
  misc_feature (1)..(51): Pfam Name: AdoMetDC_leader Pfam Description: S-adenosyl-l-methionine decarboxylase leader peptide
  misc_feature (34)..(34): Xaa is any aa, unknown, or other
MESKGGKKSSSSSSNFMYEAPLGLQIEDVRPAGXIKKFQTAAYSNCVRQPS

SEQ ID NO: 24165 - DNA, 659 bp, Zea mays
  misc_feature: Ceres CLONE 1395086-F
  misc_feature: Encodes the peptide sequence at SEQ ID NO. 24166
  misc_feature (380)..(380): n is a, c, t, g, unknown, or other
  misc_feature (520)..(520): n is a, c, t, g, unknown, or other
aagctggagctccccgcggtggcggccgctctagaactagtggatcccccgggctgcaggaattcgcacgagaccattacctagaacatcctaatcaaaaaacgttgacggccaccccgcccacagccgcgacaaactcttcctcagacccacgccacgtacgatgcctctctccccttcccctccgcccaacgccgccgccgccgccgccctacccctcctcctgctgctcgtctgcgccagcagcattgccgcgcagccgctggcgtcgtcgcaggccaaggcgctcctccgggtgcgccgcctgctgttctacccgccggcgctcgagccgctgcgcggggcgccggacccctgcgcgctgccgcccgcgccggccntcgcagtcgcctgcgagggcggccaggtcacggcgctctccgtcctgggagaccgcgacccggacgcggcctggcgcgccgcgctgccggccagctttctcctccgaggcgctgttcaccacgctcaccaggctcccggngctcgcgcggcttctcgctcgttcggcctcggggcctggggcccgttcccgggggcccaactcccgcgggtccaggcggctgagaagttcaacctcaggtccaactacttctacgggggcgtccccgatggcctcgccc

SEQ ID NO: 24166 - protein, 165 aa, Zea mays
  misc_feature: Ceres CLONE 1395086-F
  misc_feature (73)..(73): Xaa is any aa, unknown, or other
MPLSPSPPPNAAAAAALPLLLLLVCASSIAAQPLASSQAKALLRVRRLLFYPPALEPLRGAPDPCALPPAPAXAVACEGGQVTALSVLGDRDPDAAWRAALPASFLLRGAVHHAHQAPGARAASRSFGLGAWGPFPGAQLPRVQAAEKFNLRSNYFYGGVPDGLA

SEQ ID NO: 24167 - DNA, 674 bp, Zea mays
  misc_feature: Ceres CLONE 1395087-F
  misc_feature: Encodes the peptide sequence at SEQ ID NO. 24168
  misc_feature (480)..(480): n is a, c, t, g, unknown, or other
  misc_feature (557)..(557): n is a, c, t, g, unknown, or other
  misc_feature (558)..(558): n is a, c, t, g, unknown, or other
  misc_feature (562)..(562): n is a, c, t, g, unknown, or other
cgcggtggcggccgctctagaactagtggatcccccgggctgcaggaattcgcacgagaccattacctagaacatcctaatcgaaaaaaccccaccagaccttcaaccgctacatttccgtcactaccggagccgccactccgacgaacgcgggcggcggagcggaagcgaaccagagcaccggtaaaaagaaaaggatgaggcttgggagtataaacggcttgcggttcacgcagcttaaacttgtcatccttgcgttcttcatgttgtttgttctctggaaatgggagaagggctcgtcatactacgattccgaaatcctccagccagatccgttggttctgactcatccagctaactcgaagtttgtagaccagcatacatccccagaagaagactttccaagtgcagatcgatcacaccggtcagtaggtaaagtagaaaagccggttactagtgcgctgccaccattgtctacgnataggctattctggtgatgttgcagatgggaatgaagtgccacctcctgagaagaaagatgcgagtacaggaatggnnaagntgggtttctgacaatcgtaacactatacctccagggggttgggttgtaagcaatggcttccaaaaggagtgggccctgcaaactaacccagcggaaaagatttcgcgtatga

SEQ ID NO: 24168 - protein, 99 aa, Zea mays
  misc_feature: Ceres CLONE 1395087-F
  misc_feature (95)..(95): Xaa is any aa, unknown, or other
MRLGSINGLRFTQLKLVILAFFMLFVLWKWEKGSSYYDSEILQPDPLVLTHPANSKFVDQHTSPEEDFPSADRSHRSVGKVEKPVTSALPPLSTXRLFW

SEQ ID NO: 24169 - DNA, 664 bp, Zea mays
  misc_feature: Ceres CLONE 1395093-F
  misc_feature: Encodes the peptide sequence at SEQ ID NO. 24170
tggagctccccgcggtggcggccgctctagaactagtggatcccccgggctgcaggaattcgcacgagaccattacctagaacatcctaatcgaaaaaaaaataaaatccaattttctcagtctcgagcgcccgcgtccctcgccccgtcgcgactcgcgacttcgcgagtcgccccgtcccagcctcccagccgtcccggctccccgcgaccccgccctccggcagtccggcgcgggggctcctctccgatccggtgagccgaacgaggatcccaactccccgaagaaagcggccacagccagagccagggtggctcggctctcctctcacagactgcgccgcagcgcctagcgctcggctggcagccgctccggccggtcggccccgcgcccccgcccctgctggctacatccgcctgcagccagaagatctgcctccagcgaccgccctgcctgccccttgtggcttctgtgagtctgcacaccagcacacgcacttgtccccaaacaacggcggtggcgatgagtatctcagaagagcttcccggcgaaggatctgaccgtgaggagggagtcttcatcaacggagaggacatcatccacgagataacatcgacgaagaagatctccccggacgcgacgactaaaatgacgacgtcgtca

SEQ ID NO: 24170 - protein, 47 aa, Zea mays
  misc_feature: Ceres CLONE 1395093-F
MSISEELPGEGSDREEGVFINGEDIIHEITSTKKISPDATTKMTTSS

SEQ ID NO: 24171 - DNA, 698 bp, Zea mays
  misc_feature: Ceres CLONE 1395094-F
  misc_feature: Encodes the peptide sequence at SEQ ID NO. 24172
  misc_feature (366)..(366): n is a, c, t, g, unknown, or other
  misc_feature (396)..(396): n is a, c, t, g, unknown, or other
  misc_feature (468)..(468): n is a, c, t, g, unknown, or other
  misc_feature (616)..(616): n is a, c, t, g, unknown, or other
  misc_feature (617)..(617): n is a, c, t, g, unknown, or other
  misc_feature (622)..(622): n is a, c, t, g, unknown, or other
tccccgcggtggcggccgctctagaactagtggatcccccgggctgcaggaattcgcacgagaccattacctagaacatcctaatcgaaaaattatccccagctttttctccaagcgtccgttcaggaagctgtccggcaacgagccgctcggcactgggcggtggccgtgcaagagcgatcgggaccgcatcgctcgtctgctcctccaggcctccgcctccctcatcatcactgcagcggcgagaagaacaagggacggtccggcggtggtctccactgacatcgcctaccatggctaccatgctgcgccggtgcatgcgggatctgcgcccgctgcggtctctcgcgagggtccccagaccgnatcttcttcgagagtccaacatttcttaanatgtagaagcaactcaacaaaggcatctccaaagagttctacacagaatggctgccccaggtcctcaaggcnaccttctccagtcggggaaagtaatgttttcaaagcttgctctgaaactccttgtgggggtcggtgcagcaggctataggtgcacattcaactggggttaatatagatctttcaattttaaggacaagacattgccttttagctaaannaaaanggagatgtccggaaaggtgggaataatttgaaagatctggaaaattcctcttgaaaccagaagggttgaccagaca

SEQ ID NO: 24172 - protein, 33 aa, Zea mays
  misc_feature: Ceres CLONE 1395094-F
  misc_feature (25)..(25): Xaa is any aa, unknown, or other
MATMLRRCMRDLRPLRSLARVPRPXLLRESNIS

SEQ ID NO: 24173 - DNA, 622 bp, Zea mays
  misc_feature: Ceres CLONE 1395097-F
  misc_feature: Encodes the peptide sequence at SEQ ID NO. 24174
  misc_feature (89)..(89): n is a, c, t, g, unknown, or other
  misc_feature (90)..(90): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (213)..(213): n is a, c, t, g, unknown, or other
  misc_feature (325)..(325): n is a, c, t, g, unknown, or other
aagctggagctccccgcggtggcggccgctctagaatagtggatcccccgggctgcaggaattcgcacgagaccattacctagaacatnncctaaatcgnnnaaaaacaagacgagatctacccgctgccccctcgcattcccctcccccgcgtcgtcatctccccaaatccccccaaaccctaccgccgatccggccccagatcgccatggncgcgcccaacagcaatgacgccgccagcgccagcggcaccggcccggctggcgaggaggacatctccatcgaggcgttggcgcggcgcgtgcaagagcacatgaccctcaantcgaaacccgccgctcgccgccacaagttcctgggagaaacagcccgtcgggcagttccgggacggcgccgacggatcggtaccgaaagggccccatcgagccggcccacgccactcttcggagggggggggccgaacccctaaccaattggccggcggccttccaagggggttaacctgggacctcggagggagaaaggggttcttggcagaaccttttatttggttgtgtccccccccaaattacccccggagggagaagaaagaaaacggggtcccccctttaaaaccaccccc

SEQ ID NO: 24174 - protein, 86 aa, Zea mays
  misc_feature: Ceres CLONE 1395097-F
  misc_feature (2)..(2): Xaa is any aa, unknown, or other
  misc_feature (39)..(39): Xaa is any aa, unknown, or other
MXAPNSNDAASASGTGPAGEEDISIEALARRVQEHMTLXSKPAARRHKFLGETARRAVPGRRRRIGTERAPSSRPTPLFGGGGPNP

SEQ ID NO: 24175 - DNA, 751 bp, Zea mays
  misc_feature: Ceres CLONE 1395104-F
  misc_feature: Encodes the peptide sequence at SEQ ID NO. 24176
  misc_feature (423)..(423): n is a, c, t, g, unknown, or other
  misc_feature (474)..(474): n is a, c, t, g, unknown, or other
  misc_feature (478)..(478): n is a, c, t, g, unknown, or other
  misc_feature (541)..(541): n is a, c, t, g, unknown, or other
aaagctggagctccccgcggtggcggccgctctagaactagtggatcccccgggctgcaggaattcgcacgagaccattacctagaacatcctaatcgaaaaaccttgtctacaagggttttccgctgtcttatcccttcgtccacgctccctgcagccgccgcccaaaccctagcaacccgtcctccgccatggccgacgaccactactcctctaagaggaagtacgacgacccctcgccgccgccgcggcgcacggggttctcttcgggcccgccgcctgcctcgccgctcgcgggcggcgccccgtcgtacaacagcgtgccaccgccccccgatgagatccagctcgcgaagcagcgcgcgcaggagatcgcggcgcggatctttaacgccgcagaggccaagcgtcctcgcgtcgacnacggcgacgatgacagcggcggctttcggtgtaggcctgggcagcactggntggncgtggccgcatccggcggcggaggactcggcttctcgtcttctggccgtggttggccacgggncttcttatccccacatatcttctcagagcagcggcactcaggactcctcttatgggggaaatccgggtacaagcaaaaagatgaaatttccaaagggaagggttgggttatcattggaaaaaccggggaaccttttaggtaaatcccacttcaatccggagaaagattcaggtcccaaggacccttggagttgaaccgggggccttgaaa

SEQ ID NO: 24176 - protein, 163 aa, Zea mays
  misc_feature: Ceres CLONE 1395104-F
  misc_feature (78)..(78): Xaa is any aa, unknown, or other
  misc_feature (95)..(95): Xaa is any aa, unknown, or other
  misc_feature (96)..(96): Xaa is any aa, unknown, or other
  misc_feature (117)..(117): Xaa is any aa, unknown, or other
MADDHYSSKRKYDDPSPPPRRTGFSSGPPPASPLAGGAPSYNSVPPPPDEIQLAKQRAQEIAARIFNAAEAKRPRVDXGDDDSGGFRCRPGQHWXXVAASGGGGLGFSSSGRGWPRXFLSPHIFSEQRHSGLLLWGKSGYKQKDEISKGKGWVIIGKTGEPFR

SEQ ID NO: 24177 - DNA, 680 bp, Zea mays
  misc_feature: Ceres CLONE 1395107-F
  misc_feature: Translation starting site: 256
  misc_feature (255)..(255): n is a, c, t, g, unknown, or other
  misc_feature (299)..(299): n is a, c, t, g, unknown, or other
  misc_feature (302)..(302): n is a, c, t, g, unknown, or other
  misc_feature (308)..(308): n is a, c, t, g, unknown, or other
  misc_feature (370)..(370): n is a, c, t, g, unknown, or other
  misc_feature (374)..(374): n is a, c, t, g, unknown, or other
  misc_feature (375)..(375): n is a, c, t, g, unknown, or other
  misc_feature (383)..(383): n is a, c, t, g, unknown, or other
tggcggccgctctagaactagtggatcccccgggctgcaggaattcgcacgagaccattacctagaacatcctaatcgaaaaacacgactagaaccaggcaaccagctgcggagggaggaaacctagcggaacactgtgcaggtgacggcggcgcgctaccggtgacaggggatacggaggcatcgtcccctcctccatcccggcgcggcggcgccagcagccggcctgcaggcacacaagtggccacccttccnatggcggtggagaagtccagcagcggcacatcaactccctccanccnactcancatggaccggtttcagaagattgtcctaagctgggattacctccgtctcgtcgctgaatccnaggnncgcagcangccaggtgctgcagcatgtgaagaccataacgctcggggctgaaaaaccttggtgcctttgaccatgctcttttgggaagcaaagcgcaaatatccggggaccaaaaacaacagaaatctttgggggggctggtggggggggggaaatgggggtctccgcccaatttttagagggtccccaaacctcctgggggggggagaaaaaattttcagaaattggggccaaaaaaaagtttcatcttttttcccgggaaaaatttgggggggggcccccccccagggagtatgagtttgata

SEQ ID NO: 24178 - DNA, 719 bp, Zea mays
  misc_feature: Ceres CLONE 1395111-F
  misc_feature: Encodes the peptide sequence at SEQ ID NO. 24179
  misc_feature (575)..(575): n is a, c, t, g, unknown, or other
aaagctggagctccccgcggtggcggccgctctagaactagtggatcccccgggctgcaggaattcgcacgagaccattacctagaacatcctaatcgaaaacctccccatcgcgtctgtccgctacccctccccgaccagatcgctacgagacgccgcgcgatccgacccaggccgacgccgacgacccctctcgccgccggcggccatggcgtacggcgaccgcgtcaccaccttcgaggactccgagaatgagagcgagtacggctatgtccgcaaggtctctggacctgtggttgtggctgatggaatgggtggtgctgccatgtatgaacttgttcgtgtcggacatgataacctcattggggaaattatccgtcttgagggcgattcagctacaatccaagtttatgaggaaacagctggactgatggttaatgaccctgtattgagaacaagaaagcctctttcagttgaattgggacctggaattcttggaaacatttttgacggtatccagcgacctctaaaaaccatcgctattaagtcaggagatgtgatattccctccggggnggtttcagttcctgcctttgacaaagattgtatttgtggggaatttcagccaacgaagctaggtgggtgggagatgtcataccaagggggagatctataccgctactggtttttgagaacacattggatgcagcaccatgttgg

SEQ ID NO: 24179 - protein, 142 aa, Zea mays
  misc_feature: Ceres CLONE 1395111-F
  misc_feature (22)..(84): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
  misc_feature (123)..(123): Xaa is any aa, unknown, or other
MAYGDRVTTFEDSENESEYGYVRKVSGPVVVADGMGGAAMYELVRVGHDNLIGEIIRLEGDSATIQVYEETAGLMVNDPVLRTRKPLSVELGPGILGNIFDGIQRPLKTIAIKSGDVIFPPGXFQFLPLTKIVFVGNFSQRS

SEQ ID NO: 24180 - DNA, 675 bp, Zea mays
  misc_feature: Ceres CLONE 1395112-F
  misc_feature: Translation starting site: 179
  misc_feature: Pfam Name: Enolase_N Pfam Description: Enolase, N-terminal domain
  misc_feature: SWISSPROT Homolog: EC 4.2.1.11 Phosphopyruvate hydratase
  misc_feature (548)..(548): n is a, c, t, g, unknown, or other
  misc_feature (601)..(601): n is a, c, t, g, unknown, or other
tacccgcggtggcggccgctctagaactagtggatcccccgggctgcaggaattcgcacgagaccattacctagaacatcctaatcgaaaagccgccaccgtcaccgtggcccgccgccatataagtaaaccctcgcctcgtcctcctcccaggctcgccaccctccgcctccgacacatggcccacccgcacctcgtgctcccctccccgaagtccctcctccccgccgccgcaactccatcgcgccgcgccgtcgccatccgcgcggcgctctccaccactttgtctccggccaaggcggcagctggagcagaggcggtgcgatcgatccgcgcgcggcagatcgtggacagccgcgggaaccccaccgtcgaggtcgacctcgtccgccggggacggacgcctccaccgctccgcggtgcccagcggggcgtccacggggatctacgaggcgctggagctccgcgacggtgacaaggccgtatacggcgggggaagggcgtaactccaagctgtgcgcaccatcaacgaggttatcgcgcctagnctcaaaaggcgtcgatgtgaggaccaaagcgatggttgatgcagtcatgctanacattgatgaactcaaaataaaccggaaagttgggtgccatgtttaatctcgagtcctcctgagaggaagggag

SEQ ID NO: 24181 - DNA, 674 bp, Zea mays
  misc_feature: Ceres CLONE 1395113-F
  misc_feature: Encodes the peptide sequence at SEQ ID NO. 24182
  misc_feature (467)..(467): n is a, c, t, g, unknown, or other
  misc_feature (471)..(471): n is a, c, t, g, unknown, or other
  misc_feature (503)..(503): n is a, c, t, g, unknown, or other
  misc_feature (526)..(526): n is a, c, t, g, unknown, or other
  misc_feature (527)..(527): n is a, c, t, g, unknown, or other
  misc_feature (537)..(537): n is a, c, t, g, unknown, or other
  misc_feature (600)..(600): n is a, c, t, g, unknown, or other
  misc_feature (632)..(632): n is a, c, t, g, unknown, or other
  misc_feature (662)..(662): n is a, c, t, g, unknown, or other
  misc_feature (663)..(663): n is a, c, t, g, unknown, or other
aagctggagctccccgcggtggcggccgctctagaactagtggatcccccgggctgcaggaattcgcacgagaccattacctagaacatcctaatcgaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagtgggcngcangggtgtgggggggaggccacctacgacctcgnccacgtgctcgccttcctcgccnngtctcgcttncacatctccgtctacatcatgtccagggccagggccgtgtacctcatcgacttcgcatgctancagccggcgacgagctcaaggtgtccaaggcnggagtcatcgacctggcgcgcaagtccggnnaggtcgacgag

SEQ ID NO: 24182 - protein, 156 aa, Zea mays
  misc_feature: Ceres CLONE 1395113-F
  misc_feature: SWISSPROT Homolog: EC 2.3.1.119 Icosanoyl-CoA synthase
  misc_feature (89)..(89): Xaa is any aa, unknown, or other
  misc_feature (107)..(107): Xaa is any aa, unknown, or other
  misc_feature (111)..(111): Xaa is any aa, unknown, or other
  misc_feature (132)..(132): Xaa is any aa, unknown, or other
  misc_feature (153)..(153): Xaa is any aa, unknown, or other
MAREEQALLSTEIVNRGVEPSGPDAGSPAFSVRVRRRLPDFLQSVNLKYVRLGYHYLISHGVYLATIPVIVLVCGAELGSLSRDEWAAXVWGGGHLRPRPRARLPRXVSLXHLRLHHVQGQGRVPHRLRMLXAGDELKVSKAGVIDLARKSGXVDE

SEQ ID NO: 24183 - DNA, 733 bp, Zea mays
  misc_feature: Ceres CLONE 1395115-F
  misc_feature (297)..(297): n is a, c, t, g, unknown, or other
tccccgcggtggcggccgctctagaactagtggatcccccgggctgcaggaattcgcacgagaccattacctagaacatctaatcgaaaagtttccctcctaatttggatgagtataacaagtggaaagcttcatttcagaagagaaaagattatttagatgctgtggcttcagatggttgtttgactcagagttcacaggggttggctgcaggggagatgatttacagtttgagagattacttgaaagattctggtcagcaatagcatctcaaaccttaactggagtgcatctaanaggcggtcctgggagacggtttagacaaggagacactgggacttcaactccaacctttagcggaagccaggggaaaggggggttttggccactctactgacacctcagagaagaaaggcacttgaggaaactcccggggtttctttatcaaggccaggaaaaaatcccgcaaggcccactcccgaaatgggggctaaaaacccaagggccaaagaatccaaaaacaaggggatccccttttggcccccctgggtttttcccagggggggggggcccttgcaaaaaaaaactttgggggggcttcccaggttaaagaaaagggggggggcctctcaagggagggggttaaaaaggggggaaaaatgggttctctctggagaggggggaacaaaacaaggggtttccccctctccccctctttgagaaaaaggggtgg

SEQ ID NO: 24184 - DNA, 642 bp, Zea mays
  misc_feature: Ceres CLONE 1395116-F
  misc_feature: Encodes the peptide sequence at SEQ ID NO. 24185
  misc_feature (164)..(164): n is a, c, t, g, unknown, or other
  misc_feature (237)..(237): n is a, c, t, g, unknown, or other
  misc_feature (238)..(238): n is a, c, t, g, unknown, or other
  misc_feature (330)..(330): n is a, c, t, g, unknown, or other
  misc_feature (331)..(331): n is a, c, t, g, unknown, or other
  misc_feature (335)..(335): n is a, c, t, g, unknown, or other
  misc_feature (353)..(353): n is a, c, t, g, unknown, or other
  misc_feature (438)..(438): n is a, c, t, g, unknown, or other
aagctggagctccccgcggtggcggccgctctagaactagtggatcccccgggctgcaggaattcgcacgagaccattacctagaacatcctaaaaaaaaagcagtccaaacacgcaacgcaacactcgccttcccctcccaaccctccgaaccgaagcagcanagctagacgatgacgctgacgatcccggacgaggtgcgcgccaaggcggaggtgtacgtgggcgacgcggcgnngcaggagaagacgcggctgctcctccagaagacggggcctcccgagcgggctgctccccgctgcggggacatcaatcgagtggcggcctacnntggnaggaagacggggcttcgntggtgggttcccggcagcggcccgcaagggtgggacccaattaactttcgcccaaagggcggggccggccacgggggtctaaacnggggcccaaggggggtcccggggggggggcccaaaaaagggccccggctttcaaagaaaaaacaccgggggggtcaaaggggcaaaaagaaaaatgttttttgtgggggggcccccccccccccagaaaaatattgggtggaaaaaaaccccccccccccgggggaaatctccccctgggggggggcacaaggggggggggcgg

SEQ ID NO: 24185 - protein, 156 aa, Zea mays
  misc_feature: Ceres CLONE 1395116-F
  misc_feature (22)..(22): Xaa is any aa, unknown, or other
  misc_feature (53)..(53): Xaa is any aa, unknown, or other
  misc_feature (89)..(89): Xaa is any aa, unknown, or other
MTLTIPDEVRAKAEVYVGDAAXQEKTRLLLQKTGPPERAAPRCGDINRVAAYXGRKTGLRWWVPGSGPQGWDPINFRPKGGAGHGGLNXGPRGVPGGGPKKGPRLSKKKHRGGQRGKKKNVFCGGAPPPPEKYWVEKNPPPPGEISPWGGAQGGGA

SEQ ID NO: 24186 - DNA, 675 bp, Zea mays
  misc_feature: Ceres CLONE 1395118-F
  misc_feature: Encodes the peptide sequence at SEQ ID NO. 24187
tggagctccccgcggtggcggccgctctagaactagtggatcccccgggctgcaggaattcgcacgagaccattacctagaacatcctaatcgaaaaataccactccacaatcacacatttgacaccgccaatccatggccttggcgacgccgctgcggctccgccgccacctcctcctccccgccgggccgtccccggcgacccaccgcgccctgtcgctgcggcggggccgcctcctccccgcaagcctgtcgtccgccgcggcgggcgggcggccgacggtgctggtgacggagacgctgggttccgcgggggtggacctgctgcgcgccttcgccaacgtggactgctcctacgagctgacggaggaggagctccgcgccaaggtgtcgctcgtggacgcgctggtggtgcgcagcgggacgcaggtgacgcggcaggtgttcgaggccgaccgcgccaggttccgcgtcgtcgagccgctcgacgacgttctggtctccgtcctcatacaggagctgagggaaaacggcagcctggtggaataggtcattatgctcacgacaaaccaggtgataagaagactggtgatgacaaggaccaaggggaaggcgaactggcccgactggacaagttgcttaggaccgaaaagggtcaagatccagggactttgc

SEQ ID NO: 24187 - protein, 137 aa, Zea mays
  misc_feature: Ceres CLONE 1395118-F
  misc_feature: SWISSPROT Homolog: EC 1.1.1.95 Phosphoglycerate dehydrogenase
MALATPLRLRRHLLLPAGPSPATHRALSLRRGRLLPASLSSAAAGGRPTVLVTETLGSAGVDLLRAFANVDCSYELTEEELRAKVSLVDALVVRSGTQVTRQVFEADRARFRVVEPLDDVLVSVLIQELRENGSLVE

SEQ ID NO: 24188 - DNA, 751 bp, Zea mays
  misc_feature: Ceres CLONE 1395119-F
  misc_feature: Encodes the peptide sequence at SEQ ID NO. 24189
  misc_feature (633)..(633): n is a, c, t, g, unknown, or other
tcaccgcggtggcggccgctctagaactagtggatcccccgggctgcaggaattcgcacgagaccattacctagaacatcctaatcgaaaaatagtccataccgtgcctcatctagtcatctcgtcttaggtagcggccgaaccagagccccgtcccaactccaccacctctcttctctacggcgcgagcaagggcggcgccggccgcggcgtcggcgggaaccgggcctcgctctcctcatctctccgatcacttctgtcttgtgaaaatggcggatgaactatgctcaatgtctgtgggtcagaagttccatgggcagtccgtgctgttgagcagaatttccttcctaattctgcccatggaacaacccctggtatttcaacaatgggcctaattcctggcttaacaatgggggccccccaaaagagtgccccataatccaagggggggaaagaaaatggggaaacttgggtggggaacctcccccattccgggcccgggggcaacccaactccccccgggggccttttgcgcgttttgcggcccccaccaaaaaaagagaaaagagggggttttttttttcggggcgattatttttggggagcccccccctcttttttttttgtggacgnggggggggggggagagagattttttcttggggggggcgggtggggggggccgcgcccccaaaaaaaaaaaaagtgggggtgggggaccctctccccacaaagtggggtgtgcggcggg

SEQ ID NO: 24189 - protein, 41 aa, Zea mays
  misc_feature: Ceres CLONE 1395119-F
MADELCSMSVGQKFHGQSVLLSRISFLILPMEQPLVFQQWA

SEQ ID NO: 24190 - DNA, 674 bp, Zea mays
  misc_feature: Ceres CLONE 1395123-F
  misc_feature: Translation starting site: 143
  misc_feature (224)..(224): n is a, c, t, g, unknown, or other
  misc_feature (257)..(257): n is a, c, t, g, unknown, or other
  misc_feature (277)..(277): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (354)..(354): n is a, c, t, g, unknown, or other
  misc_feature (355)..(355): n is a, c, t, g, unknown, or other
  misc_feature (357)..(357): n is a, c, t, g, unknown, or other
  misc_feature (358)..(358): n is a, c, t, g, unknown, or other
  misc_feature (654)..(654): n is a, c, t, g, unknown, or other
gctctagaactagtggatcccccgggctgcaggaattcgcacgagaccattacctagaacatcctaatcgaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccnacaaggagatcttcctccgcgagcttatctccnactcttccgatgcgctggancagatcaggttcgagagtctcactgaccagagcaaggctcgattgcgccannnnnnnnncnnnnnnnnnnnnnnngnngnngggggagagagacgcccccctcttttttttttttttttctccaaaaatatttcccccccccccccaccccccccttttttttgtgggttcccccccaaaaaaaaaggggcccccggaaaaaaaagggtttttttccaaatttaaattctgaaaaggggggggatttttcggggatttgggacacccaaaaagattccccgcaaacccctttttgttggaaaaaaaaacaaacacccttcccggggggggaaacccacatttttcccccccccgggggggttctctccccggacggncaccccccccccaggggggg

SEQ ID NO: 24191 - DNA, 755 bp, Zea mays
  misc_feature: Ceres CLONE 1395124-F
  misc_feature: Encodes the peptide sequence at SEQ ID NO. 24192
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (550)..(550): n is a, c, t, g, unknown, or other
ggggnnnnccccnnnnnnacccccggggaccgcgccccggccggcggggccaaatatagctccaccgcggtggcggccgctctagaactagtggatcccccgggctgcaggaattcgcacgagaccattacctagaacatcctaatcgaaaaagcagtactgcctccactgcagtcccagctcagagctctcagcggtggcggccggcgaccggcgacatcctccggtatcgactcccgtggagtggagcgttgaaccacgctgcggacctgcattcaccagtccgccgtttccttcgccttcgccttctccgcgtgatccggttgctctggccactgatggccggtgacattacatgcggatccttgctgcaaaaattgcagttgatatgggatgaagttggcgagagtgatgaggatcgtgacaaggtcctttatcagctggatcaggaatgccttgatgtttacaagaggaaagttgaccaagcaactaactctagggatctcctgatccaggctctggatgactcaaagatagaacttgctaggcnttctttctgggccttgggagaaaaagctattgccagaaccccttgagaaagaccacagggaaccatcaagcgagcagctaggctgctataggcgccaaccactttggagaaggttggctaaacagaaagaatgaggggacgccaccggggggctgtgttaaatgtaccaaccccaaattgattcaaaaataagggggggggaaat

SEQ ID NO: 24192 - protein, 85 aa, Zea mays
  misc_feature: Ceres CLONE 1395124-F
  misc_feature (71)..(71): Xaa is any aa, unknown, or other
MAGDITCGSLLQKLQLIWDEVGESDEDRDKVLYQLDQECLDVYKRKVDQATNSRDLLIQALDDSKIELARXSFWALGEKAIARTP

SEQ ID NO: 24193 - DNA, 741 bp, Zea mays
  misc_feature: Ceres CLONE 1395125-F
  misc_feature: Encodes the peptide sequence at SEQ ID NO. 24194
  misc_feature (543)..(543): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (567)..(567): n is a, c, t, g, unknown, or other
  misc_feature (652)..(652): n is a, c, t, g, unknown, or other
  misc_feature (656)..(656): n is a, c, t, g, unknown, or other
  misc_feature (660)..(660): n is a, c, t, g, unknown, or other
tccccgcggtggcggccgctctagaactagtggatcccccgggctgcaggaattcgcacgagaccattacctagaacatcctaatcgaaaaaggcctcgccactcttccgaacctgtagtcgcttacccactgccaactcagcgccaaactgtggagaattttttttttacctatttctatttatggtggtggtggtgtgcaatcgcaggaacaatcaccaccgttattaagaagatgatgcgctgcgctgcaacgggcggcgggtgcgtcgcttcgtggagcggcgattggagattgccggcggtcaacccctgcagcgtgcggatgccgacgggcaacgatgggtggtgcgccggcctgaggtcgcgggcggcggatctcgccggcctcgagatggccaacctgcgcggcggcgtcggggggctcttccgcgcgagcccgcgctacgggcgcttgcaagccacggcggcagttgaccctgaagatattccattggagaaggttcaagttaaatcctcaggacatgttctgccatatgttgncgttgctttgtttgnnngctattnctgtttgttaccatccttggtgtggtcaatggcgcacttgatatctcgcgaaggatcttgggattgctgaaatgctgctttgaangggntggntggttagcacatccttggctggtgcacactaagtcttttaactgggggttctttgcaagataaattggcggacaaaaaatt

SEQ ID NO: 24194 - protein, 133 aa, Zea mays
  misc_feature: Ceres CLONE 1395125-F
  misc_feature (103)..(103): Xaa is any aa, unknown, or other
  misc_feature (108)..(108): Xaa is any aa, unknown, or other
  misc_feature (109)..(109): Xaa is any aa, unknown, or other
  misc_feature (111)..(111): Xaa is any aa, unknown, or other
MMRCAATGGGCVASWSGDWRLPAVNPCSVRMPTGNDGWCAGLRSRAADLAGLEMANLRGGVGGLFRASPRYGRLQATAAVDPEDIPLEKVQVKSSGHVLPYVXVALFXXYXCLLPSLVWSMAHLISREGSWDC

SEQ ID NO: 24195 - DNA, 642 bp, Zea mays
  misc_feature: Ceres CLONE 1395126-F
  misc_feature (463)..(463): n is a, c, t, g, unknown, or other
  misc_feature (464)..(464): n is a, c, t, g, unknown, or other
  misc_feature (496)..(496): n is a, c, t, g, unknown, or other
  misc_feature (499)..(499): n is a, c, t, g, unknown, or other
tcaccgcggtggcggccgctctagaactagtggatcccccgggctgcaggaattcgcacgagaccaacctagaacatcctaatcgaaaagaacacgatccctttctcccctttccctgcgtagtgcggagctccagtgaaggaaccaaacagcgcaacacacgaacacaccaggcggcaggctccaccccgtccttttcctgccttttccccccgtcgagttaatccatccagtcgccaaaagctttgctaaatttcacgtgtctcgcctcgagtcgtccctaatccgacgatgccttgttctactcctaaaaaaacccaaagatcctgactttctcttgctgctagcctcccttttcccttctcccttaatcgcactgttggaagctcttcgctgtcacccccacccacctccggcgctcttttttagcattttccttgggctctggactccaaaatccagnnctttggttggctctctggctctggctgatggnggnccccgggtcaggactcttgattgcccctcgggggggggtcggtcccaatggcggaactggcctggcaagggcaaaaaaagggggtgccgaactccaaaggaggtggaaaacccccctcaatgttgcccgaggggccccgggaa

SEQ ID NO: 24196 - DNA, 658 bp, Zea mays
  misc_feature: Ceres CLONE 1395127-F
  misc_feature: Encodes the peptide sequence at SEQ ID NO. 24197
  misc_feature (474)..(474): n is a, c, t, g, unknown, or other
  misc_feature (482)..(482): n is a, c, t, g, unknown, or other
  misc_feature (531)..(531): n is a, c, t, g, unknown, or other
  misc_feature (561)..(561): n is a, c, t, g, unknown, or other
acccgcggtggcggccgctctagaactagtggatcccccgggctgcaggaattcgcacgagaccattacctagaacatcctaatcgaaaaattcggatttccttccgccttccgacagcggctgtctcggcgacccaaccccagcctgaccccacctcccgccgccgccgccgccgccgccgcgccttcgtcgtcaggagaagggtcccggtggctgcgtctctctcccctgcccccctgctccacactcggttcacgcgtcggctcgctaccgcaggccctcgactcgtacgcccgtccccggcggcgatccggccggcaccgtaaccctaggactccgacggagcaggaatgatgagtcatgaacaacaaattgtccctcctagtaagggttctgtgaatgggttcccccatagaaaactggataaggagggcagtggaacgcaaagtagaataaatttggtgaggcatccntctggtgnttttactaattcagggcatggaaagcattccagggaccgctaatctatngtctaacacaacttattgggcatcatgtgnacgtgcatgtgaataaacgctctataatctctggaattttccatgcacaaccctgacaaagacctttggcgcgtctaaaaaatgctcagcctaaaaa

SEQ ID NO: 24197 - protein, 56 aa, Zea mays
  misc_feature: Ceres CLONE 1395127-F
  misc_feature (43)..(43): Xaa is any aa, unknown, or other
MSHEQQIVPPSKGSVNGFPHRKLDKEGSGTQSRINLVRHPSGXFTNSGHGKHSRDR

SEQ ID NO: 24198 - DNA, 671 bp, Zea mays
  misc_feature: Ceres CLONE 1395131-F
  misc_feature: Encodes the peptide sequence at SEQ ID NO. 24199
gctctagaactagtggatcccccgggctgcaggaattcgcacgagaccattacctagaacatcctaatcgaaaatctctatgacacgtgccccttcccccctcttaagctaagggacccttgggcagcccggcatcttctccaatctccaccctctgcccctctcgatttcttcttcccatctcccgatccatcgcaacccaaaccctactccaggcagatctccgtctccgccgacgctgccggcgtgagcacagcatcagatccgctgtgatggcgttccgccgcatcctatccaccgcggtgcgccgccgctcggccgtggccgccgcggcggccgggaacgcgcgcgaggcctccacggccgtcgctgcggcgccacgtgtgctcgcccccgatgcgaccgcggtgcgcgctcccgtgatgccgtatgaccgcatcgccgaggccgtcaacgccaggctccggcggatcgagcacccagacccgcgcttcctccgctacgccagccccgtgccgtcccacgcggaccacatggccatccttgcggcgccagagacccgggtcaccacactgcccaacggtctgcgcatcgccacggaggcttcccttcgcgcgcgcacgattacggtcggcgtgtggatcgatggcggcagcaagtacgacaatgag

SEQ ID NO: 24199 - protein, 133 aa, Zea mays
  misc_feature: Ceres CLONE 1395131-F
  misc_feature: SWISSPROT Homolog: EC 3.4.24.64 Mitochondrial processing peptidase
MAFRRILSTAVRRRSAVAAAAAGNAREASTAVAAAPRVLAPDATAVRAPVMPYDRIAEAVNARLRRIEHPDPRFLRYASPVPSHADHMAILAAPETRVTTLPNGLRIATEASLRARTITVGVWIDGGSKYDNE

SEQ ID NO: 24200 - DNA, 668 bp, Zea mays
  misc_feature: Ceres CLONE 1395132-F
ggagctccccgcggtggcggccgctctagaactagtggatcccccgggctgcaggaattcgcacgagaccattacctagaacatcctaatcaaaagcaaaaacccgccactctcagatccgcacagcgacgccgccagccagacccgatcccctccctcgctagggttttcgtccccgcgccgccgcgctcccggatcccaccgaaacaccttgcccggcggtcccgcggcgttgccgctcctgcccaacatcgcgcaggtggctgcggggctcggagccgcgtcctcgctcgactccgcgtcgctctacaccgtcacaggtgtaaagcgcgccggcatcttccaccgtttccgcgggctgctccctgagacgggcggcgagggctcctctttcctcgtgccctgggtgaacaagcccttctcttcgacttccggccgggcccgacaactcctcctccaactcggggaccaagggactggagattggcaaccttacgttgggttttctcttccgccccggaggttcagaacctcccccccatttttcaccttcctccggattccagttcccaccccccaatgggcttccccctcccttcgggaaaacagggtggctttaagcgcccgcctccttccccccaattttcaatggccccccacagcccctg

SEQ ID NO: 24201 - DNA, 696 bp, Zea mays
  misc_feature: Ceres CLONE 1395133-F
  misc_feature (511)..(511): n is a, c, t, g, unknown, or other
  misc_feature (535)..(535): n is a, c, t, g, unknown, or other
  misc_feature (619)..(619): n is a, c, t, g, unknown, or other
tggagctccccgcggtggcggccgctctagaactagtggatcccccgggctgcaggaattcgcacgagaccattacctagaacatcctaatcgaaaaatcacttgttcttcttcgagctaccagctgcctatcatggtcatcatggtcgagctgctgcccccacttgcctctctaatcctcagtcctctgtagagctggtcctcctacccctcactttgccttgagcaatttggtttctagcatctgtggggtggcttgtgggtggtcgccttggactgctccttcctccacctgccgcgccggcagggcgacgaggtccaaaagcctggtggggctcatcatcaagaacaccgaagcggcgagagtggcatgggatctgatccgaggcggagctcgaggagctgagggctgtacgtgctcttggatccggtagagatccgtgccctcgtgttcgtccccggccgccgcgatggggaacacgtgcgtcggccccagcatcaccatgaacgncttcttccagtccgtggccacggnggctgtggaagacgccccaaggaaagggcgacgcgctgcccgccgccgccattgggccccggcggcggcaggcccgggcccggncgccagccggcggctgccgaagcccggcggcccgaaggggcaccacgccgcccggggcaaagcgaaggcccccggaa

SEQ ID NO: 24202 - DNA, 684 bp, Zea mays
  misc_feature: Ceres CLONE 1395135-F
  misc_feature: Encodes the peptide sequence at SEQ ID NO. 24203
  misc_feature (405)..(405): n is a, c, t, g, unknown, or other
  misc_feature (411)..(411): n is a, c, t, g, unknown, or other
  misc_feature (425)..(425): n is a, c, t, g, unknown, or other
  misc_feature (433)..(433): n is a, c, t, g, unknown, or other
  misc_feature (434)..(434): n is a, c, t, g, unknown, or other
aagctggagctccccgcggtggcggccgctctagaactagtggatcccccgggctgcaggaattcgcacgagaccattacctagaacatcctaatcgaaaaataaaaaaaactgagcctgcccgcccgcccgcccgcgcgctccgctccgtgaactatatctatctatcacctgctgctccaaggaggcggacagaggcaggcaggaaggcactcacttctccaggagctcggagtcggcagcaagaagagaatggggccgccgacgccgccgccgccgccacccttcgtactgctctctcccaaggtctggtgctgtggcatgtttagtgcaatcttcattgcttgctgtcttgctgcatttaacacagcacgagcttcagagaatagtccaagcctatctgtngtgccnagagatctcatccnagggtttnnacgcatgaaccatttctaaagcacaaggacgtgatgcctttatccattcatccagagagcaaatggcgtcaccaggaggcacccgacagcgggttcgtccacataaccgaaggaagtcatcgacgggtaccaagtttctggggcccgagccccttgatcagggccagaaggttggaaaacttgctcggccacccccggcaaatttactaccagttccggggggccgcccccggggggtccccaaaaccca

SEQ ID NO: 24203 - protein, 72 aa, Zea mays
  misc_feature: Ceres CLONE 1395135-F
  misc_feature: SWISSPROT Homolog: EC 4.2.1.20 Tryptophan synthase
MPLSIHPESKWRHQEAPDSGFVHITEGSHRRVPSFWGPSPLIRARRLENLLGHPRQIYYQFRGAAPGGSPKP

SEQ ID NO: 24204 - DNA, 666 bp, Zea mays
  misc_feature: Ceres CLONE 1395136-F
  misc_feature: Encodes the peptide sequence at SEQ ID NO. 24205
  misc_feature (529)..(529): n is a, c, t, g, unknown, or other
aaagctggagctccccgcggtggcggccgctctagaactagtggatcccccgggctgcaggaattcgcacgagaccattacctagaacatcctaatcgaaaaatctagggctattacaaagcgtgcaaggcttctttcctcccaaatcccctgagcaaggcccccgtcggctagcgccgcagccgtcggcgccgacgccgagtctcgccggcaggcgtgtgcagagggtcccttccccgctcccggcgccatggactgcgcaaagggaaggtcggaggggaacctctacgacgagctgatggtggagatcttctcgcgcatgcccgtcaaagacctccgccgttccacttacgtgtgcaaatcttggcgcaacctcatcaccgagcccctcaaccgcatgaagttgtgccagaccctgtaaggcttcttccacggcggcgtcggaggccctcgcagctagcggacatttcaccagcctgccgagtagcgaagtgcctcaggtcgacccttccttctcttgtatcaaggncatggtgccaggggacgagcgcatggtcctctagtattcgtgcagcgggatcctgctctttgaaagcacgcgggaggtctaggtcggtcacatcgtgtcagacctgcgaccaagagatagttgactgtgcccgacag

SEQ ID NO: 24205 - protein, 56 aa, Zea mays
  misc_feature: Ceres CLONE 1395136-F
  misc_feature (7)..(54): Pfam Name: F-box Pfam Description: F-box domain
MDCAKGRSEGNLYDELMVEIFSRMPVKDLRRSTYVCKSWRNLITEPLNRMKLCQTL

SEQ ID NO: 24206 - DNA, 712 bp, Zea mays
  misc_feature: Ceres CLONE 1395138-F
  misc_feature: Translation starting site: 258
  misc_feature: Pfam Name: FGGY_N Pfam Description: FGGY family of carbohydrate kinases, N-terminal domain
  misc_feature (228)..(228): n is a, c, t, g, unknown, or other
  misc_feature (374)..(374): n is a, c, t, g, unknown, or other
  misc_feature (475)..(475): n is a, c, t, g, unknown, or other
ggagctccccgcggtggcggccgctctagaactagtggatcccccgggctgcaggaattcgcacgagaccattacctagaacatcctaatcgaaaaattttcacggtcaccagtccctcctacccgcttcccataaaatcttctgatctgtaacgcattcgtcgtcgcccacatccgcttcgctctcttgctcttttagtcccatctcccatcccacctgggaggcgnaatttcgtctggggaaaaagtcggcggccatggcggggcgagactccctcccggagggctctctcttcctcggattggacagctcccactcatcactgaaagctacggtgctcaataatgagctcacaatagtagcttctgaaaantgtaattttgactctgaatttgcacactaacaaactggaagttggggtgtacagagacccagcagatgataggcacatttttttcaccaccattatggggntggaagcttttgaaggtgctgcttggaaagctaaaacaaggaatcacttcggaaaggaagggcttgttcctggggatggccaggaacaatggcagggtttttttgaaaaaggggcccccctgttgggtatcccccctggggggcaaaaaaaagttttttttcccaacccgggggggggttttttacaagggacccccctttttgggggggggaggggccccaaaagcagtgcgaaaa

SEQ ID NO: 24207 - DNA, 649 bp, Zea mays
  misc_feature: Ceres CLONE 1395139-F
  misc_feature: Encodes the peptide sequence at SEQ ID NO. 24208
  misc_feature (566)..(566): n is a, c, t, g, unknown, or other
  misc_feature (584)..(584): n is a, c, t, g, unknown, or other
tggagctccccgcggtggcggccgctctagaactagtggatcccccgggctgcaggaattcgcacgagaccattacctagaacatcctaatcgaaaaacacacccggaccccggtctgcgtttgtccctgcgggctgcggccctgcctcttctcgtctcccgttcccctcgccgcgtgagctctctctctctctctctctcctctgtggtgacgactgggcgcccgcacccctggcagccgccgccgcccagtccccgtcgggcccttcggcaggtcttcttcggcctcttcgccggcgacgagccgcaccaggcgtacatgtgtacacccagcccaggcccttaactgcgcccgcccctgcgactggttttcctgctggtttctgtggatttggctgccggaggattggtgcagcctttaggatcacggtagattcgctgtgaaatccgaagggtgctcaggtcatgttgggggaccagcgcatgatactgggcttagactcggcaacctcatcaagcactgcccctgatttgacccgcgctgaagaggatccttctgtgagcangagctgcgtgatcgacgnctgcaaggtggagtgcgcgcaaaagtagacggggggggagggtcctggtgattgttatagcaaga

SEQ ID NO: 24208 - protein, 48 aa, Zea mays
  misc_feature: Ceres CLONE 1395139-F
  misc_feature (34)..(34): Xaa is any aa, unknown, or other
  misc_feature (40)..(40): Xaa is any aa, unknown, or other
MLGDQRMILGLDSATSSSTAPDLTRAEEDPSVSXSCVIDXCKVECAQK

SEQ ID NO: 24209 - DNA, 586 bp, Zea mays
  misc_feature: Ceres CLONE 1395143-F
  misc_feature: Encodes the peptide sequence at SEQ ID NO. 24210
  misc_feature (208)..(208): n is a, c, t, g, unknown, or other
  misc_feature (232)..(232): n is a, c, t, g, unknown, or other
  misc_feature (260)..(260): n is a, c, t, g, unknown, or other
  misc_feature (284)..(284): n is a, c, t, g, unknown, or other
  misc_feature (294)..(294): n is a, c, t, g, unknown, or other
  misc_feature (326)..(326): n is a, c, t, g, unknown, or other
  misc_feature (366)..(366): n is a, c, t, g, unknown, or other
aagctggagctccccgcggtggcggccgctctagaactagtggatcccccgggctgcaggaattcgcacgagaccattacctagaacatcctaatcgaaaaacatgccacattgccaccaagccacagttccacctttcgattcatgcacgctcagtcatgggcgccctccggagtttagccatctcctacccggagttcctcgtggncgggctgtgcttcgtctccctctncggcctgcgcacgcgatgcgtgagcggncggcacgcgcccccctgagctggnctgtggtggncatgctccccgtcgtgctcgcgaacctcgggngcttctacgaggcatcaccgacgccctccaggggtccggntgacgtatgggtccccggggccggggctcgccccggggaactcctggtgactggaacccgggggcgtcaaaaatgcctggggcaaacccggggtttaaaaaaggggccgaaattttggggagaagtgtcaccccctgggaaaggttttttgtttttcaacccccccccctgggggggccccaaaaaaaaaattccccccccctttttaaaccccgggggt

SEQ ID NO: 24210 - protein, 39 aa, Zea mays
  misc_feature: Ceres CLONE 1395143-F
  misc_feature (17)..(17): Xaa is any aa, unknown, or other
  misc_feature (25)..(25): Xaa is any aa, unknown, or other
MGALRSLAISYPEFLVXGLCFVSLXGLRTRCVSGRHAPP

SEQ ID NO: 24211 - DNA, 715 bp, Zea mays
  misc_feature: Ceres CLONE 1395144-F
  misc_feature: Translation starting site: 445
aagctggagctccccgcggtggcggccgctctagaactagtggatcccccgggctgcaggaattcgcacgagaccattacctagaacatcctaatcgaaaaatctcccttccgttccccaattcgaaatcgaatcgggtccgacgggtcggtcttgccgtgcgtgcgtggctgcgcgagcgactcgactgcacccccgctcctcccagtccccacacactgcgcgccgccgccgggtcctcctagggtttcgccgcgatgtcgctccggccgagcgagcgggagcagatgcggaagggcaactacaagcagacggtatacgcggaggagagccgccgccgccgcgagggccagatggtggacatccgcaaggccaagcgcgaggaaagcctccagaagaagcgccgacgatgggtttcccgcctccgccgccggtgtgccgccgatgggccactccaccgcgctccagcagaagctcgatggcttgccggagatggtgcaggacgtccactccaacgacccctccgtgcagcttgaggccaccacacagttcaggaagctgctttctatagagcgtagtcccccaatcgaagaggtgatcagcacaggagtggtgccgcgattcattgagtttcttacacgtgaggaccatccccaactccagtttggggctgcatgggcactcaccaacattgcatcaggcacatcagagaacc

SEQ ID NO: 24212 - DNA, 635 bp, Zea mays
  misc_feature: Ceres CLONE 1395144-R
tcgaggtcgacggtatcgataagcttttttttttttttttttaaatgagcacgcaacaacttccaaacaacggtggtttattctacatacaagactagacaagacgtgacgaaccacaaacctgtgtacatgttacacaatatacaccaatgaacaagactcaagaaaccgaaatgggactcccaaaaacccatttgacattgtcttataagttgcgccaatactcatgcaacatgttatacacctcacgaaccgctttgacaaaaaacgacaagttccctatctttcaaggttctttctaccaacaagtaaaacaatataattcatttatgctgtataggaggaaaaacccaactcccgacaacacccgcgactccctgcctgatgcctcccaacatatgttggtgctggtgggagctagagcccaaatgatccaacaggctgaccttcaagactgaccaccgaccaagctgcaccactggtaatgcatcccaaggactgaccctgctgactgagaatgacatgacaactccctgagaccagaccaatgggactcaaccatgacttgtttgacgccgctaccccacacctctgactatcccagagcactatccaacgcataatggcacatcggc

SEQ ID NO: 24213 - DNA, 624 bp, Zea mays
  misc_feature: Ceres CLONE 1395145-F
  misc_feature: Encodes the peptide sequence at SEQ ID NO. 24214
  misc_feature (403)..(403): n is a, c, t, g, unknown, or other
cgcggtggcggccgctctagaactagtggatcccccgggctgcaggaattcgcacgagaccattacctagaacatcctaatcgaaaaacagacagattaatcaacgcccgcacctcctatgggcacgaccggcgacgctccggctccggcgggggatccgcaggaccgccaccgtacccaccccccggcggcgaagcagcggacgacgcttgtgttcacgtacgggacgctgaagcgcggcttctccaaccaccgcctcctggaggagctcttcgcgagcggggacgcgtcgctggtgggccccgcggtgacgtcggcgcggctgccgctggtgtgcggcccgtaccgggtgccgttcctgctgaacctccctggcgccggcgccggggcgcaccgcgtgcgncgggaggcgtacgccgtgaccgtccgccggcttgcgccgatagacaagttggagtgggtggaaccagcatcggacaaacgcgggtccccgttctggatggcgaccgcgggcccgctcatggctggcgcgctcataacccgttccccccgggcccccgcccctctcccgatggccacctggaacccgcacacggcccctttctctataataggcccggaccg

SEQ ID NO: 24214 - protein, 168 aa, Zea mays
  misc_feature: Ceres CLONE 1395145-F
  misc_feature (32)..(132): Pfam Name: AIG2 Pfam Description: AIG2-like family
MGTTGDAPAPAGDPQDRHRTHPPAAKQRTTLVFTYGTLKRGFSNHRLLEELFASGDASLVGPAVTSARLPLVCGPYRVPFLLNLPGAGAGAHRVRREAYAVTVRRLAPIDKLEWVEPASDKRGSPFWMATAGPLMAGALITRSPRAPAPLPMATWNPHTAPFSIIGPD

SEQ ID NO: 24215 - DNA, 675 bp, Zea mays
  misc_feature: Ceres CLONE 1395150-F
aagctggagctccccgcggtggcggccgctctagaactagtggatcccccgggctgcaggaattcgcacgagaccattacctagaacatcctaatcgaaaaacctcctatggccaccgtcgactgacccctgacctctcccgcggacctcgacgacgacatgattcccgggtctaccctcatcccccgctgcctgtaacaccggcttcgcggaggacttctaccggagcggcaccgactggtcctccttacgcgcccctccgccgctggggccgcccacaaggcacccggtgtgaaagagacaggatgcggctcgcgcgtgcacagaaccctcttccaggagtgtaggatcgagaagccgcgtagcaacggacgtgctgctgattcatcgcttgagcagaggagcctcttccaggcatgagttatcgagagaccgcagagggagggtctcgatgctggagattcctcccctcctcatccctttaccgggtctttgctggataggaagtcggagtgaggaaccaccgaggaggtagcgtcgatgggacagaaggcccctcgtgtgccccttctactagaagagtcctggcacacatttcacggtgggatgcatttccgaaatgaccaaatgggagggggtgctcggaactattttccttagccgctgtcgtcatga

SEQ ID NO: 24216 - DNA, 659 bp, Zea mays
  misc_feature: Ceres CLONE 1395153-F
  misc_feature: SWISSPROT Homolog: EC 1.11.1.6 Catalase
  misc_feature (377)..(377): n is a, c, t, g, unknown, or other
  misc_feature (534)..(534): n is a, c, t, g, unknown, or other
  misc_feature (535)..(535): n is a, c, t, g, unknown, or other
  misc_feature (596)..(596): n is a, c, t, g, unknown, or other
aagctggagctccccgcggtggcggccgctctagaactagtggatcccccgggctgcaggaattcgcacgagaccattacctagaacatcctaatcgaaaaatgtaaaccacactccactccagcactgaacacttgattgattcagtgggtagctagctagctgaatcacaatggatcctaccaagttccgtccgtccagtagccacgacacgacggtgacgacgacgaacgcttggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggngcctccgccaagggcttcttcgagtgcacccacgacgtgacgtcgctgacgtgcgccgacttcctgcgcgcgcccggcgtgcggacgcccgtgatcgtgcgcttctcgacgtgatccacgagcggggttccccggagacgatccgcgaccgcgcggnnttcgcccgtgaagtctacacccgcgagggcactggggacctgctgggcaaaacttccccgnttcttcatcgggacggatcagggttccccgacgtgatccagcgtcaggcccaacccgcgtgaa

SEQ ID NO: 24217 - DNA, 681 bp, Zea mays
  misc_feature: Ceres CLONE 1395158-F
  misc_feature: Encodes the peptide sequence at SEQ ID NO. 24218
gctctagaactagtggatcccccgggctgcaggaattcgcacgagaccattacctagaacatcctaatcgaaaaatcttgctctgaacgcattcctcccatctcccaagacctcctcagacccgagaagcgcatctgcggccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggagctcgggaagctgctgaccggcgtgaccatcgccccacggcggcgtgttgcccaacatcaacccggtcctgctgcccaagaagacgggcggagaaggcgtccagcggcgggagcaaggaggccaagtcgcccaagaaggccgccaagtcccccaagaagggcataggggtttggaggccggatcccgatgttgtccatgtgtagagctgcacccgcgccaag

SEQ ID NO: 24218 - protein, 160 aa, Zea mays
  misc_feature: Ceres CLONE 1395158-F
  misc_feature (31)..(104): Pfam Name: Histone Pfam Description: Core histone H2A/H2B/H3/H4
MDATGTGAGGKAKKGAAGRKAGGPRKKSVTRSVKAGLQFPVGRIGRYLKKGRYAQRVGSGAPVYLAAVLEYLAAEVLELAGNAAKDNKKTRIVPRHVLLAIRNDEELGKLLTGVTIAPRRRVAQHQPGPAAQEDGRRRRPAAGARRPSRPRRPPSPPRRA

SEQ ID NO: 24219 - DNA, 690 bp, Zea mays
  misc_feature: Ceres CLONE 1395162-F
  misc_feature: Encodes the peptide sequence at SEQ ID NO. 24220
aagctggagctccccgcggtggcggccgctctagaactagtggatcccccgggctgcaggaattcgcacgagaccattacctagaacatcctaatcaaaaacatcagcatctgtgcgtctcttccacgagaggcaacctaccgtatagtactgccgacatggtgctctccggcggcctagtcgtgccgtggctcgcggcggcggtggcggtggccgcgctggccatcaccgccgccccggtcggcgccgatgcctacaagaactacaccgtcggcgatgacaagggctggtacgacggcctcagccagcccggggtcgactaccaggcgtgggctgacggcaagaacttcagcctcggggatttcctcatcttcaacacggacaagaaccactcggtggggcagacgcggaacgtgacactgtacgagagctgcgactacaaggactcggggcccgacgacaccgtcgagtgggccgccgccgccccggagttccgcaagaacgccgttaccgtcgtcgtgccgatcctcgacgagggccgcgcctacttcttctcgggaactaccacggcgggaagtgcgagaagcggccagggtttccccgtcgacggggcccaagaatcagggctggccggctgacctcagggcggccgtccgcctacgcgcccggtggccctccctcgggggggcc

SEQ ID NO: 24220 - protein, 159 aa, Zea mays
  misc_feature: Ceres CLONE 1395162-F
  misc_feature (44)..(145): Pfam Name: Cu_bind_like Pfam Description: Plastocyanin-like domain
MVLSGGLVVPWLAAAVAVAALAITAAPVGADAYKNYTVGDDKGWYDGLSQPGVDYQAWADGKNFSLGDFLIFNTDKNHSVGQTRNVTLYESCDYKDSGPDDTVEWAAAAPEFRKNAVTVVVPILDEGRAYFFSGTTTAGSARSGQGFPVDGAQESGLAG

SEQ ID NO: 24221 - DNA, 677 bp, Zea mays
  misc_feature: Ceres CLONE 1395164-F
  misc_feature (441)..(441): n is a, c, t, g, unknown, or other
  misc_feature (634)..(634): n is a, c, t, g, unknown, or other
cgcggtggcggccgctctagaactagtggatcccccgggctgcaggaattcgcacgagaccattacctagaacatcctaatcgaaaaagtttcttcacccgtgctctctccctcatcccctgcgcataggaagccagctccttcacgtcgcctcctccctaggcggcgatcctacagagcctcgccggtcatccctgctccctcggcgtctctcccatggcgccctccctgctccttcacatggtgtggacgccagccccctctcttgttgccatggatagcccctctcccatctccttccccaagcacaagtcccatggtcgcccaaccctagctcgccctgccccagccatggacgctgtcgagccgcccgtttcctatctcccctcgccttcatcctctggctgccgcccctccctggatttcgccctctctactcgntcgatcttctctgttgtggcgcgcactggctgtcttccacctccatcggaccacgccgagctccctccttgctccgtcttctccatggtcgctcctctcctttcccctgataatactaggcgcagcagcaacatgccagatctctgtagccagaaaatttagatgagaagaaagctttagcgagcgcttgccnagtgcttggtgatcgccacccgggaaaagggttgcgatctccg

SEQ ID NO: 24222 - DNA, 690 bp, Zea mays
  misc_feature: Ceres CLONE 1395166-F
  misc_feature: Encodes the peptide sequence at SEQ ID NO. 24223
aaagctggagctccccgcggtggcggccgctctacaactagtggatcccccgggctgcaggaattcgcacgagaccattacctagaacatcctaatcgaaaaatccaggccccactgtccaggcacccggatccagccctctctcccttctccacttccgtttccggattcttgcgtttccaagtccgatacaaaccagcgccgcgccgcgcgagcacgtcgggcgacgttgcggcaggcgagatccgagaacactcctccctcgcgcccccgcacccgcatggccgccgctggccgcagatagggatgcgcaggcgggggcgtgcagatccagatccggtgggcggcgaggacgagatcgcccccaccaccatggcgggcgccgtgtcggcgctcttcctgctggacattaagggccgcgtcctcgtctggcgcgactatcgtggtgatgtctccgcgctccaggccgagcgcttcttcaccaagctcctcgacaaggagggcgactcggaagtccactcgcctgtggtctacgacgacgccggcgtcacgtacatggtcatccagcacaacaatgtcttcctcctcaccgctgctcgccagaactgcaacgcgggcagcatcctcctcttcctccaccggggagtagatgtgtttaggcactacttccaggaactgggagaagagtct

SEQ ID NO: 24223 - protein, 106 aa, Zea mays
  misc_feature: Ceres CLONE 1395166-F
MAGAVSALFLLDIKGRVLVWRDYRGDVSALQAERFFTKLLDKEGDSEVHSPVVYDDAGVTYMVIQHNNVFLLTAARQNCNAGSILLFLHRGVDVFRHYFQELGEES

SEQ ID NO: 24224 - DNA, 717 bp, Zea mays
  misc_feature: Ceres CLONE 1395171-F
  misc_feature: Encodes the peptide sequence at SEQ ID NO. 24225
  misc_feature (362)..(362): n is a, c, t, g, unknown, or other
  misc_feature (502)..(502): n is a, c, t, g, unknown, or other
  misc_feature (518)..(518): n is a, c, t, g, unknown, or other
  misc_feature (519)..(519): n is a, c, t, g, unknown, or other
  misc_feature (525)..(525): n is a, c, t, g, unknown, or other
  misc_feature (527)..(527): n is a, c, t, g, unknown, or other
  misc_feature (528)..(528): n is a, c, t, g, unknown, or other
  misc_feature (538)..(538): n is a, c, t, g, unknown, or other
  misc_feature (609)..(609): n is a, c, t, g, unknown, or other
tccccgcggtggcggccgctctagaactagtggatcccccgggctgcaggaattcgcacgagaccattacctagaacatcctaatcgaaaaacggatcaaaatcgaatccaacgctactgcctagggtttcctctgcatttcccctaccacaccccgcgccgcccacccatggccgccgcagacgcgtccgccgagaccgccgccatcgcgcggcgcctggcctcctgcaacaccggcacccgggagcgcgcgctccgctacctcctctccgaatttctgccggcctccgcgccgcgcctctccgccaccgacctcctcaagctctggaagggcatcttcttctgcttctggcacgccgacnagccgctctaccagagctccgtcgcctcgcctccgccgtctccgtcccgccgtcccccgccgatggtgccgccttcctcgccgcctaccctcacacgctccgccgcgagtgggcccacatcgacgtccaccgcctcgacnagttctacctcctcannccgcgntnncctcacacgncttcctgctttctcatgctaactccttcgcccccgacgtcacctcccaggtcgtgtccgtcctgtcagacnaggccctgctcccgaaagcgaacacgtcgccgctgccacctccgggggctcgggtacacgtcggcgaggcgtccttgacgagctctgcctgtgctcccgtgagcctgg

SEQ ID NO: 24225 - protein, 129 aa, Zea mays
  misc_feature: Ceres CLONE 1395171-F
  misc_feature (9)..(124): Pfam Name: Nop52 Pfam Description: Nucleolar protein,Nop52
  misc_feature (65)..(65): Xaa is any aa, unknown, or other
  misc_feature (117)..(117): Xaa is any aa, unknown, or other
  misc_feature (119)..(119): Xaa is any aa, unknown, or other
  misc_feature (120)..(120): Xaa is any aa, unknown, or other
MAAADASAETAAIARRLASCNTGTRERALRYLLSEFLPASAPRLSATDLLKLWKGIFFCFWHADXPLYQSSVASPPPSPSRRPPPMVPPSSPPTLTRSAASGPTSTSTASTSSTSSXRXXLTRLPAFSC

SEQ ID NO: 24226 - DNA, 721 bp, Zea mays
  misc_feature: Ceres CLONE 1395173-F
  misc_feature: Encodes the peptide sequence at SEQ ID NO. 24227
  misc_feature (639)..(639): n is a, c, t, g, unknown, or other
  misc_feature (646)..(646): n is a, c, t, g, unknown, or other
  misc_feature (681)..(681): n is a, c, t, g, unknown, or other
cgctctagaactagtggatcccccgggctgcaggaattcgcacgagaccattacctagaacatcctaatcgaaaacgggatcgctctctctttgggctaccggctccgccgccgctcgccctaagccaggtgctgaaggccttcgtcggtcttttcaccggcgacgacgacccactaggaaaagaattttcctggcatatttttgtttccagaaatattcgtgtcaagttggtatgtcagggatcacagcaatttggcgtcggtcatgtccattagctgctagtcagattctaatggagacatattttggcccatctgtatcttctggtgttctgaggtggttcagcagcggcactaagcactcaagaaaacctgaattttctgttgctaaccatatcagggtggtggatttgcattctgcttctgcagttaattatgtgtcaacgatcagaaggttgcccctttcatgccgtatggacactaattggttgattacttcaaagtccagacatggtgcattgccaggattcttaggtgtttcaagcttctatcgtggatactcctcagatactggaaatcagccagaagcttcgcagagtggtgtctctaaccttcctctacagaaagctctgaggttgncactgcnagtgctggtgggggttcatggattgaaaatctggnacatgctcgcaagtctactatagatgctaccactgatgca

SEQ ID NO: 24227 - protein, 91 aa, Zea mays
  misc_feature: Ceres CLONE 1395173-F
RSRTSGSPGLQEFARDHYLEHPNRKRDRSLFGLPAPPPLALSQVLKAFVGLFTGDDDPLGKEFSWHIFVSRNIRVKLVCQGSQQFGVGHVH

SEQ ID NO: 24228 - DNA, 674 bp, Zea mays
  misc_feature: Ceres CLONE 1395174-F
  misc_feature (138)..(138): n is a, c, t, g, unknown, or other
  misc_feature (419)..(419): n is a, c, t, g, unknown, or other
  misc_feature (503)..(503): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (625)..(625): n is a, c, t, g, unknown, or other
  misc_feature (674)..(674): n is a, c, t, g, unknown, or other
tggagctccccgcggtggcggccgctctagaactagtggatcccccgggctgcaggaattctcacgagaccattacctagaacattctaatcgaaaagaagggaaaagcattccaacgctgcatctgcactgcacggnacttcctcctcctcatcctcctctatctctaagaatttaaaagagaaagaagggggaagtcctcgactgctcgttccataaaccctaacctcgttggattcgcggcaaaaatcctcccaattcggaaaccctccgatgttccagctacctgcgggagctgagcccgtgctcggtttggcgaaattttgcacccctcttgtgctaggaccacccggttcaagctggttcctcggaaggatcaggtcttcaccggtgctctccggcgccggaatccaggtttngttccggcgagaggtcggggttcctcttgggtgggggccagcccagcttcgagctcaatttgcccggcctgagatggatcgcgnactgcggtgcccgggtgcccgtggctcaacctagttcgcgtcgagtcgacgcggatccctggcccattttgggggggcccagcttctggaacaannnnngggggcgttcgcctcgtgcgggnaaaaaagggggtgacgtgtgatgcatcccaggctcgaatcacccgaccn

SEQ ID NO: 24229 - DNA, 738 bp, Zea mays
  misc_feature: Ceres CLONE 1395175-F
  misc_feature: Encodes the peptide sequence at SEQ ID NO. 24230
  misc_feature (366)..(366): n is a, c, t, g, unknown, or other
  misc_feature (369)..(369): n is a, c, t, g, unknown, or other
  misc_feature (375)..(375): n is a, c, t, g, unknown, or other
  misc_feature (544)..(544): n is a, c, t, g, unknown, or other
  misc_feature (571)..(571): n is a, c, t, g, unknown, or other
  misc_feature (656)..(656): n is a, c, t, g, unknown, or other
ggagctccccgcggtggcggccgctctagaactagtggatcccccgggctgcaggaattcgcacgagaccattacctagaacatcctaatcgaaaaaagctcccaatcccaagatgaatgctacgtaggtagacagtgttcttgtggtgacgtgacctccacagagtgcagagatgggagaagctgaagaagcgccaggagacagcaatggtgaggcactggagctcctcatgtccatggcgtcctcttcgctggcctgctctgtctcgcagttcccagccaagtggcagtccatcaaggacaagctccagctgctctgctgcagcctcaattcactctgcggcggcggcggtgaccacgacgacnacnacgacnaggagcatcctgtgttggctgagcttctgcggctggcttcagcaaccgtgaggagcatccaggtcgttgcttctcagtgcagcgacgggtcataaaaagggtggaaggcttcgtctgaggagcgacctggacaacctgagctgcaagctcgatgcgcacatgaagcagntcagggagatggccgtctcgtcccggnggggcgtcgccgtccaaggccattggtcgccgtcaggcccagcgcgagggccaagggggggggtgagaaggcctttctacctcanggatctcttttccagggatcagggatcggcggcacccgtccagagggagcaggcactggccgcaattcaggggaagttggtg

SEQ ID NO: 24230 - protein, 98 aa, Zea mays
  misc_feature: Ceres CLONE 1395175-F
  misc_feature (65)..(65): Xaa is any aa, unknown, or other
  misc_feature (66)..(66): Xaa is any aa, unknown, or other
  misc_feature (68)..(68): Xaa is any aa, unknown, or other
MGEAEEAPGDSNGEALELLMSMASSSLACSVSQFPAKWQSIKDKLQLLCCSLNSLCGGGGDHDDXXDXEHPVLAELLRLASATVRSIQVVASQCSDGS

SEQ ID NO: 24231 - DNA, 700 bp, Zea mays
  misc_feature: Ceres CLONE 1395178-F
  misc_feature: Encodes the peptide sequence at SEQ ID NO. 24232
aaagctggagctccccgcggtggcggccgctctagaactagtggatcccccgggctgcaggaattcgcacgagaccattacctagaacatcctaatcgaaaaatgtaaaccacactccactccagcactgaacacttgattgattcagtaggtacctagctagctgaatcacaatggatcctaccaagttccgtccgtccagtagccacgacacgacggtgacgaccaccaacgctgccgctcctgtgtgtaacgacaacgaggagctgactgtggcgtatcgcggtcccatcctgctggaggactaccacctgatcgagaaggtggagcacttcgcgcgcgagcgcatcccggagcgcgtggtgcacgcgcgcgggggcctccgccaaggccttcttcgagtgcaccacgacgcgacgtcgctgacgtgcgccgacttcctgcgcgcgcccggcgggcggacgcccggtgatccgcgcttctcgacggtgaatcacgaaacggcggcccccgcaaaacgatcccgcgacccgcgccggattaccccctagaaattctacaccccccgaagggcaaactgggaaccttgcttgggaaaaaaactttcccccgttctttcttcactccggccaacggtaatccaagtttcccccgaaagcggatcccaacgccgctcaaaagccccaaaccccgagggtcg

SEQ ID NO: 24232 - protein, 125 aa, Zea mays
  misc_feature: Ceres CLONE 1395178-F
  misc_feature: SWISSPROT Homolog: EC 1.11.1.6 Catalase
MDPTKFRPSSSHDTTVTTTNAAAPVCNDNEELTVAYRGPILLEDYHLIEKVEHFARERIPERVVHARGGLRQGLLRVHHDATSLTCADFLRAPGGRTPGDPRFSTVNHETAAPAKRSRDPRRITP

SEQ ID NO: 24233 - DNA, 695 bp, Zea mays
  misc_feature: Ceres CLONE 1395179-F
  misc_feature: Encodes the peptide sequence at SEQ ID NO. 24234
  misc_feature (216)..(216): n is a, c, t, g, unknown, or other
  misc_feature (290)..(290): n is a, c, t, g, unknown, or other
  misc_feature (291)..(291): n is a, c, t, g, unknown, or other
  misc_feature (397)..(397): n is a, c, t, g, unknown, or other
  misc_feature (410)..(410): n is a, c, t, g, unknown, or other
  misc_feature (415)..(415): n is a, c, t, g, unknown, or other
  misc_feature (416)..(416): n is a, c, t, g, unknown, or other
  misc_feature (583)..(583): n is a, c, t, g, unknown, or other
aagctggagctccccgcggtggcggccgctctagaactagtggatcccccgggctgcaggaattcgcacgagaccattacctagaacatcctaatcgaaaaacgccaaagatttcctcttccgcctgcgcttccctttgccccgctctcccccagcctcgctcgccatataatacgggccggccggccggccagctgggtccccgcggatgggctncggtctcgcggggctagggtttggtcggtcgtctcgccggcgtcgaggccgccagcgctgctagctagctctcnntcgcgttagggttccccgtagccatggtgctggcagcgcttctcgtggccgtacggcggccggagcgccaccttctgcggtagttcaccgggtgggagagagtgcncatgggggctggnttggnngccgtgttccaggtcgtcttcgatcggccccccggagtttaccagtaccgggtttttgggttgatggtggtctggaggtgtgatgagacaaaaccctttgtacgtgatgaatatggactgatcagcaatgaagtgcttgtggaaacaatgtacaacctgttgtgcanccagagccttctatcagaggaactaatatggataagggtaccattttgaaaacaatgcccccggagccatcatctcagaacccaagatgccaatagcagttatccgccatgt

SEQ ID NO: 24234 - protein, 77 aa, Zea mays
  misc_feature: Ceres CLONE 1395179-F
  misc_feature (6)..(6): Xaa is any aa, unknown, or other
  misc_feature (62)..(62): Xaa is any aa, unknown, or other
MGAGLXAVFQVVFDRPPGVYQYRVFGLMVVWRCDETKPFVRDEYGLISNEVLVETMYNLLCXQSLLSEELIWIRVPF

SEQ ID NO: 24235 - DNA, 661 bp, Zea mays
  misc_feature: Ceres CLONE 1395182-F
  misc_feature: Translation starting site: 299
  misc_feature: SWISSPROT Homolog: EC 4.1.1.8 Oxalyl-CoA decarboxylase
  misc_feature (503)..(503): n is a, c, t, g, unknown, or other
  misc_feature (645)..(645): n is a, c, t, g, unknown, or other
tccccgcggtggcggccgctctagaactagtggatcccccgggctgcagcaattcgcacgagaccattacctagaacatcctaatcgaaaaaccgcatacaccgctgcccgcgcgcagccgcgcaggtgcatctgcgccgccgccggcccgccgcacccgcacgtctccttatacccatccggccatctacacacggcagtccacgctcgtggcaccgcactcactccgaatcctgaagcaacaaacaccagaagcgcaccaactccccaaccaccggagaccgcaccccagcaaaggatgtcatctgactccacggccgccgtgacggtggacggcagcgcgcttgcggggcgcgcgctggccgcggcggacacgcggcacatgttacggtgtggtgggcatccccgtcacctccctcgcgtcccgtgacgccgcggccggggtccgcttcctcgctttgcgcaacgagcagtacgcgtggtacgccgccgccgcctacggnttcctcacgggatccgcgggcgctctactcaccgtcgtcgagccaggatgcgtcacggggctcgcgggcctctctcacgccagcggcaacgcctgggcggtcctcatgatctccggaatcctgcgatcaggctgacgccggnaggggcgacttccagg

SEQ ID NO: 24236 - DNA, 675 bp, Zea mays
  misc_feature: Ceres CLONE 1395185-F
  misc_feature (405)..(405): n is a, c, t, g, unknown, or other
aaagctggagctccccgcggtggcggccgctctagaactagtggatcccccgggctgcaggaattcgcacgagaccattacctagaacatcctaatcgaaaagtcataaagaggcacagggcacaggcaagaccgggaggaggatctcactatccggcgaggaagatgcctgcttttcacatagagatattaaaatggagttgcttcggctgcttgccctgatctccctgctcttcgcagtggcactagtcctgacaggaacatcacccacgatgcctgctcgtcaaaagtgaaggatttctagcacctgaacgacagctcgggtctccacctgacggtgcaccacccgtggaggccctgctccccggggccgatgcccgccgacctccccttctccgcgggccnggcccacgacggcgcgtgatctacaagggccggcatcttgaaggacgagagaaccctacctctctacccagcgtggacggacagtaccatccagcatgctacgtggtgctgtgctatcaactacatctactgcacctgcggccaaccaagaagctaccactgctggctcctgccagttccccggccacagtgattgcttggcttgttgcaaagtctgactactacaggcgctgctgctaacagctgaggggcttgtttgggctctgcccc

SEQ ID NO: 24237 - DNA, 699 bp, Zea mays
  misc_feature: Ceres CLONE 1395186-F
  misc_feature: Encodes the peptide sequence at SEQ ID NO. 24238
  misc_feature (388)..(388): n is a, c, t, g, unknown, or other
  misc_feature (473)..(473): n is a, c, t, g, unknown, or other
  misc_feature (479)..(479): n is a, c, t, g, unknown, or other
aaagctggagctccccgcggtggcggccgctctagaactagtggatcccccgggctgcaggaattcgcacgagaccattacctagaacatcctaatcgaaaactagcttcccactccgctcggccaccagctttgaccgcctcccctcccctccgctcctgttcttccataccccactcccccgcaggagcggcgcggcggcggcaaaggcaaaggcaagatgttcgggcgcgcgccgaagaagagcgacaacaccaagtactacgagatcctcggggtgcccaagtcggcgtcccaggacgacctcaagaaggcctaccgcaaggccgctatcaagaaccaccccgacaagggcggtgaccccgagaagttcaaggagctcgcacangcctatgagggttttgagtgatccagagaaacgtgagatttatgatcagtatggtgaagatgcccttaaggaaggaatgggtggntggtgnatcccatgctgatccatttgacattttctcatcattctttggaccctcttttggaggaggtggtggaaggaacaggggaagaaggcaaaggaggggagaagaggaagccccctcccttaaagtttctctggagaatctttacatggcaatctcaagaaattctctctttcccgcacggaaatttggcccagaggaagggaaaggattccaactagggaga

SEQ ID NO: 24238 - protein, 62 aa, Zea mays
  misc_feature: Ceres CLONE 1395186-F
  misc_feature (13)..(62): Pfam Name: DnaJ Pfam Description: DnaJ domain
  misc_feature (56)..(56): Xaa is any aa, unknown, or other
MFGRAPKKSDNTKYYEILGVPKSASQDDLKKAYRKAAIKNHPDKGGDPEKFKELAXAYEGFE

SEQ ID NO: 24239 - DNA, 686 bp, Zea mays
  misc_feature: Ceres CLONE 1395187-F
  misc_feature (323)..(323): n is a, c, t, g, unknown, or other
cgcggtggcggccgctctagaactagtggatcccccgggctgcaggaattcgcacgagaccattacctagaacatcctaatcaaaacatccaaagagagatccccccgacctgtcgttagtgtggcgctgcttgactcgctccgcgctcccctcgtctgttgaggattccggctgatatgaatagttcctcgttttacactaccattcccgctgaatcatcaggagcaagtctctccctcgccggtcttgtcgggccaagacccttgaacgaacgctcggcctcaatcctccgcctcttgcttcgcttggacgccgaagaggncgcggcctccggctctggccagtgttattgttgaagcgttaaaggtggatagtctgcagaggctctgctcatcattggaaccaattcttcgtagagtagtcagtgaagaagtggagtgcgcactgggcaaacttggccctgcaacaatcggtggaaggccttccccaaagcgaattgaaggtccaaatggaagaactctgcaactcgaattccgaacaaggctgtcacttcccctttttactgggagaaaaagttgaaggggagcagggagctgcaatttcatgttggtttggttgatgctggcacttggctgtgttgtatcctctggaaccagagccgtctgccaaacttgacatcgttgtt

SEQ ID NO: 24240 - DNA, 667 bp, Zea mays
  misc_feature: Ceres CLONE 1395188-F
  misc_feature: Encodes the peptide sequence at SEQ ID NO. 24241
  misc_feature (420)..(420): n is a, c, t, g, unknown, or other
  misc_feature (449)..(449): n is a, c, t, g, unknown, or other
  misc_feature (530)..(530): n is a, c, t, g, unknown, or other
  misc_feature (546)..(546): n is a, c, t, g, unknown, or other
  misc_feature (578)..(578): n is a, c, t, g, unknown, or other
  misc_feature (591)..(591): n is a, c, t, g, unknown, or other
  misc_feature (646)..(646): n is a, c, t, g, unknown, or other
aagctggagctccccgcggtggcggccgctctagaactagtggatcccccgggctgcaggaattcgcacgagaccattacctagaacatcctaatcgaaaaataaatccccaatctccgcgctttccttccgccccacactcgtccactcaccccctctttgctctgcctcgccgcgccgcagagcagagcatggcgcccccacgccctctcctcgccgccgtcttcctcgccgcggcggttctgctcctcctttctccggcagaggcggggacggtgggcgtgaactacggccgcgtggcgaacaacctgcccaacccagcggcggttgtgcagctgctcaagcagcagggcgtcgcgcaggtgaagctgtacgacgccgaccccaccgtgctgcgcgccctcgcgaacaccggatcanggggggggtgggtggcgctgcccaacgangcaggtcgcgggcggcggcgtcgcgcgcgtccaaacgcgctgctgtgggtgcgccggaaccgtggcggcgtaccacccggncacgcagatccgggcnatcgccgtggggcaacgagggtgttcgcgtcnggcaagaacggancggcgcagctggtcccgcccatggccaacgtcaacgccgcgctggccagctccgncttcgacgggcccgtcaaagg

SEQ ID NO: 24241 - protein, 158 aa, Zea mays
  misc_feature: Ceres CLONE 1395188-F
  misc_feature: SWISSPROT Homolog: EC 3.2.1.39 Glucan endo-1,3-beta-D-glucosidase
  misc_feature (77)..(77): Xaa is any aa, unknown, or other
  misc_feature (86)..(86): Xaa is any aa, unknown, or other
  misc_feature (119)..(119): Xaa is any aa, unknown, or other
  misc_feature (134)..(134): Xaa is any aa, unknown, or other
  misc_feature (152)..(152): Xaa is any aa, unknown, or other
MAPPRPLLAAVFLAAAVLLLLSPAEAGTVGVNYGRVANNLPNPAAVVQLLKQQGVAQVKLYDADPTVLRALANTGSXGGWVALPNXAGRGRRRRARPNALLWVRRNRGGVPPGHADPGXRRGATRVFASGKNGXAQLVPPMANVNAALASSXFDGPVK

SEQ ID NO: 24242 - DNA, 679 bp, Zea mays
  misc_feature: Ceres CLONE 1395189-F
  misc_feature: Encodes the peptide sequence at SEQ ID NO. 24243
  misc_feature (337)..(337): n is a, c, t, g, unknown, or other
  misc_feature (370)..(370): n is a, c, t, g, unknown, or other
  misc_feature (544)..(544): n is a, c, t, g, unknown, or other
aaagctggagctccccgcggtggcggccgctctagaactagtggatcccccgggctgcaggaattcgcacgagaccattacctagaacatcctaatcgaaaaatccgctccccgccttccgcttccctaccccccgcatcacctaccaacgccgacaccatgggggccttcgcgaaggaggagcaccagttcctagccgagctcggcctcgcgcagcgcaacccaggcgcgttcgcatgcggtgcgtggggcggctcaggtcccaccgtcacctccacgagcccgaccgacaatcaggtcatcgcagaggtcgtggaggcgtccgtgcacgactacnaggagggcatgcgcgcctgcttcgatgccgccnagacatggatggcgattcctgctccaaagcgaggagagatcgttaggcaaatcggtgatgcactgagagcaaagctccatcaccttggcaggcttgtgtcacttgatatggggaaaattcttcctgaagggatcggtgaggttcaggaaatcatcgacatgtgtgattatgctngtggggctaagtcgccaactaaatggatccattataccatctgaacgacaaacatatgatgggttgaaggtgtggatccccctgaaagggttgtggttggtataacggcatttaatttcccttgtgctggggctt

SEQ ID NO: 24243 - protein, 142 aa, Zea mays
  misc_feature: Ceres CLONE 1395189-F
  misc_feature: SWISSPROT Homolog: EC 1.2.1.3 Aldehyde dehydrogenase (NAD(+))
  misc_feature (60)..(60): Xaa is any aa, unknown, or other
  misc_feature (71)..(71): Xaa is any aa, unknown, or other
  misc_feature (129)..(129): Xaa is any aa, unknown, or other
MGAFAKEEHQFLAELGLAQRNPGAFACGAWGGSGPTVTSTSPTDNQVIAEVVEASVHDYXEGMRACFDAAXTWMAIPAPKRGEIVRQIGDALRAKLHHLGRLVSLDMGKILPEGIGEVQEIIDMCDYAXGAKSPTKWIHYTI

SEQ ID NO: 24244 - DNA, 690 bp, Zea mays
  misc_feature: Ceres CLONE 1395191-F
  misc_feature: Encodes the peptide sequence at SEQ ID NO. 24245
  misc_feature (436)..(436): n is a, c, t, g, unknown, or other
  misc_feature (444)..(444): n is a, c, t, g, unknown, or other
  misc_feature (642)..(642): n is a, c, t, g, unknown, or other
  misc_feature (643)..(643): n is a, c, t, g, unknown, or other
cagagctggagctccccgcggtggcggccgctctagaactagtggatcccccgggctgcaggaattcgcacgagaccattacctagaacatcctaatcgaaaacttcttcttttttccctacccctccgccgttgctctgcaaggcacgcgtcctgcacgcgccaaagctaggcgataaactggaaaggagcgcgcagcgcaggcttcgggctcctgtctccgccgcggcgtcctctcgctttttcaggactttcaggacttgcaggctctgcgcagcgcgatctgacatctgaccgggtcagacgatacagcccatatactacgttacgtcgagtcctcaaagttcaattctacctggaccattgcacccatcttggcccaaagtacttgcgcgccgcgctacgaacgaggccatccgccgccacacgccgtcgncatggccncagaaggtcagaggggcactggccttgggaaggggcgacgaggagcagcggctgcgggctgctctgcgtcacctgcaggcggaagcggggggtgctggagcgcctggtgtacaagcaccggaaccagcaccgcggcgccgcctatttccatacctcctcaagggtgaggagggacctgaagcttctgctcggcgccgnnctcgctgaggtcctcaacgccgtgttcccagttctcgcatgccgcaa

SEQ ID NO: 24245 - protein, 57 aa, Zea mays
  misc_feature: Ceres CLONE 1395191-F
  misc_feature (3)..(3): Xaa is any aa, unknown, or other
MAXEGQRGTGLGKGRRGAAAAGCSASPAGGSGGCWSAWCTSTGTSTAAPPISIPPQG

SEQ ID NO: 24246 - DNA, 709 bp, Zea mays
  misc_feature: Ceres CLONE 1395192-F
  misc_feature: Encodes the peptide sequence at SEQ ID NO. 24247
  misc_feature (506)..(506): n is a, c, t, g, unknown, or other
  misc_feature (547)..(547): n is a, c, t, g, unknown, or other
  misc_feature (709)..(709): n is a, c, t, g, unknown, or other
agagctggagctccccgcggtggcggccgctctacaactagtggatcccccgggctgcaggaattcgcacgagaccattacctagcatcctaatcaaaaaaagtctctcaaatctggaatcctttcacgccgccactctcccctttttccttctctcttcgtcgttgtggctcctgccttcctgcctcggcgcatcgactcgcggagagggacagcacagcgcctcctccccatcctttctccattcccagatcgaaggtccataaaaaaccatccttttgcatctgattgagcactgtctttgtgcaagagaacaatttagttgtacatacaaacaaaaagaagtgggagtatttttcagagtttattagaagagactgtttcgaggacccaggtcagagaaaggcgagaagctttagcagcggcaatggtctggtcaatggacccgcaggtgaccgtccacggcgactgggtgtcagccgtggtgccgctgatgaagctgctgntgcctgggcggtgatcggcctgctcctccccaacccgcggnttccaggtcgtgcccagggccaccttcaagctcctgagcaagctcgtcttcgcgctcttcctccccggcctcatcttcgccacttccgggcaagtcggtacccatagacacgtcctggggacttggtggttcatcccccgtcaacgtgctcatcagacctgn

SEQ ID NO: 24247 - protein, 30 aa, Zea mays
  misc_feature: Ceres CLONE 1395192-F
  misc_feature (27)..(27): Xaa is any aa, unknown, or other
MVWSMDPQVTVHGDWVSAVVPLMKLLXPGR

SEQ ID NO: 24248 - DNA, 701 bp, Zea mays
  misc_feature: Ceres CLONE 1395194-F
  misc_feature: Encodes the peptide sequence at SEQ ID NO. 24249
  misc_feature (290)..(290): n is a, c, t, g, unknown, or other
  misc_feature (524)..(524): n is a, c, t, g, unknown, or other
  misc_feature (608)..(608): n is a, c, t, g, unknown, or other
  misc_feature (614)..(614): n is a, c, t, g, unknown, or other
  misc_feature (635)..(635): n is a, c, t, g, unknown, or other
  misc_feature (652)..(652): n is a, c, t, g, unknown, or other
  misc_feature (653)..(653): n is a, c, t, g, unknown, or other
  misc_feature (656)..(656): n is a, c, t, g, unknown, or other
  misc_feature (657)..(657): n is a, c, t, g, unknown, or other
  misc_feature (659)..(659): n is a, c, t, g, unknown, or other
  misc_feature (661)..(661): n is a, c, t, g, unknown, or other
  misc_feature (677)..(677): n is a, c, t, g, unknown, or other
  misc_feature (680)..(680): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (695)..(695): n is a, c, t, g, unknown, or other
  misc_feature (698)..(698): n is a, c, t, g, unknown, or other
  misc_feature (699)..(699): n is a, c, t, g, unknown, or other
cagagctggagctccccgcggtggcggccgctctacaactagtggatcccccgggctgcaggaattcgcacgagaccattacctagaacatcctaatcgaaaaaatgcggcgcctccactttgcgatgcccgcgtcctcgctcccctccccatcctcctcatctaccgtgctctccattccccacccgctcccaccgccgctcgcagatgccgcccaaggtggtcgccgtcgccgcgggcgaggcccacacactcgccctcacgggtgacgggcaggtgtactcctgggncagggggccgttcggtcgcctcgggaacggccgcgaggacgacaagctggtccccaccgcggtggcgcccgcggtctctgccagcgggacaccgcggcccaggttcgtcgccgtcgcggctggtgcctaccacagccttgcgctggacgatgaagggtcactctggtcatggggttacaatctctatggtcaacttggctatggggaccagaattcccttttttcatgtttcgntgaacaattttcagaataaaggtctcctgaaacactgaatgatggaaaacagaaacacacggggccacacttgtttgaggtggnctctgncacacgtgggggatgggggcnctttgccataaacggtnnggnngncntttggagggggggggnccncccnnncnnnnnccnaannat

SEQ ID NO: 24249 - protein, 111 aa, Zea mays
  misc_feature: Ceres CLONE 1395194-F
  misc_feature (21)..(76): Pfam Name: RCC1 Pfam Description: Regulator of chromosome condensation (RCC1)
  misc_feature: SWISSPROT Homolog: EC 2.7.11.1 Non-specific serine/threonine protein kinase
  misc_feature (28)..(28): Xaa is any aa, unknown, or other
  misc_feature (106)..(106): Xaa is any aa, unknown, or other
MPPKVVAVAAGEAHTLALTGDGQVYSWXRGPFGRLGNGREDDKLVPTAVAPAVSASGTPRPRFVAVAAGAYHSLALDDEGSLWSWGYNLYGQLGYGDQNSLFSCFXEQFSE

SEQ ID NO: 24250 - DNA, 679 bp, Zea mays
  misc_feature: Ceres CLONE 1395195-F
  misc_feature: Translation starting site: 414
  misc_feature (387)..(387): n is a, c, t, g, unknown, or other
  misc_feature (388)..(388): n is a, c, t, g, unknown, or other
  misc_feature (439)..(439): n is a, c, t, g, unknown, or other
  misc_feature (440)..(440): n is a, c, t, g, unknown, or other
  misc_feature (545)..(545): n is a, c, t, g, unknown, or other
  misc_feature (583)..(583): n is a, c, t, g, unknown, or other
  misc_feature (639)..(639): n is a, c, t, g, unknown, or other
aagctggagctccccgcggtggcggccgctctagaactagtggatcccccgggctgcaggaattcgcacgagaccattacctagaacatcctaatcgaaaaagcctttccctctcttctctgctctttgcatctctctcttgttcctcccttcctctctaaaaaaagggttctgatccctttctagaagctcctgggtttctgttgccgacccgagctccccaggggcgctcaggaggcgccgagccggcgaccgctccggcggatctgaggagccgccgcggtcgctttgcctccgttgcgatactgcacaggttccttgtaaactattgattgggaacactctgaagaagagtttgttggctgcataacatctccctgagcctgnnttgaagtttgctgataggaaagatcatgggcgctctctgtgatttctgtgnngagcagaggtctatggtttactgccgatcagatgcagcatccttgtgtttatcatgtgaccgtaatgtgcattcagctaatgctcttttctcgcgtcatacaggnacacttttatgtggaccggtgtgctcacagcctgctantggtccgctgtctagcagaaaatgcctcgctttgccaaaatggtgattgggatggncacatttgcaggatcctcatcttgcggacacaaaaggaga

SEQ ID NO: 24251 - DNA, 715 bp, Zea mays
  misc_feature: Ceres CLONE 1395197-F
  misc_feature (715)..(715): n is a, c, t, g, unknown, or other
aaagctggagctccccgcggtggcggccgctctagaactagtggatcccccgggctgcaggaattcgcacgagaccattacctagaacatcctaatcgaaaacttgcaagcaagcagctgctctcgtgtgacatctagtcgtcgccagtcagtcacctctccagcctccagcaccaaccatccaccaccgagctagcagctgtctgctcgcctcccccacctaggctaggactaggagccaccaaactctgccccgccatgccgggcctcgccgcctcaggcaactcgcccccggcgggggcgccggcccggggcgtctcctcgcgcggttgtccgccgcgcttcccttattgacctatcctcctcccccacctggtcccagccgacccagcactacgcacacaccccaccggatgtttctaccgaactcatgccaattttcttactcctttgccaggcccgcgcccctccacccctccggcccctacccccttccatacatccttatgccagtaaaacccccctccaacccccctcccccacccgtccctgactccctcttccaaccccctaacaacatttgtggcccaccacccaaccctctcccccgacccctcgactcccctcctcccagtacttcctacttttttcatctgttcatgacagcttcattttgtctaaccttactattaataatacactatttccctcctcn

SEQ ID NO: 24252 - DNA, 664 bp, Zea mays
  misc_feature: Ceres CLONE 1395201-F
  misc_feature: Encodes the peptide sequence at SEQ ID NO. 24253
  misc_feature (530)..(530): n is a, c, t, g, unknown, or other
  misc_feature (664)..(664): n is a, c, t, g, unknown, or other
tggagctccccgcggtggcggccgctctagaactagtggatcccccgggctgcaggaattcgcacgagaccattacctagaacatcctaatcgaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcatcggcatgaccaagtccgaccttgtcaacaacctcggtaccatcgccaggtccgggaccaaggagttcatggaagcccttgctgcccggcgctgatgtgtccatgattggccagntcgggcgtcggtttctactctgcctacctcgtcgccgatagagttgtcgtgaccaccaaggaccacgatgacgaggagtaccttgtggaagtcccaagcgggcggggccgttccctggtactcggggcccgtcn

SEQ ID NO: 24253 - protein, 114 aa, Zea mays
  misc_feature: Ceres CLONE 1395201-F
MASETETFAFQAEINQLLSLIINTFYSNKEIFLRELISNSSDALDKIRFESLTDKSKLDAQPELFIHLVPDKATNTLSIIDSGIGMTKSDLVNNLGTIARSGTKEFMEALAARR

SEQ ID NO: 24254 - DNA, 719 bp, Zea mays
  misc_feature: Ceres CLONE 1395204-F
  misc_feature: Encodes the peptide sequence at SEQ ID NO. 24255
  misc_feature (578)..(578): n is a, c, t, g, unknown, or other
gctctagaactagtggatcccccgggctgcaggaattcgcacgagaccattacctagaacatcctaatcgaaaaacagtcaaaagctccccattcctcttccccttctcacccggcactcgaactctgcggccctgcaaaccctagctttcgctccatggccgacggcgatccggagccggcgccagcgccggcaccggcactggctaacgagaagctccatgtccgggcggcggcctacgtggatgagacgcgcccgccgccaccgctggagccctccgggggtccggacgaggagaagcgcccgcccgaagaggtagaagcggaggtggagatgcacccgccgcgggaaccaaccggggagccgcccgttgatcgcccgggggtggaggtggtggcggacatgaaggcgaacgaagtggagaaggaaaggggggatcgggcaaaggagaagcggagaaaggataaagggaaggggaaggaggagaaagagaaggtggacgaagaggcgaaggggaaagtgactgcggtgatgaaggtggatgggaacggagaaggaggtcaagccgacccggcggncagctggggccagcgcggagacgcccatccctagcggtgccggtggtggccgtgccttgcttcatcgcgcctccaggggtttgcgtgttacagcacaggcacaaatgcacttgcagtcaccaactcatctgcaatggtcgg

SEQ ID NO: 24255 - protein, 151 aa, Zea mays
  misc_feature: Ceres CLONE 1395204-F
  misc_feature (141)..(141): Xaa is any aa, unknown, or other
MADGDPEPAPAPAPALANEKLHVRAAAYVDETRPPPPLEPSGGPDEEKRPPEEVEAEVEMHPPREPTGEPPVDRPGVEVVADMKANEVEKERGDRAKEKRRKDKGKGKEEKEKVDEEAKGKVTAVMKVDGNGEGGQADPAXSWGQRGDAHP

SEQ ID NO: 24256 - DNA, 652 bp, Zea mays
  misc_feature: Ceres CLONE 1395206-F
  misc_feature: Encodes the peptide sequence at SEQ ID NO. 24257
tggagctccccgcggtggcggccgctctagaactagtggatcccccgggctgcaggaattcgcacgagaccattacctaaacatcctaatcgaaaaaacgggacgacagttcgtctccgcccgcatcgattgttgtccgctgttctccttcctcctcgtcctccttcaggccagcgggcaagaagaagaagaagaaaaatcaaggcttgcggcgagaggctgtgcccggccgaccggcgagcgaacttcgtacgcgcgtcatgggtggcggcagcaacagaggcggcgccggcgccggcgaggagagcggcagcgaccacgacggtgtgctgcggaggccgctgctcacaacggggagctggtaccggatgagctcgcggcagtccagctttgccccggggaccccctccatggccgtcctgcgcgagtcccacgtctccgccttcctctgcacgctcatcgtcgcgctcgggcccatccagttcggcttcaccagcggcttctcctccccgaccaggacgccatgggttcggacctcaacctctctatctccaggttctcggcgttcggatcgctgtccaacgtcggcggcatgggtcggagcgatcgccagcggccagatggccgagaacttggccgtaaagggccgttg

SEQ ID NO: 24257 - protein, 130 aa, Zea mays
  misc_feature: Ceres CLONE 1395206-F
MGGGSNRGGAGAGEESGSDHDGVLRRPLLTTGSWYRMSSRQSSFAPGTPSMAVLRESHVSAFLCTLIVALGPIQFGFTSGFSSPTRTPWVRTSTSLSPGSRRSDRCPTSAAWVGAIASGQMAENLAVKGR

SEQ ID NO: 24258 - DNA, 722 bp, Zea mays
  misc_feature: Ceres CLONE 1395208-F
  misc_feature (20)..(20): n is a, c, t, g, unknown, or other
  misc_feature (23)..(23): n is a, c, t, g, unknown, or other
  misc_feature (24)..(24): n is a, c, t, g, unknown, or other
  misc_feature (46)..(46): n is a, c, t, g, unknown, or other
  misc_feature (373)..(373): n is a, c, t, g, unknown, or other
  misc_feature (374)..(374): n is a, c, t, g, unknown, or other
  misc_feature (421)..(421): n is a, c, t, g, unknown, or other
  misc_feature (422)..(422): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (490)..(490): n is a, c, t, g, unknown, or other
  misc_feature (496)..(496): n is a, c, t, g, unknown, or other
  misc_feature (532)..(532): n is a, c, t, g, unknown, or other
  misc_feature (581)..(581): n is a, c, t, g, unknown, or other
  misc_feature (582)..(582): n is a, c, t, g, unknown, or other
  misc_feature (604)..(604): n is a, c, t, g, unknown, or other
  misc_feature (640)..(640): n is a, c, t, g, unknown, or other
  misc_feature (668)..(668): n is a, c, t, g, unknown, or other
  misc_feature (670)..(670): n is a, c, t, g, unknown, or other
  misc_feature (722)..(722): n is a, c, t, g, unknown, or other
caagctggagcttactgcgntgnncgccgctctagactagtggatnccccgggctgcaggaattcgcacgagaccattacctaaacatcctaatcgaaaaaccaacccttgtagtctcagtcaatctgtagattgagactacgatgagcctgtcaccgctcgactcctcctccccgccggccgcgggttcctcttctgttttggttcggtgcagctccgcgagcctgttgcttctccgcggcccttctccccttccgttcttgctctcggagggcctaatccaggtctaccctccttttgtggcttgggaagtggattcgtcctgccgaggcatagtggcttggcgggtggacggctttttcccccccccccnnggcacgggcccttggagcccttgacgtggttcttcccggcccccagnnacctgcccccccccccctcggggttggnnngatgcgggaacactcctgtgggcgcagtccttcgtggnttttgnggccttcggctgccttctccgccttacttttctccnactacacgatataccactcccttccttcgacttcgctactctcttactnncccccttctccttcactcgccngaaatatgttttttcttctcccccattttttgcaanacctcgacctgtctcttttttctccccnanccctcccgacggctatacgcgcttttattcacggcttttactcatatctcgn

SEQ ID NO: 24259 - DNA, 660 bp, Zea mays
  misc_feature: Ceres CLONE 1395215-F
  misc_feature: Encodes the peptide sequence at SEQ ID NO. 24260
  misc_feature (503)..(503): n is a, c, t, g, unknown, or other
tccccgcggtggcggccgctctagaactagtggatcccccgggctgcaggaattcgcacgagaccattacctagaacatcctaatcgaaaaaaccccaccagaccttcaaccgctacatttccgtcactaccggagccgccactccgacgaacgcgggcggcggagcggaagcgaaccagagcaccggtaaaaagaaaaggatgaggcttgggagtataaacggcttgcggttcacgcagcttaaacttgtcatccttgcgttcttcatgttgtttgttctctggaaatgggagaagggctcgtcatactacgattccgaaatcctccagccagatccgttggttctgactcatccagctaactcgaagtttgtagaccagcatacatccccagaagaagactttccaagtgcagatcgatcacaccggtcagtaggtaaagtagaaaagccggttactagtgcgctgccaccattgtctacgataggctatttctgtgatgntgcagatgggaaatgaagtgccacctcctgagaggaaagaatgcgagtacaggaatggggagtggggtttctgacaatcgtagacactattacctcagggttttgggttgaagaatggcttccccaaaaagttggcccctgcaaactaacccaggaa

SEQ ID NO: 24260 - protein, 105 aa, Zea mays
  misc_feature: Ceres CLONE 1395215-F
  misc_feature (101)..(101): Xaa is any aa, unknown, or other
MRLGSINGLRFTQLKLVILAFFMLFVLWKWEKGSSYYDSEILQPDPLVLTHPANSKFVDQHTSPEEDFPSADRSHRSVGKVEKPVTSALPPLSTIGYFCDXADGK

SEQ ID NO: 24261 - DNA, 643 bp, Zea mays
  misc_feature: Ceres CLONE 1395216-F
  misc_feature: Translation starting site: 150
  misc_feature: Pfam Name: Glyco_transf_22 Pfam Description: Alg9-like mannosyltransferase family
  misc_feature (297)..(297): n is a, c, t, g, unknown, or other
  misc_feature (377)..(377): n is a, c, t, g, unknown, or other
  misc_feature (404)..(404): n is a, c, t, g, unknown, or other
tccccgcggtggcggccgctctagaactagtggatcccccgggctgcaggaattcgcacgagaccattacctagaacatcctaatcaaaaatccagaacggcagaaccttctagaccaaaccttcgacccatcacctcgagctccagccatgtcgctctcgtcggcgcgccagcgccgggccactgcagcgtcgccaccgacagatgatgggtacgccaaggacgccaaggacaggaggcggcggcccggcggagacggggacagcgaggacgagggtatcaagtggttccctccgntcctggcgctcgggctcctccgcacatgagcgcgtcctccaacctgatcacgactggcgacgaggtcttcaactactggnagccccttcacttcctcctcttacggntcggttttcagaatgggaaggacgggtccgactttgcttctcgggcaaattggacctttttctttcaggccctggaactggcccggttcatggacttgggagacaaaaggggtccgggggtcaaccccggggaaaactttttgggcccatttcaatataaccaaaaggggttcgggggggggggcttttaaaaaaaataggaaaagggcttttttttgattattctcttgcaaggaatc

SEQ ID NO: 24262 - DNA, 693 bp, Zea mays
  misc_feature: Ceres CLONE 1395219-F
  misc_feature: Encodes the peptide sequence at SEQ ID NO. 24263
  misc_feature (359)..(359): n is a, c, t, g, unknown, or other
  misc_feature (538)..(538): n is a, c, t, g, unknown, or other
  misc_feature (562)..(562): n is a, c, t, g, unknown, or other
  misc_feature (570)..(570): n is a, c, t, g, unknown, or other
  misc_feature (586)..(586): n is a, c, t, g, unknown, or other
  misc_feature (643)..(643): n is a, c, t, g, unknown, or other
  misc_feature (658)..(658): n is a, c, t, g, unknown, or other
  misc_feature (689)..(689): n is a, c, t, g, unknown, or other
tggagctccccgcggtggcggccgctctagaactagtggatcccccgggctgcaggaattcgcacgagaccattacctagaacatcctaatcgaaaaactagtaccgccacacgaattcccgaccccgatggcgacatcgccaccgcagaaccctagctccggcgagccctccgatgcgtcgagcctcgcagccgcggcgctcgaggcgcccgtgcgcgtatggagatccctcgtcgcgcgcttccctcccctcccggactcctccagcttccttgctggcgtctccgacctccagctccgctacttcggcaacagccggccccgccgccgcaggcgctccgctctacctctccctctnccgcccggtggccgcgcactctgctcggattggctggtgagatgccccaaagcctttgtggatcttagatgatgttgtgcaacacaccctgactaatttgcacagtattcacaaaagcttactaattttggcaggccaaggctgagggaacaaattctcagaaagtgtactttatgaanttttggagagaaggtcaaaggggncctttggntgatgcaacatatcanacactcactagactcgggagcaatggacgccctgtccaatacattttgattctgctnctggggaaatggggncacaaaactcgctgccctgacagtagcaaantgct

SEQ ID NO: 24263 - protein, 100 aa, Zea mays
  misc_feature: Ceres CLONE 1395219-F
MATSPPQNPSSGEPSDASSLAAAALEAPVRVWRSLVARFPPLPDSSSFLAGVSDLQLRYFGNSRPRRRRRSALPLPLPPGGRALCSDWLVRCPKAFVDLR

SEQ ID NO: 24264 - DNA, 690 bp, Zea mays
  misc_feature: Ceres CLONE 1395220-F
  misc_feature: Encodes the peptide sequence at SEQ ID NO. 24265
  misc_feature (218)..(218): n is a, c, t, g, unknown, or other
aaagctggagctcaccgcggtggcggccgctctagaactagtggatcccccgggctgcaggaattcgcacgagaccattacctagaacatcctaatcaaaaatgccgaatgcagaaaaccgctcccccgctcacaccgaaatttgaaatcctcgtccgagactggtgcttcgaacgaagcaacagccgccgcgccatggagaagatctccgtcgccgnccgcttccgccctcccaacctggtggccgctaacacctccccagacagttccggcggagggggcgaccgcgagtggcgtatcgatgacacccgcgattccctcctccaccgcgccgccggactcatcaacggtgtcttccttcgccgccccccacgtcttcgaaggagggtatgaacaacgatctggatttatgggcccccccccccggaaactaatggacccaactccccggcctagttctaaggacaccgacgttcgactactatcagaacaagcgcgcgccaggaccttcccacgtaaaacgactcccaatgtctactcggggtactcgttgctattcacctgatgccaggcgatagtggaaagatctctcctttgtggtgtcaaaaccaagagcaaaaccagccctccggctaaggctaggagatggggttacaaattctctgtcaccaagcgggctacaacctggca

SEQ ID NO: 24265 - protein, 65 aa, Zea mays
  misc_feature: Ceres CLONE 1395220-F
  misc_feature (8)..(8): Xaa is any aa, unknown, or other
MEKISVAXRFRPPNLVAANTSPDSSGGGGDREWRIDDTRDSLLHRAAGLINGVFLRRPPRLRRRV

SEQ ID NO: 24266 - DNA, 656 bp, Zea mays
  misc_feature: Ceres CLONE 1395224-F
  misc_feature: Encodes the peptide sequence at SEQ ID NO. 24267
  misc_feature (400)..(400): n is a, c, t, g, unknown, or other
  misc_feature (435)..(435): n is a, c, t, g, unknown, or other
  misc_feature (444)..(444): n is a, c, t, g, unknown, or other
  misc_feature (481)..(481): n is a, c, t, g, unknown, or other
  misc_feature (645)..(645): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (653)..(653): n is a, c, t, g, unknown, or other
cacccgcggtggcggccgctctagaactagtggatcccccgggctgcaggaattcgcacgagaccattacctagaacatcctaaaaaaaaagcagtccaaacacgcaacgcaacactcgccttcccctcccaaccctccgaaccgaagcagcaaagctagacgatgacgctgacgatcccggacgaggtgcgcgccaaggcggaggtgtacgtgggcgacgcggcggggcaggagaagacgcggctgctcctccaggagacgggcctcccgagcgggctgctcccgctgcgggacatcatcgagtgcggctacgtggaggagacgggcttcgtgtggctccggcagcgccgcaaggtggaccactacttcgccaaggccggccgccacgtgtcctacggncgccgaggtggtcggcggtggccgacaaagggcgnctcaagagnatcacgggcgtcaagcccaggagatgcttgctgtggntcaccctcacgagatctgcgtcgacgacccgccccaggggtagctccactgcaggggcattcgggggcctgtccgcagtttcccccggcgagggccttccaaggcccaaggaagcgggccgcccgggaaacccggggtgcttccccccggggggcgggagaggnaannnaanaca

SEQ ID NO: 24267 - protein, 160 aa, Zea mays
  misc_feature: Ceres CLONE 1395224-F
  misc_feature (2)..(124): Pfam Name: DUF538 Pfam Description: Protein of unknown function, DUF538
  misc_feature (91)..(91): Xaa is any aa, unknown, or other
  misc_feature (94)..(94): Xaa is any aa, unknown, or other
MTLTIPDEVRAKAEVYVGDAAGQEKTRLLLQETGLPSGLLPLRDIIECGYVEETGFVWLRQRRKVDHYFAKAGRHVSYGRRGGRRWPTKGXSRXSRASSPGDACCGSPSRDLRRRPAPGVAPLQGHSGACPQFPPARAFQGPRKRAARETRGASPRGAGE

SEQ ID NO: 24268 - DNA, 714 bp, Zea mays
  misc_feature: Ceres CLONE 1395225-F
  misc_feature: Translation starting site: 192
  misc_feature: SWISSPROT Homolog: EC 3.4.25.1 Proteasome endopeptidase complex
  misc_feature (555)..(555): n is a, c, t, g, unknown, or other
  misc_feature (598)..(598): n is a, c, t, g, unknown, or other
  misc_feature (599)..(599): n is a, c, t, g, unknown, or other
aaagctggagctccccgcggtggcggccgctctatacctagtggatcccccgggctgcaggaattcgcacgagaccattacctagaacatcccaatcgaaaagaccaccaccgctctgcctcgcctcgcctcacctcacctcacctcgccgactagggttttgtaccgccgtggatctcgccgtccccgccatggacgtctcgcacgcgggatcctccgtcgccggcgaggctccgacgaccggggagcaccggatggggactacccatcgtcggggtctgctacgaggggcggcgtcgtcctgggcgccgattccaggaccagcactggaatgtatgtagccaaccgtgcttcagacaagattactcaactgacagaccatggtgtatgtctgtcgctctggatctgctgctgatacacaagtcattttcggattatgtacgctatttcctccaccaacacacaatccagcttggacaccagctacccgttaaagttgcagccaactttggataggttgctagcttatcagaacaagaacatgttgcaagctgncatgattggtttggaggatgggaccagttacgaggggaggcannattttctcagtccctctccggggggaacgatcttgaagcaacattgggcatttgggaggttccaggttccaggttacctatatgcctctttcttgatcatgaatggaaaagaggg

SEQ ID NO: 24269 - DNA, 655 bp, Zea mays
  misc_feature: Ceres CLONE 1395229-F
  misc_feature: Encodes the peptide sequence at SEQ ID NO. 24270
tggagctccccgcggtggcggccgctctagaactagtggatcccccgggctgcaggaattcgcacgagaccattacctagaacatcctaatcgaaaagttcacttctctttggcccgaaaccgagagctagtgcttgattcggccgcttttgggcaccgaacacgttcttgggaccgccgccgccgccctacttccagtcccagatgctcaggtctccatcggcctcgagccctttgccggcgacgagcactcacaacaccagttttgtaagaggggatctgtaccagtcatgctgagcagcagcagcagaggcgtgttctggcttgtgtggcacctagaggagcttacacaacagggaagagtattgtgttaggacgtaacaatggcttcttcaatggaatcgtcataccttcctgctacgactgagtcattagcccaagctcaagaggctcaagatgcttcagagtccatgtcaatcctttaccgtgtcattcaggacccatcttcttctgctgatgcactgagaacaaaagaagttgcaattacaaatcttacgaactacctcactacagaaaacagagctgaggagctgcgtaatcttttgacccagctcagaccattttttgcagctattcctaagctaagactgcaaaa

SEQ ID NO: 24270 - protein, 90 aa, Zea mays
  misc_feature: Ceres CLONE 1395229-F
MASSMESSYLPATTESLAQAQEAQDASESMSILYRVIQDPSSSADALRTKEVAITNLTNYLTTENRAEELRNLLTQLRPFFAAIPKLRLQ

SEQ ID NO: 24271 - DNA, 671 bp, Zea mays
  misc_feature: Ceres CLONE 1395231-F
  misc_feature: Encodes the peptide sequence at SEQ ID NO. 24272
  misc_feature (625)..(625): n is a, c, t, g, unknown, or other
  misc_feature (626)..(626): n is a, c, t, g, unknown, or other
tggagctccccgcggtggcggccgctctagaactagtggatcccccgggctgcaggaattcgcacgagaccattacctagaacatcctaaaaaaaaatagctgaaatctctccacggatcgactctcctccctgccgcgcatgcgcgtcaatggcgccgccagtcgccggcgtcgtgcgtcttgccgcggcctcccgcgtattagttctgtccctctacctgctcgcccgcctcctcttgcgcccctacgacacctccgctactctccacccaccctgcctctcctctttctcctcttccccggatcccaacacgcccgtctccgccgctatctcgtcgctggccgtgtggtacggtgtccacttcgcccgccccgctgagtgcggctactagtacgagcagtccttcgccttcctcccactcctccccggctccctcgtgctcctcgcacgatcgttgttcgcgccgctagtaccgatactagggtacagggccgtgctcgtgctctccggctatgtcctcaacaacgtcgcattcgttgctgctgcggcctacttctacagattgtctgtgctgatcttgatggacagaaagctgcttaccgagctttctgtctgttttgttnncaccctgcttctgtatctactcatcattgtatgcacaaagtctta

SEQ ID NO: 24272 - protein, 80 aa, Zea mays
  misc_feature: Ceres CLONE 1395231-F
MAPPVAGVVRLAAASRVLVLSLYLLARLLLRPYDTSATLHPPCLSSFSSSPDPNTPVSAAISSLAVWYGVHFARPAECGY

SEQ ID NO: 24273 - DNA, 594 bp, Zea mays
  misc_feature: Ceres CLONE 1395233-F
  misc_feature (162)..(162): n is a, c, t, g, unknown, or other
  misc_feature (331)..(331): n is a, c, t, g, unknown, or other
  misc_feature (343)..(343): n is a, c, t, g, unknown, or other
  misc_feature (345)..(345): n is a, c, t, g, unknown, or other
  misc_feature (348)..(348): n is a, c, t, g, unknown, or other
  misc_feature (471)..(471): n is a, c, t, g, unknown, or other
aagctggagctccccgcggtggcggccgctctagaactagtggatcccccgggctgcaggaattcgcacgagaccattacctgaacatcctaatcgaaaaacgaaatggttttgccttcgcttttgcttatgcgtacgcgcggcgaatcacggcgcccaccnttccaaccggacttggagtcacttgactccgccgcgggattcccgcccagatctcattctcgccccacctaaccgccgacggtggcatgatggccaccgagcccttgtccccgggaatctcgtcgaggacgtcgaacactacccctggactcctcctcactctcgcggntacgaaggaccngntgntccgccacctccccccctgtcaacttttcttccacggcggggagaacatggggcttttctcgaaaggaggattaggacgtgggggataactcccgccttccctgggtccccatggcgttacgnccgggagaaatccccggaaggggccccgggggttccttggaaaccctgtccccaagcctaaaaaaaccggggaccccgcaccggaaccggggggtttttcccgggtgggaaaataggtcctac

SEQ ID NO: 24274 - DNA, 641 bp, Zea mays
  misc_feature: Ceres CLONE 1395234-R
  misc_feature: SWISSPROT Homolog: EC 2.7.11.1 Non-specific serine/threonine protein kinase
cgattgggtaccgggccccccctcgaggtcgacggtatcgataagcttttttttttttttttttcattttttttttttttttttttttttttttttttttttttttttttttttttttttttttaaaaaaaaacgacaagactcgttgccaaaaaagaatccgattaccctctttttacacgggacagatctttttcccaagctacagtctacctacccaaaccacctgaccaagcaacgctttcccttgcctcgctaacgaaaacgggccaataatggttttggatttggaccaacagtcgtctccttcgtccctcccagggttctccggggaagcttgcgactgctcttgctagcgctcgcaacaacagcaggcgcctgtttggttccagccttgttgggtccttgacgcttctcggcctcaccaaagtcttggagctcctctaggatagttaccacggcatccatagtcggcctcatcttagcttcgtaggacaggcactcaagaaaaagggcggcaatggcttgtgcgccctcaaggttgtattggccttccagcctggtatccaggatccggaatatcttgcgcttgtgtgtgaggtaaggtcaagcccactccacaaggttgtgctcaccctggg

SEQ ID NO: 24275 - DNA, 682 bp, Zea mays
  misc_feature: Ceres CLONE 1395235-F
  misc_feature: Encodes the peptide sequence at SEQ ID NO. 24276
  misc_feature (336)..(336): n is a, c, t, g, unknown, or other
  misc_feature (399)..(399): n is a, c, t, g, unknown, or other
  misc_feature (400)..(400): n is a, c, t, g, unknown, or other
aagctggagctccccgcggtggcggccgctctagaactagtggatcccccgggctgcaggaattcgcacgagaccattacctagaacatcctaatcgaaaagaaaaaaaaacagcgcgccaccgccaccaaccaaacagaggaaaaggaggggaggaagaagcggaggagagagaaaccctaatcgagatgggcaagcttctctgcgacccctccgccgccgccgtcgccgaggccctgccgccgtccccagcccccgctccgcctccgccgctcctcgcttggtcctccccggccccggcctcctcccccgaggcctccatctcgcccacaggcntgggacgcggtctgggcgctcgaggaccagcagcgccgccgcctccaccggatctgggagcgnngcgtcgcgtgaaaaccctcctcgccgggcgccggcgaggccgcatgcccgcccgtggtcttccgctcgacacggggggggagtcgacgccgatgggaactgctcttcccgccgcgcggacggcagccgctgccaagccgacgcgcgcgagctgagccaccgcgcagtgcgccgattcgccgaggtctacccccgccctgggggagacgacaagaacgccctcgaccgccgcggtgaggcacctctacgcgccgatctcagggcggggggggggggccaggtc

SEQ ID NO: 24276 - protein, 121 aa, Zea mays
  misc_feature: Ceres CLONE 1395235-F
  misc_feature (50)..(50): Xaa is any aa, unknown, or other
  misc_feature (71)..(71): Xaa is any aa, unknown, or other
MGKLLCDPSAAAVAEALPPSPAPAPPPPLLAWSSPAPASSPEASISPTGXGRGLGARGPAAPPPPPDLGAXRRVKTLLAGRRRGRMPARGLPLDTGGESTPMGTALPAARTAAAAKPTRAS

SEQ ID NO: 24277 - DNA, 659 bp, Zea mays
  misc_feature: Ceres CLONE 1395239-F
  misc_feature: Encodes the peptide sequence at SEQ ID NO. 24278
  misc_feature (532)..(532): n is a, c, t, g, unknown, or other
  misc_feature (553)..(553): n is a, c, t, g, unknown, or other
  misc_feature (585)..(585): n is a, c, t, g, unknown, or other
tggagctccccgcggtggcggccgctctagaactagtggatcccccgggctgcaggaattcgcacgagaccattacctagaacatcctaatcgaaaaactcccaccgtatcctcccctgcgtagggtttaaccactcgcagcagccgccgtgactcgagaatcatgtcagcgccgccgtcgctcaagaccccggcaaccgccgtagcggtctctcggcgctcggtcgccaccccgagagccaccgggcttcgcgatgcctgtgctcccccgactcggagcctccggtgctcagcctccgccgccgtggacggcgcttccacagagatggctgatgctccgctggactggccagacaggtcgctggaggagttacgcatcttgccggatcacgacacgttctgcttgatgccgctctcgccgctgcacgggcggtacgatcgcttcgtcaaggagttgatgccctttttcagcgagttcggactaatcagatacggcgttctcatcgagatccagtggctactgaaactttcntcaattcctgagatcactgangtgcctcagttcagcagggaagcgcagtcttngttggaatgcattattgacaattttcgcatagtgatgcaaaagagttacgatatcgagaagtacccaacatgac

SEQ ID NO: 24278 - protein, 110 aa, Zea mays
  misc_feature: Ceres CLONE 1395239-F
  misc_feature: SWISSPROT Homolog: EC 4.3.2.2 Adenylosuccinate lyase
  misc_feature (76)..(76): Xaa is any aa, unknown, or other
  misc_feature (87)..(87): Xaa is any aa, unknown, or other
MADAPLDWPDRSLEELRILPDHDTFCLMPLSPLHGRYDRFVKELMPFFSEFGLIRYGVLIEIQWLLKLSSIPEITXVPQFSREAQSXLECIIDNFRIVMQKSYDIEKYPT

SEQ ID NO: 24279 - DNA, 686 bp, Zea mays
  misc_feature: Ceres CLONE 1395240-F
  misc_feature: Encodes the peptide sequence at SEQ ID NO. 24280
  misc_feature (606)..(606): n is a, c, t, g, unknown, or other
tggagctccccgcggtggcggccgctctagaactagtggatcccccgggctgcaggaattcgcacgagaccattacctagaacatcctaatcgaaaaacggatcaaaatcgaatccaacgctactgcctagggtttcctctgcatttcccctaccacaccccgcgccgcccacccatggccgccgcagacgcgtccgccgagaccgccgccatcgcgcggcgcctggcctcctgcaacaccggcacccgggagcgcgcgctccgctacctcctctccgaatttctgccggcctccgcgccgcgcctctccgccaccgacctcctcaagctctggaagggcatcttcttctgcttctggcacgccgacaagccgctctaccagagctccgtcgccacgcgcctcgcctccgccgtctccgtcccgccgtcccccgccgatggtgccgccttcctcgccgcctacctcaccacgctccgccgcgagtgggcccacatcgacgtccaccgcctcgacaagttctacctcctcaaaccgccggttcctccaccacgccttcctgcttctccatgctaactccttcggcccccgacgtcacctcccagggntcgtgtccggtccttgtcagacaaggccctgggctcccggaaagccgacaacgtcgccgctgcccacctcccggggggct

SEQ ID NO: 24280 - protein, 132 aa, Zea mays
  misc_feature: Ceres CLONE 1395240-F
  misc_feature (9)..(133): Pfam Name: Nop52 Pfam Description: Nucleolar protein,Nop52
MAAADASAETAAIARRLASCNTGTRERALRYLLSEFLPASAPRLSATDLLKLWKGIFFCFWHADKPLYQSSVATRLASAVSVPPSPADGAAFLAAYLTTLRREWAHIDVHRLDKFYLLKPPVPPPRLPASPC

SEQ ID NO: 24281 - DNA, 698 bp, Zea mays
  misc_feature: Ceres CLONE 1395243-F
  misc_feature: Encodes the peptide sequence at SEQ ID NO. 24282
  misc_feature (495)..(495): n is a, c, t, g, unknown, or other
  misc_feature (535)..(535): n is a, c, t, g, unknown, or other
  misc_feature (536)..(536): n is a, c, t, g, unknown, or other
  misc_feature (651)..(651): n is a, c, t, g, unknown, or other
tccccgcggtggcggccgctctagaactagtggatcccccgggctgcaggaattcgcacgagaccattacctagcatcctaatcaaaaaaagtctctcaaatctggaatcctttcacgccgccactctcccctttttccttctctcttcgtcgttgtggctcctgccttcctgcctcggcgcatcgactcgcggagagggacagcacagcgcctcctccccatcctttctccattcccagatcgaaggtccataaaaaaccatccttttgcatctgattgagcactgtctttgtgcaagagaacaatttagttgtacatacaaacaaaaagaagtgggagtatttttcagagtttattagaagagactgtttcgaggacccaggtcagagaaaggcgagaagctttagcagcggcaatggtctggtcaatggacccgcaggtgaccgtccacggcgactgggtgtcagccgtggtgccgctgatgaagctgctgntgcctgggcggtgatcggcctgctcctcgccaacccgcgnngtccaggtcgtgcccagggccaccttcaagctcctgagcaagctcgtcttcgcgctcttcctccctggcctcatcttcgtcactttcggggaagtcggcacccatagacacgtcntgggggactctgggggttcatccccccgtcaacgtgctcatcagact

SEQ ID NO: 24282 - protein, 30 aa, Zea mays; identical to SEQ ID NO: 24247
  misc_feature: Ceres CLONE 1395243-F
  misc_feature (27)..(27): Xaa is any aa, unknown, or other

SEQ ID NO: 24283 - DNA, 703 bp, Zea mays
  misc_feature: Ceres CLONE 1395245-F
  misc_feature (514)..(514): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (557)..(557): n is a, c, t, g, unknown, or other
  misc_feature (615)..(615): n is a, c, t, g, unknown, or other
  misc_feature (637)..(637): n is a, c, t, g, unknown, or other
  misc_feature (653)..(653): n is a, c, t, g, unknown, or other
  misc_feature (665)..(665): n is a, c, t, g, unknown, or other
  misc_feature (671)..(671): n is a, c, t, g, unknown, or other
  misc_feature (677)..(677): n is a, c, t, g, unknown, or other
  misc_feature (680)..(680): n is a, c, t, g, unknown, or other
  misc_feature (684)..(684): n is a, c, t, g, unknown, or other
  misc_feature (687)..(687): n is a, c, t, g, unknown, or other
  misc_feature (690)..(690): n is a, c, t, g, unknown, or other
  misc_feature (694)..(694): n is a, c, t, g, unknown, or other
  misc_feature (695)..(695): n is a, c, t, g, unknown, or other
aaagctggagctccccgcggtggcggccgctctagaactagtggatcccccgggctgcaggaattcgcacgagacccttccctagaacatcctaatcaaaagcttcacttcaattctcctcctcgccgagcgggagcgccgagagagatgcgaccgcgatgcccccactcgtcccctcccagctcctaccaccaagcccaaccctgatcctacccgcgccacctcgcctctcctgccgccgccgccgcttcccgcccgcactgcttgccgcgtcgtcgtcctcctccgcgtccccgcactccaggcaaccataccgccgccgccgccgccttgaagcccagcgccagacaccgacgcctgcgccgcgcccgccctcccagccaaagccgcctccgcgccacgcaaatgccaccgcgtcccgcgctcggggccaggaggagctggaggcggcgatttacgacttcatgtgccgctccgccaagccaggagccttccccacccgcgaggagctcgntcgcggcgggccgctcnnnacctcgcggacgccgtcgcgtccngggggggctggctctccctcggctggtcctccccggccgcggggggcccccgcgccgntggctgcgccgcgctcttcggncgggggccccccgggnctccccgctggngccggngggggnttnccgnggnggncctnncgcccgtt

SEQ ID NO: 24284 - DNA, 680 bp, Zea mays
  misc_feature: Ceres CLONE 1395246-F
  misc_feature: Encodes the peptide sequence at SEQ ID NO. 24285
  misc_feature (641)..(641): n is a, c, t, g, unknown, or other
  misc_feature (668)..(668): n is a, c, t, g, unknown, or other
tccccgcggtggcggccgctctagaactagtggatcccccgggctgcaggaattcgcacgagaccattacctagaacatcctaatcgaaaaagacaaccaaacgaaccctcccggagcagcaaagcataggcgctcgagcgctccctcccgagctcctccgcctcacggtcacgcctcgtgtccccccaccccctcctcctcctcctcggccggccgcctcacgccgtcacctccgctcggcgagtctcggctccgaccgctgccgccacgtgcgacctcccctactcctgagagatctgcggggctcggcatggggtgaccagatcgggccgctgctcggtgctttccagctgaattttgcccgcagctcgtgtcggaggcagcgaagatggcggaggccggcgtggcacgcggctcagggagcgctggcgatgctttgttcagggaactctggcatgctggtgctggggccgttggtcacagtgcctcgccaaggcgagctggtttattacttcccccagggtcatatggaacagcttgaagcgtctacagatcaacaacttgatcagcactttgcctttgtttaatctaccgcacaaatccttcctgcaaggtggtcaatgtagaaacttagagctgnactgtttcctggaagaaggtttatgcntccaattatgct

SEQ ID NO: 24285 - protein, 51 aa, Zea mays
  misc_feature: Ceres CLONE 1395246-F
MLCSGNSGMLVLGPLVTVPRQGELVYYFPQGHMEQLEASTDQQLDQHFAFV

SEQ ID NO: 24286 - DNA, 675 bp, Zea mays
  misc_feature: Ceres CLONE 1395256-F
  misc_feature: Encodes the peptide sequence at SEQ ID NO. 24287
gctctagaactagtgggtcccccgggctgcaggaattcgcacgagaccattacctagaacatcctaatcgaaaaaccttgtctacaagggttttccgctggcttatcccttcgtccacgctccctgcagccgccgcccaaaccctagcaacccgtcctccgccatggccgacgaccactactcctctaagaggaagtacgacgacccctcgccgccgccgcggcgcacggggttctcttcgggcccgccgcctgcctcgccgctcgcgggcggcgccccgtcgtacaacagcgtgccaccgccccccgatgagatccagctcgcgaagcagcgcgcgcaggagatcgcggcgcggatctttaacgccgcagaggccaagcgtcctcgcgtcgacaacggcgacgatgacagcggcggcttcggtgtaggcctgggcagcactggtggcggtggccgcatcggcggcggaggactcggcttctcgtcctctgccggtggtgggcacggggcttctatcccacaattatcttctcagagcagcgcacctcagtactcctcttatgggggatatcatggtacaagcaaaaagatcggaatcccaaatggaaggagtgctgttctcctcggccgagccggggcgcccattagggatatccaactgcgcccaggagcaag

SEQ ID NO: 24287 - protein, 170 aa, Zea mays
  misc_feature: Ceres CLONE 1395256-F
MADDHYSSKRKYDDPSPPPRRTGFSSGPPPASPLAGGAPSYNSVPPPPDEIQLAKQRAQEIAARIFNAAEAKRPRVDNGDDDSGGFGVGLGSTGGGGRIGGGGLGFSSSAGGGHGASIPQLSSQSSAPQYSSYGGYHGTSKKIGIPNGRSAVLLGRAGAPIRDIQLRPGA

SEQ ID NO: 24288 - DNA, 912 bp, Zea mays
  misc_feature: Ceres CLONE 1395260-F
  misc_feature (20)..(20): n is a, c, t, g, unknown, or other
  misc_feature (21)..(21): n is a, c, t, g, unknown, or other
  misc_feature (37)..(37): n is a, c, t, g, unknown, or other
  misc_feature (38)..(38): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (912)..(912): n is a, c, t, g, unknown, or other
gtgccccccccccctccccnncctcgaatcacacttnntttgatnnnnatataactggagctcaccgcggtggcggccgctctagaatagtggatcccccgtgctgcaggagttcgcacgagaccattacctagaacatcctcatcgaaaagcggttccgacgctccgcactccgctcccctctcccaagcaaacacagccgagtccacgcacgcctcccatcattcctcaaccgcctcgccggagtaaggggagtagcggaggatggagattgaccaggctgcgcgggtgcaacgaccgccgcatgcgcaccaagtacagcaacgccgtctacgtcgtccagcgggccttcgccgctctacccctttgaggaagtcgccttcagccttttaaatggcgaggaaggatccaactgtggcctcctgccatttgattccaagctgggaactacccttttacaaagaagggactttccccccccggcaaccccaaacccaaagcgctggttaaaaaaccgggtccaccggcggcaactaattccaatttccacaaaaccccccctgggggctttttcccctggacaaatcaaagattcctttcgagctcttactccaaagattgggtcctccaccctcttatggcggcccaaagccttctcgggaaacaacactcccaaatttgcctttgtcccaaaagatcatgtgcttcaacaaacagggcctccggctgcatatgggaaagcccctctccgaagagcgaccgtttttggcctgggggacaaaacgaaatttcttgtagcccccaacaggcgattctgacttctggaaaaagagagttctgccctgccacacacgcccgatggaccgcgcctcctcccctctatccaagaggcaggcacaaccccgctccgcn

SEQ ID NO: 24289 - DNA, 501 bp, Zea mays
  misc_feature: Ceres CLONE 1395261-F
  misc_feature (209)..(209): n is a, c, t, g, unknown, or other
  misc_feature (257)..(257): n is a, c, t, g, unknown, or other
  misc_feature (476)..(476): n is a, c, t, g, unknown, or other
  misc_feature (477)..(477): n is a, c, t, g, unknown, or other
agagctggagctccccgcggtggcggccgctctacaactagtggatcccccgggctgcaggaattcgcacgagaccattacctagaacatcctaatcgaaaactcatttttctctctcctgcgccgcgacgtccctccgccttcgccgccgaatccgagactccgatctcgggttcaccgcagcgcacagagcagccccgactcccggnccgatcccgcgctctcctctccgtcgcttcagtcatggcaggaatggncacctgaggggttcctccagtttccgatgggttaaagccccaattgaattttttaaaaaggccggggaatttggttgaaaaacccgggggaaaaattggggagggtcttttcctttttaaatgggggagagtttttttgggaaagtttttttggagaattggggcccccccccaaagaaaaattctttttggggggggttttattatggtggggggggnntaaaaaaaaccccccctctctgcc

SEQ ID NO: 24290 - DNA, 672 bp, Zea mays
  misc_feature: Ceres CLONE 1395263-F
  misc_feature: Encodes the peptide sequence at SEQ ID NO. 24291
  misc_feature (602)..(602): n is a, c, t, g, unknown, or other
  misc_feature (619)..(619): n is a, c, t, g, unknown, or other
  misc_feature (622)..(622): n is a, c, t, g, unknown, or other
cgctctagaactagtggatcccccgggctgcaggaattcgcacgagaccattacctagaacatcctaatcgaaaaaccatcatcacactcgaaacccaacagcttccttcctggcgatccaattaacggcttctcttctgagctcagcacgaacaatggccaccatcctcaccgtcgcaagcttcttcgcacttgtgtgcatctctcaacaagcgcgggctgcgaactacacgttcatgaaggacgcggtgcacgcgccgcggacgggcttctacgactacatcatagtcggcggcggcacggcgggctgcccgctggcggccaccctgtcggcccgcgcgcgggtgctgctgctggagcgcggcggctctccgtacgaggacgcgcgcgtcctgaacatggcccacttctcggacgtgctggcggacacgtcggcgtcgtccccgtcgcagcggttcgtgtcggaggacggcgtgatcaactcccgcccgcgcgtgctgagcggcgtcagctgcatcaacgccggcttcttcacgcgcgccggcgcgggctacgtcagggtcgacggctgggaccccagggtagtgcgggcggcgtaccgntgtatgggaggacgtgntcncgttccgcccggcgctaggtccgtggcatggcgtccgtgcggatgagcct

SEQ ID NO: 24291 - protein, 170 aa, Zea mays
  misc_feature: Ceres CLONE 1395263-F
  misc_feature: SWISSPROT Homolog: EC 4.1.2.10 Mandelonitrile lyase
  misc_feature (155)..(155): Xaa is any aa, unknown, or other
  misc_feature (156)..(156): Xaa is any aa, unknown, or other
MATILTVASFFALVCISQQARAANYTFMKDAVHAPRTGFYDYIIVGGGTAGCPLAATLSARARVLLLERGGSPYEDARVLNMAHFSDVLADTSASSPSQRFVSEDGVINSRPRVLSGVSCINAGFFTRAGAGYVRVDGWDPRVVRAAYRCMGGRXXVPPGARSVAWRPCG

SEQ ID NO: 24292 - DNA, 694 bp, Zea mays
  misc_feature: Ceres CLONE 1395265-F
  misc_feature: Encodes the peptide sequence at SEQ ID NO. 24293
  misc_feature (646)..(646): n is a, c, t, g, unknown, or other
cgcggtggcggccgctctagaactagtggatcccccgggctgcaggaattcgcacgagaccattacctagaacatcctaatcgaaaatctgggccccatgtgctaactgcctgtaaaccctaatcccgaatccctcccggcctcctccgtctcgcgctcgattcgaatccgagctccctatcctgctcctgctgttcccgctgcaatggaggacaacgcggtcgaagagcccgagttgagcggtgcggcggagttcgcgccggcgctcgtcgccgcccacccacacggcaactccgtcgccgtcgccatcgggcccgagctccgcgtgtttgatctcagggctggtcatccagtttcattgtcagatgattgtggtggccattctcattcagacgcaataagagctatctgcttcagtgtgagtgcagctttgtttgcttcagctggtgatgacaaacttgtgaaggtttgcaagactgattcgtgccgttgcatccagactataacttcggagaaagaggtcagtgcagttgttattagcaacgatgacctgtatgtatctcttgcagataaatttgtggtgtttggttagtccctttgcgggaagaagtgcaaagcaggtttcaagtgataacaacctgggccnattcctggtcactattgagtatcatcactagcatgaggttttcgccaa

SEQ ID NO: 24293 - protein, 128 aa, Zea mays
  misc_feature: Ceres CLONE 1395265-F
MEDNAVEEPELSGAAEFAPALVAAHPHGNSVAVAIGPELRVFDLRAGHPVSLSDDCGGHSHSDAIRAICFSVSAALFASAGDDKLVKVCKTDSCRCIQTITSEKEVSAVVISNDDLYVSLADKFVVFG

SEQ ID NO: 24294 - DNA, 722 bp, Zea mays
  misc_feature: Ceres CLONE 1395266-F
  misc_feature: Encodes the peptide sequence at SEQ ID NO. 24295
  misc_feature (584)..(584): n is a, c, t, g, unknown, or other
  misc_feature (635)..(635): n is a, c, t, g, unknown, or other
  misc_feature (722)..(722): n is a, c, t, g, unknown, or other
gctctagaactagtggatcccccgggctgcaggaattcgcacgagaccattacagaacatcctaatcgaaaaaaaaccgaccgaaagcggaaagcaaatagcagacggcagacaacagtcgaggggacacaggaaggcgcgaagaagaccgagatcctcgcccaacgccatcacgccactcccccaatactcaggtgtcaggacagcgagcaggcacaagcagatctcactccacgttgctccttccgcccttcctctccgccgctccccggaaggatcatggagcgcgggattcttggctccaggggcgccgtccaaatcttggggtcgaagaccggggccgcgatgtcatgtggcaaaacaacctctacaagttttacttgttctaccaaacacgagctgaacttgcatgtgaatgttaagccgttgcaattgttttgctgaagaaaagatcggagtactgttattaaatcttggtggtccagaaaccctagacgatgttcaaccattcttgttcaacctatttgctgatccagatatcattcgactgcctaggctcttcaggttcccttcaagacactggncaaacttatttctacttttagagctcctaagagtaaagaagggtatgcttncatcggggggtgggtcaccattgaggaaaaatactgatgagcaggcaaatgctttgaagattgctctggaaaagaaaaattgacgcn

SEQ ID NO: 24295 - protein, 100 aa, Zea mays
  misc_feature: Ceres CLONE 1395266-F
  misc_feature: SWISSPROT Homolog: EC 4.99.1.1 Ferrochelatase
  misc_feature (57)..(57): Xaa is any aa, unknown, or other
  misc_feature (74)..(74): Xaa is any aa, unknown, or other
MLSRCNCFAEEKIGVLLLNLGGPETLDDVQPFLFNLFADPDIIRLPRLFRFPSRHWXNLFLLLELLRVKKGMLXSGGGSPLRKNTDEQANALKIALEKKN

SEQ ID NO: 24296 - DNA, 667 bp, Zea mays
  misc_feature: Ceres CLONE 1395267-F
  misc_feature: Encodes the peptide sequence at SEQ ID NO. 24297
gctctagaactagtggatcccccgggctgcaggaattcgcacgagaccattacctagaacatcctaatcaaaaatatacagagcgagccagcacacagtttttttcataaggctggtctgcaattaggtgcctcgactgcttgctagccgccggattaatctttccctaccctaaggctcaggttttagtgggatatgatgaagctaaaaagtggacgacgaccgttctataaggatgttaagcctgtagactgccgttcaggctcaagtcttccacatttggctgctcaagcaaagtttgcagccatgaacatgcagaatgaagatgtcaagcctcgtcgaccagttcaagtcagacgaagtagatgggttcttggtgatgtaaccgaggtgttggatcataattcgtggaggcttgggaagatacagaagttctgaagaatgactattttgtcatcaggctagtggggtgcatccaaccaagagaattcacatatcttgctttgagatccacatggatgcaagcagttgactggtgggaggcagatcattgaactggataagccgatccgatttgctgactgctcctctccccactcaaaaatgggggatgaaccggaaccttcagcctaccgaggaggtggaccctatggttagagggaggcca

SEQ ID NO: 24297 - protein, 80 aa, Zea mays
  misc_feature: Ceres CLONE 1395267-F
MMKLKSGRRPFYKDVKPVDCRSGSSLPHLAAQAKFAAMNMQNEDVKPRRPVQVRRSRWVLGDVTEVLDHNSWRLGKIQKF

SEQ ID NO: 24298 - DNA, 703 bp, Zea mays
  misc_feature: Ceres CLONE 1395268-F
  misc_feature: Encodes the peptide sequence at SEQ ID NO. 24299
aaagctggagctccccgcggtggcggccgctctacaactagtggatcccccgggctgcaggaattcgcacgagaccattacctagaacatcctaatcgaaaaactgcgcctgcggaggatcggaggaaccagtagcggaggcttcgattttcggcgggcgcaataaatttcccgcatggctcggagggccgcgtcctcgctcgtctcccgctgcctcctggcgagggcccctgccggcgcgccgcccgctgccccctctgcgctgcgcaggacagtggctgcagatgggatgcacaggctgttgccaggtgtccttcagaggttcagcactgcagcagcagtagaggagcccatcacgccgtcagtccatgagaactacacaaagctcctcattaatggcaactttgttgattccgcatccggcaagaccttcccaactctggaccctcgtacaggggaggcgattgctcatgtggctgagggtggcgcagaggacattaaccgtgcagtagctgcggctcggaagggttatgatgaagggccatggccgaagatgactgcctatgagaggaccggtatcctactgcggcttgctgatttgatagaggagcacaatgacgagcttgctgctttggagacatgtgacaacgggaagccatatgagcaagaagcccagattgaagtacccatgatggcccgtctt

SEQ ID NO: 24299 - protein, 176 aa, Zea mays
  misc_feature: Ceres CLONE 1395268-F
  misc_feature: SWISSPROT Homolog: EC 1.2.1.3 Aldehyde dehydrogenase (NAD(+))
MARRAASSLVSRCLLARAPAGAPPAAPSALRRTVAADGMHRLLPGVLQRFSTAAAVEEPITPSVHENYTKLLINGNFVDSASGKTFPTLDPRTGEAIAHVAEGGAEDINRAVAAARKGYDEGPWPKMTAYERTGILLRLADLIEEHNDELAALETCDNGKPYEQEAQIEVPMMARL

SEQ ID NO: 24300 - DNA, 677 bp, Zea mays
  misc_feature: Ceres CLONE 1395269-F
  misc_feature: Encodes the peptide sequence at SEQ ID NO. 24301
cgctttcaactagtggatcccccgggctgcagtaattcgcacgagaccattacctagaacatcctaatcgaaaaaaccccgaccgcccatgtccgccatcgcggcctcctcggccgccgccgccgcggcgtcgaactccgatgaggaagaaaactataaggagtacatcccagtcgccaagcgccgggccatggaggccgagcgcctccgccagctccgcctctccaagtcggcgccggcctctgccgtctcatcactcccgatgccacctcccccgcctcttttaccagcgcagacctccgttcccgacgccgccgcgaagcccagccttctcgtcaaggccacgcagcttaagcgcgcggccccggaggtgaccgccacggagcagcgcatccagcaggagaaggaagtgattgaaaatctctcagacaacaaatcgctcaggtcagtccgcgagatcgccaagggcatcatctacacggaaccgatccagaccgggtggaagccgccccctcgcctccgcgggatgccggtcggcaaagccacgagttccggcgacagtgggacatcatcggccacggggacgaaaatacgccgcctgggggggattccgggaatccccgcccccgggacccatggttccgaaactgggccgaaagggaatcctccacccccgc

SEQ ID NO: 24301 - protein, 196 aa, Zea mays
  misc_feature: Ceres CLONE 1395269-F
MSAIAASSAAAAAASNSDEEENYKEYIPVAKRRAMEAERLRQLRLSKSAPASAVSSLPMPPPPPLLPAQTSVPDAAAKPSLLVKATQLKRAAPEVTATEQRIQQEKEVIENLSDNKSLRSVREIAKGIIYTEPIQTGWKPPPRLRGMPVGKATSSGDSGTSSATGTKIRRLGGIPGIPAPGTHGSETGPKGNPPPP

SEQ ID NO: 24302 - DNA, 704 bp, Zea mays
  misc_feature: Ceres CLONE 1395271-F
  misc_feature: Encodes the peptide sequence at SEQ ID NO. 24303
  misc_feature (395)..(395): n is a, c, t, g, unknown, or other
  misc_feature (477)..(477): n is a, c, t, g, unknown, or other
  misc_feature (537)..(537): n is a, c, t, g, unknown, or other
tcaccgcggtggcggccgctctagaactagtggatcccccgggctgcaggaattcgcacgagaccattacctagaacatcctaatcgaaaactcactatatactcactcctgctgttttccgtccatccgcccaccggttcgcagcccgcgcctcaaaaccctagccccgggcggatcgcggggcgcctccgcggtgccagcgacgcggctcgtttgatccgattgttggtcgagccccgccctcgctgccgcgcttcgctccggctgtgcagcggcgtgagcaccgagcacactcgcgaatggggaactgctggggtgcgcggatcaaggatgggagccctcaccctggcgcctcaggaatgttctcaaagagtagtggcaaggatgggagtangcttagcggctgtagtagtcgagcctcttcagcttctatgccaccaagtgcgaagactgaatgtgaaatccctgcatccgcnatggtaagatcttcacctttcataatctcaaggcagcacaaggaatttccggcctgatanggtctaagggaaagaggttttggatctgccataaagatggaatgatgaaaacctttatcccttgcaaactggcactgggatccttgtgctggaaaaaatcaacctggggttttaaggggcaccaaaagggtgcggagagtaattcccaggggggtttgcatcccaac

SEQ ID NO: 24303 - protein, 77 aa, Zea mays
  misc_feature: Ceres CLONE 1395271-F
  misc_feature (32)..(32): Xaa is any aa, unknown, or other
MGNCWGARIKDGSPHPGASGMFSKSSGKDGSXLSGCSSRASSASMPPSAKTECEIPASAMVRSSPFIISRQHKEFPA

SEQ ID NO: 24304 - DNA, 697 bp, Zea mays
  misc_feature: Ceres CLONE 1395279-F
  misc_feature: Encodes the peptide sequence at SEQ ID NO. 24305
  misc_feature (529)..(529): n is a, c, t, g, unknown, or other
aaagctggagctcaccgcggtggcggccgctctataactagtggatcccccgggctgcaggaattcgcacgagaccattacctagaacatcctaatcaaaaccccgcacggcaccagtgacgcgaaagcaaaacgccaaacaggctcctctgaaactcccagagccggtagaggcacgccactccgcagtgtcagtcactgcccccccatcacgccgcccgccctttctcggccgttgccgcgagctcgcttcgacccaccgccgatggcgacggcgatgagcgcgatggccgccacctgcatggcctcgatcccggccgccgctacgttccccggtgatctcggcgtcggacgacgccgagcggttgtaccagggtggcgcgccggtgggagacggctgcgtgcgacgccgcctgcccggaggccgttcctgttctcgccgaagggcgtttcggactcgcggagctcgcaaacgtgccttgatccggacgccagcacgagtgttcttgggatcatccttggagggggngctgggacaaggttggattcactggacgaaaagaggccgaaaacagcagtgccggtgggcgccaacaaccggcttatagatatccctggcaggaactgtttcaaaggaacggcttccagaaaaagggggtaaacaagtcaaatttgcttcggttaaccggcccttttg

SEQ ID NO: 24305 - protein, 131 aa, Zea mays
  misc_feature: Ceres CLONE 1395279-F
  misc_feature: SWISSPROT Homolog: EC 2.7.7.27 Glucose-1-phosphate adenylyltransferase
MATAMSAMAATCMASIPAAATFPGDLGVGRRRAVVPGWRAGGRRLRATPPARRPFLFSPKGVSDSRSSQTCLDPDASTSVLGIILGGGAGTRLDSLDEKRPKTAVPVGANNRLIDIPGRNCFKGTASRKRG

SEQ ID NO: 24306 - DNA, 723 bp, Zea mays
  misc_feature: Ceres CLONE 1395284-F
  misc_feature: Encodes the peptide sequence at SEQ ID NO. 24307
  misc_feature (597)..(597): n is a, c, t, g, unknown, or other
  misc_feature (601)..(601): n is a, c, t, g, unknown, or other
  misc_feature (602)..(602): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
aaagctggagctccccgcggtggcggccgctctagaactagtggatcccccgggctgcaggaattcgcacgagaccattacctagaacatcctaatcgaaaaactccgtatctctcgtgcctttttcctttcctggttgcgacgagccgacgactgggcggacgccgctgccgccctacgccaggtcttcgtcggccccttcgacgagcacacacaagattcagtcgggaatgttgaatgcatagtgtaatttctgcgcaaaaagatggcatcagacgagttcatcagccttgacgcaccttgtgaggctgatgcgaaagatgaagggggagacgttcaggttaaagctcctgatgtgagtgggatggagcctctggtatcggatctccaaccagaagggaaagctggtgctgtgggtagtaatcccaagacatctgctgggaacctggatcttgaagaggggcaagtggaagatatggacctcgcggatgatgacgtagtggttggaaaggatcagctattagatgcttccattcagcccgagatcagtgttgcagctgtgcagactgtgattgggttttgaggtcaagctggacnaggnnggacgggactgaaaatggaataatttatgagtcaaacagcatctctattgaagaaagtccnnntcagaggagtaaaagagcccgtggtggatcaaaggaacctttctggtcgtgtcatcta

SEQ ID NO: 24307 - protein, 105 aa, Zea mays
  misc_feature: Ceres CLONE 1395284-F
MASDEFISLDAPCEADAKDEGGDVQVKAPDVSGMEPLVSDLQPEGKAGAVGSNPKTSAGNLDLEEGQVEDMDLADDDVVVGKDQLLDASIQPEISVAAVQTVIGF

SEQ ID NO: 24308 - DNA, 710 bp, Zea mays
  misc_feature: Ceres CLONE 1395288-F
  misc_feature: Encodes the peptide sequence at SEQ ID NO. 24309
  misc_feature (678)..(678): n is a, c, t, g, unknown, or other
aaagctggagctccccgcggtggcggccgctctagaactagtggatcccccgggctgcaggaattcgcacgagaccattacctagaacatcctaatcgaaaaccacagcctccccagcatcattgaagctcgctcaccggcattcgacgaccccctcccgcacagatgaccatggccgcggggatgaccggcagtgctcgcgccagcaccggctccttgctcgtgcttctcttcgtcgcgctggccggcgcgaccgccggggcgagtgccaccgttgccttcagcagcggtaaccgcaacgcgctggcgctgctgacgacgcccgcatcggcgtccccggggcagctgaacgtgatcatccagtgccttatgggctgcttcacgcacgtgttcggctggtcgttcggatgcatggacgagcagggcgctgacctgccgctctgcatcatcagctgcgaccagaagaagcgtcgtgtgcatggtcagctgcggacttgcgccgtcaccgccatcaccgtcgccgcccacgcccaaccaccagcacccaagccgcccacgcccaagccgcccggaccgctaaaaaccccgtcgtacgccggccgctgccggtcaccggacgcacatctgggcttgatatgtcgacatggtgcctgccagctctcaaccgatccatcgtanccagaacgtagtaatgttccaagggatcgggt

SEQ ID NO: 24309 - protein, 179 aa, Zea mays
  misc_feature: Ceres CLONE 1395288-F
  misc_feature (169)..(169): Xaa is any aa, unknown, or other
MAAGMTGSARASTGSLLVLLFVALAGATAGASATVAFSSGNRNALALLTTPASASPGQLNVIIQCLMGCFTHVFGWSFGCMDEQGADLPLCIISCDQKKRRVHGQLRTCAVTAITVAAHAQPPAPKPPTPKPPGPLKTPSYAGRCRSPDAHLGLICRHGACQLSTDPSXPERSNVPRDR

SEQ ID NO: 24310 - DNA, 687 bp, Zea mays
  misc_feature: Ceres CLONE 1395289-F
  misc_feature: Translation starting site: 261
  misc_feature (368)..(368): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (438)..(438): n is a, c, t, g, unknown, or other
  misc_feature (446)..(446): n is a, c, t, g, unknown, or other
  misc_feature (460)..(460): n is a, c, t, g, unknown, or other
  misc_feature (461)..(461): n is a, c, t, g, unknown, or other
  misc_feature (474)..(474): n is a, c, t, g, unknown, or other
  misc_feature (548)..(548): n is a, c, t, g, unknown, or other
  misc_feature (559)..(559): n is a, c, t, g, unknown, or other
aaagctggagctccccgcggtggcggccgctctagaactagtggatcccccgggctgcaggaattcgcacgagaccattacctagaacatcctaatcgaaaaacgaaacccacccgcatttcccctgtgcagctgtgctggccaagtcgtctggactctggactctggagcctgtctgcccgtcccggttcagcttgctcgcctcgcttatgagttctgagctgtgacaagaactcaggaggtggttgacgggtgaagcgatggtggggagctacgcgaacggtggcggggctgcgccggcggcggtagcggcggagaagctcgacgagctgcggctgctgctggggaagtcggacgggacacgctgncgggtcgtcggggtgggcgccagggcgtgnnnggagcgtgttctgcgcgcttttgcaggacgcgtacggncggcaccngcgaccggtgcagnntgcgcgtgtggcnccgcgccgggcgcgccgtaaaccgcgccgacgccgagcgccctcttcgaggtcatcaactccccgcgaggacgntgctgcgccgnctcatccgccgctgcgcctacctcaggtacgtcgaggcgccggctcggggaccgcacgctgcaccgccgacgagatccttccgcgacggcttctggcctcacatggtcgacaccccgctctgcccggt

SEQ ID NO: 24311 - DNA, 726 bp, Zea mays
  misc_feature: Ceres CLONE 1395291-F
  misc_feature: Encodes the peptide sequence at SEQ ID NO. 24312
  misc_feature (579)..(579): n is a, c, t, g, unknown, or other
  misc_feature (635)..(635): n is a, c, t, g, unknown, or other
  misc_feature (689)..(689): n is a, c, t, g, unknown, or other
aaagctggagctccccgcggtggcggccgctctagaactagtggatcccccgggctgcaggaattcgcacgagaccattacctagaacatcctaatcgaaaaacatcgatcagtcgcgtgtctaggtttcctctctcaccatagcgcccgctctgtcgcccttcgttcacctctccttcctctcctccctgcctgccagggagaggggaagtcagaggcacggagtggcgcagagcagacgcacgtgaaccattgtagctgtccctgtcgtcgtcgtcgtcgtcaacgaatccacacaaggaaaggatggagaagaagccgaccatcctcatgaacaggtacgagctcgggcgcacgctcgggcagggcaccttcgccaaggtgtaccacggccggaacctcgcgtccggcgagagcgtggccatcaaggtcatcgacaaggagaaggtgatgcgcgtcggcatgatcgaccagatcaagcgcgagatctccgtcatgcgcctcgtccgccaccccaacgtcgtgcagctggcacgaggtgatggccagcaagagcaagataacttcgccatggagtancgtccggggcggcgagctcttcgcccgcgtcgcccgcggcgggctcaaggagacgncccgcgagaagtacttcaccagcttccgtcggcgccgtcgacttctgcacaagncgccggcgtctaccaccgcgacctcaagcccgagaac

SEQ ID NO: 24312 - protein, 140 aa, Zea mays
  misc_feature: Ceres CLONE 1395291-F
  misc_feature: SWISSPROT Homolog: EC 2.7.11.1 Non-specific serine/threonine protein kinase
  misc_feature (91)..(91): Xaa is any aa, unknown, or other
  misc_feature (110)..(110): Xaa is any aa, unknown, or other
  misc_feature (128)..(128): Xaa is any aa, unknown, or other
MEKKPTILMNRYELGRTLGQGTFAKVYHGRNLASGESVAIKVIDKEKVMRVGMIDQIKREISVMRLVRHPNVVQLARGDGQQEQDNFAMEXRPGRRALRPRRPRRAQGDXPREVLHQLPSAPSTSAQXAGVYHRDLKPEN

SEQ ID NO: 24313 - DNA, 744 bp, Zea mays
  misc_feature: Ceres CLONE 1395295-F
  misc_feature: Encodes the peptide sequence at SEQ ID NO. 24314
  misc_feature (404)..(404): n is a, c, t, g, unknown, or other
  misc_feature (572)..(572): n is a, c, t, g, unknown, or other
  misc_feature (606)..(606): n is a, c, t, g, unknown, or other
  misc_feature (607)..(607): n is a, c, t, g, unknown, or other
  misc_feature (642)..(642): n is a, c, t, g, unknown, or other
  misc_feature (643)..(643): n is a, c, t, g, unknown, or other
  misc_feature (658)..(658): n is a, c, t, g, unknown, or other
  misc_feature (676)..(676): n is a, c, t, g, unknown, or other
  misc_feature (677)..(677): n is a, c, t, g, unknown, or other
  misc_feature (716)..(716): n is a, c, t, g, unknown, or other
aaagctggagctccccgcggtggcggccgctctagaactagtggatcccccgggctgcaggaattcgcacgagaccattacctagaacatcctaatcgaaaaatctcctctctggacgaacagatcctctctggacgaacagaaaggttaccagcagcaccacggcgagatctccccttggcgggccaaaaccgacggcgagcttcaccggcgttggtcggctccaatctcttcgccgttttattttcctcccaggttaaggttgcaggcttttagcttgggattctgaaagatggggacctcttctggcgcgaatttccatcagcaacctcctccgacccaggggatgttgcctccaaggcatggtccacgcccctcagggttgcagacctcgctctcgctgngcctcttcggagcaggttggctcgcctgacatgcaggagcctggttcaaactcggagccagggcatgattccgccactgagagcgccagttccaaagacacatggccagctgagccgaaccagagcaatgggtggggtggctgcccagtgatggttgtgagtaagggnggcggaaaaaggaggtgggcaaatggtgatcccnnagccgcaggttatccatggacctcctccccgtggnngagtgggatgtttcntggcgggaggtgcacggnnaaaaaggggtttgattctggtcgctgagaagaatggaangatggatgtcggatgagccaccctagaa

SEQ ID NO: 24314 - protein, 113 aa, Zea mays
  misc_feature: Ceres CLONE 1395295-F
  misc_feature (14)..(14): Xaa is any aa, unknown, or other
  misc_feature (82)..(82): Xaa is any aa, unknown, or other
  misc_feature (94)..(94): Xaa is any aa, unknown, or other
  misc_feature (99)..(99): Xaa is any aa, unknown, or other
  misc_feature (105)..(105): Xaa is any aa, unknown, or other
MVHAPQGCRPRSRXASSEQVGSPDMQEPGSNSEPGHDSATESASSKDTWPAEPNQSNGWGGCPVMVVSKGGGKRRWANGDPXAAGYPWTSSPWXSGMFXGGRCTXKKGFDSGR

SEQ ID NO: 24315 - DNA, 707 bp, Zea mays
  misc_feature: Ceres CLONE 1395299-F
  misc_feature: SWISSPROT Homolog: EC 3.2.1.39 Glucan endo-1,3-beta-D-glucosidase
aaagctggagctcaccgcggtggcggccgctctagaactagtggatcccccgggctgcaggaattcgcacgagaccattacctagaacatcctaaaaaaaaaacgggctagcgtgacgaggtcaccggccataaatccccaatctccgcgctttccttccgccccacactcgtccactcaccccctctttgctctgcctcgccgcgccgcagagcagagcatggcgcccccacgccctctcctcgccgccgtcttcctcgccgcggcggttctgctcctcctttctccggcagaggcggggacggtgggcgtgaactacggccgcgtggcgaacaacctgcccacccagcggcggttgtgcagctgctcaagcagcagggcgtcgcgcaggtgaagctgtacgacgccgaccccaccgtgctgcgcgccctcgcgaaaccggcatcaagggtgggtgttggcgctgcccaacgagcaggtcgcggcggcggcgtcgcgcgcgtcctacgcgctgctgtgggtgcgccggaacgtggcggcgtaccacccggccacgcagatccagggcatcgccgtgggcaacgaggtgttcgcgtcggccaagaaagtgacggcgcaactgtccccggccatggccaacgtgcacgccgcgctgggcaggctcgccctcgacgggggccgtcaaagtgtcctcccccatcgcgctt

SEQ ID NO: 24316 - DNA, 692 bp, Zea mays
  misc_feature: Ceres CLONE 1395301-F
  misc_feature: Encodes the peptide sequence at SEQ ID NO. 24317
  misc_feature (468)..(468): n is a, c, t, g, unknown, or other
  misc_feature (479)..(479): n is a, c, t, g, unknown, or other
  misc_feature (621)..(621): n is a, c, t, g, unknown, or other
caaagctggagctccccgcggtggcggccgctctagaactagtggatcccccgggctgcaggaattcgcacgagaccattacctagaacatcctaatcgaaaagtccctgtccctccactcctcccgtcgagcacttggcactgccaatggcggctcccgcccacaccccttcgatgcgcgcaagccaccttctttccccgtgagatcgacgcacctccccctctcgtgcttcattcccgctcgtcgttcgtttcttcggccccgagccgtcgcgcggtcgcctccacatctcgtcgttcttcaaggtctttggcctccgccgttcttggacaggggcacaccactgtccaccggtgcccactacgcgaaatacgagtccctcgtgcggctcctgtagggtggaagagatccatcaggcggtgagtgggaaggggcggttcccacacaaccggaaaggggaagggggncaaatggcggnccgtggcaggcccactctgcacgtggctccgtcgccgcgtgcttatctgcggcatgcgacgctgaagagcacaagcagaagcatttctgcgcaggcgaagccgcgctttgggggcgttgtcatgctcggccagcgccgccgnctcggcgcgccggggtcgcggcttgcgcgctctggaaggactatggctgttgccttacagctgaaagaagg

SEQ ID NO: 24317 - protein, 73 aa, Zea mays
  misc_feature: Ceres CLONE 1395301-F
  misc_feature (3)..(3): Xaa is any aa, unknown, or other
MAXRGRPTLHVAPSPRAYLRHATLKSTSRSISAQAKPRFGGVVMLGQRRRLGAPGSRLARSGRTMAVALQLKE

SEQ ID NO: 24318 - DNA, 685 bp, Zea mays
  misc_feature: Ceres CLONE 1395303-F
  misc_feature: Encodes the peptide sequence at SEQ ID NO. 24319
ccccgcggtggcggccgctctagaactagtggatcccccgggctgcaggaattcgcacgagaccattacctagaacatcctaatcaaaaggcccgcgcctcgctctctcttgtctcgcccgctagctcccatcccagcctcccaccgcgcccgcctgcaccaacctcccccctcccctccccgctccgctccgctccacgcacggcgccagatctgctgctgctgcggcgaccggtggacgccgcgccgcgcgtgccggcgtcggcgacgtgagcggcggatcctgcccggccgtgccatcccggcgacgatgacagcgtaagcgggcggcggacgaccgcgcccccccggcccctactcacgaggtcattggcgcgtgctccttggcagaaaatggcgatgatggtggatccccccaatggcatggcaagtcaaggaaagcattactatactatgtggcagacactgtttgagatcgacaccaagtacgtgtcgatcaagcccatcggaagaggagcttacggaatcgtttgctcatctgttaaccgcgagaccaatgaaaaagccgcgataaaaaagataaacaacgtctttgacaaccgtgtggatgcgctaaggacgctgagagagctgaaactccttcggcaactgaggcacgagaatgttattgctcccagggaataag

SEQ ID NO: 24319 - protein, 96 aa, Zea mays
  misc_feature: Ceres CLONE 1395303-F
  misc_feature: SWISSPROT Homolog: EC 2.7.11.24 Mitogen-activated protein kinase
MAMMVDPPNGMASQGKHYYTMWQTLFEIDTKYVSIKPIGRGAYGIVCSSVNRETNEKAAIKKINNVFDNRVDALRTLRELKLLRQLRHENVIAPRE

SEQ ID NO: 24320 - DNA, 720 bp, Zea mays
  misc_feature: Ceres CLONE 1395305-F
  misc_feature: Translation starting site: 212
  misc_feature: SWISSPROT Homolog: EC 5.5.1.4 Inositol-3-phosphate synthase
  misc_feature (331)..(331): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (423)..(423): n is a, c, t, g, unknown, or other
  misc_feature (468)..(468): n is a, c, t, g, unknown, or other
  misc_feature (476)..(476): n is a, c, t, g, unknown, or other
  misc_feature (481)..(481): n is a, c, t, g, unknown, or other
  misc_feature (482)..(482): n is a, c, t, g, unknown, or other
  misc_feature (500)..(500): n is a, c, t, g, unknown, or other
  misc_feature (687)..(687): n is a, c, t, g, unknown, or other
aaagctggagctccccgcggtggcggccgctctagaactagtggatcccccgggctgcaggaattcgcacgagaccattacctagaacatcctaatcgaaaaacacaacccaaagcagccacagcagcctccttcctcctctcactctcgctcgcgctgcgctcgctacctcgcttcgcattccattcgaaaagaggggaggaaaggcaagatgttcatcgagagcttccgcgtcgagagcccccacgtgcggtacggcccgatggagatcgagtcggagtaccggtacgacacgacggagctggtacacgagggcaaggacggcgcctcnacgctgggtcgtccgccccaagtccgtcaagtacaacttccggaccagaaccgccgtccccaagctcggggtgatgttttgtggnnnntggngaggcaaacaacgggtccacgctggaacggctggggtcattgccnacaagggnagggnngatctcatggggcgaccnaaggacaagggtgcagcaagccaactactacggctccctcacccaggcctccaccatcagagtcggagcaccacggggggaggagatctatgcgccgttcaagagcctccttccctagtgaacccgacgacattggtgttcggaggctgggacattagcaaatgaacctgggcgatcctgaccaggnccaaggtgctggatattgactgagaaagagcta

SEQ ID NO: 24321 - DNA, 709 bp, Zea mays
  misc_feature: Ceres CLONE 1395307-F
  misc_feature: Encodes the peptide sequence at SEQ ID NO. 24322
  misc_feature (481)..(481): n is a, c, t, g, unknown, or other
  misc_feature (482)..(482): n is a, c, t, g, unknown, or other
  misc_feature (533)..(533): n is a, c, t, g, unknown, or other
  misc_feature (536)..(536): n is a, c, t, g, unknown, or other
  misc_feature (622)..(622): n is a, c, t, g, unknown, or other
  misc_feature (625)..(625): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (641)..(641): n is a, c, t, g, unknown, or other
  misc_feature (646)..(646): n is a, c, t, g, unknown, or other
  misc_feature (647)..(647): n is a, c, t, g, unknown, or other
  misc_feature (649)..(649): n is a, c, t, g, unknown, or other
  misc_feature (652)..(652): n is a, c, t, g, unknown, or other
  misc_feature (707)..(707): n is a, c, t, g, unknown, or other
aaagctggagctccccgcggtggcggccgctctagaactagtggatcccccgggctgcaggaattcgcacgagaccattacctagaacatcctaatcgaaaaatcatcacactcgaaacccaacagcttccttcctggcgatccaattaacggcttctcttctgagctcagcacgaacaatggccaccatcctcaccgtcgcaagcttcttcgcacttgtgtgcatctctcaacaagcgcgggctgcgaactacacgttcatgaaggacgcggtgcacgcgccgcggacgggcttctacgactacatcatagtcggcggcggcacggcgggctgcccgctggcggccaccctgtcggcccgcgcgcgggtgctgctgctggagcgcgggggctctccgtacgaggacgcgcgcgtcctgaacatggccactttctcggacgtgctggcggacacggtcggcgtcgtcccggtcgcagcggnntcgtgtcggagggacggcgtgatcaactcccgcccgcgcgtggctgggcgncgncagctgcatcaacgccggcttcttcacgcgcggcggcgcgggctacgtcagggccgccggctggaccccaggggaggtgcgggcgncgnaccgnnngnnnggaangaccnngnccncgttcccgcccgggctgggccccggggcagccgcccgggggaggggcctgcgggnaa

SEQ ID NO: 24322 - protein, 176 aa, Zea mays
  misc_feature: Ceres CLONE 1395307-F
  misc_feature: SWISSPROT Homolog: EC 4.1.2.10 Mandelonitrile lyase
  misc_feature (101)..(101): Xaa is any aa, unknown, or other
  misc_feature (148)..(148): Xaa is any aa, unknown, or other
  misc_feature (149)..(149): Xaa is any aa, unknown, or other
  misc_feature (151)..(151): Xaa is any aa, unknown, or other
  misc_feature (152)..(152): Xaa is any aa, unknown, or other
  misc_feature (153)..(153): Xaa is any aa, unknown, or other
  misc_feature (154)..(154): Xaa is any aa, unknown, or other
  misc_feature (156)..(156): Xaa is any aa, unknown, or other
  misc_feature (157)..(157): Xaa is any aa, unknown, or other
  misc_feature (158)..(158): Xaa is any aa, unknown, or other
MATILTVASFFALVCISQQARAANYTFMKDAVHAPRTGFYDYIIVGGGTAGCPLAATLSARARVLLLERGGSPYEDARVLNMATFSDVLADTVGVVPVAAXSCRRDGVINSRPRVAGRRQLHQRRLLHARRRGLRQGRRLDPRGGAGXXPXXXXDXXXVPARAGPRGSRPGEGPAG

SEQ ID NO: 24323 - DNA, 717 bp, Zea mays
  misc_feature: Ceres CLONE 1395308-F
  misc_feature: Translation starting site: 261
  misc_feature (442)..(442): n is a, c, t, g, unknown, or other
  misc_feature (584)..(584): n is a, c, t, g, unknown, or other
  misc_feature (634)..(634): n is a, c, t, g, unknown, or other
  misc_feature (667)..(667): n is a, c, t, g, unknown, or other
  misc_feature (669)..(669): n is a, c, t, g, unknown, or other
aaagctggagctccccgcggtggcggccgctctagaactagtggatcccccgggctgcaggaattcgcacgagaccattacctagaacatcctaatcgaaaaaccgcatcgcctcgccgctgttccccgcaacctatcgacccaatctcgtccgacccggcgcgtcgtcccctccagatctccgtcgccctctccaggtagcagaaactgttctgctgcattctgacaaagtggagggcttaggagcttctgcttcttttatgtctgaacaatctttgctttatttgggattgttgggagagtactctcgtgcaactaggaaaaggcacaaggttccgtcccactgcatgcgtcaagagactgtctggttttcttgttctgatttgtcatttgctggtggctcaaagccggcttggtttcctcgaaggatcagcatctactncttgattgtggactttgtcgcatctgatatcaacttcataaatctttatccaagatggcgctgcaaaacattggtgcttcaaacagggatgatgccttctacaggtacaagatgcccagaatgattaccaagatagaagggncgtggtaatgggtatcaagacaaatgtttgtgaacatgttgacatagcanaagcacttgccaggccagcttctacacaacagntnactttgggatgtgagcttggtgcacagtcccaatttgatgagaaagaa

SEQ ID NO: 24324 - DNA, 790 bp, Zea mays
  misc_feature: Ceres CLONE 1395309-F
  misc_feature: Encodes the peptide sequence at SEQ ID NO. 24325
tttgccctcccccccctaatcttattatgcccgccccgtcccccgtcaccaaagctggggctccccgcggtggcggccgctctccaactagtggatcccccggcctgcaggatttcgcacgagaccattacctagaacatcctactcaaaacactcgggttggttagacgaacccaatgcaagggcgggcgaggtgacggcccggcggacgcgctcgcctctcctctcctctcctctcctcttcttccgactctccctctccgcatgccattccaacgcattaccggtatttttagccgccggaggagacgaccagctgcgcagccactagcgagagagagagggaggcgagaaaccatagctcctggccgtgctgactgcccatccaccgcggcgccgcccgtacgactcccgtccggatccctcctcctctcctgcaaggtccctgtgcgtacccgcgcccgctcggagcgtcgagccggagccggagaagatgacgggggggttgctccccaggccccccccgatgggctctctggctatgcctattctgcctacgaatgctacaagatggttgaaatgcaaacccccccagaaccgctaatctcaatcccctcggtgtccgcactttgatctttagatggatcctgtagacaagctttaggacgagtttccccagactttcaccattgtcactgcctttagcggttcaccctccggacggctacttcctcgccgctccctccgcggcaattagccgcgggcgctttaagcccaagccgccaccccg

SEQ ID NO: 24325 - protein, 36 aa, Zea mays
  misc_feature: Ceres CLONE 1395309-F
MTGGLLPRPPPMGSLAMPILPTNATRWLKCKPPQNR

SEQ ID NO: 24326 - DNA, 718 bp, Zea mays
  misc_feature: Ceres CLONE 1395310-F
  misc_feature: Encodes the peptide sequence at SEQ ID NO. 24327
  misc_feature (299)..(299): n is a, c, t, g, unknown, or other
  misc_feature (300)..(300): n is a, c, t, g, unknown, or other
  misc_feature (320)..(320): n is a, c, t, g, unknown, or other
  misc_feature (621)..(621): n is a, c, t, g, unknown, or other
  misc_feature (635)..(635): n is a, c, t, g, unknown, or other
  misc_feature (638)..(638): n is a, c, t, g, unknown, or other
  misc_feature (645)..(645): n is a, c, t, g, unknown, or other
  misc_feature (648)..(648): n is a, c, t, g, unknown, or other
  misc_feature (659)..(659): n is a, c, t, g, unknown, or other
  misc_feature (690)..(690): n is a, c, t, g, unknown, or other
  misc_feature (709)..(709): n is a, c, t, g, unknown, or other
aaagctggagctccccgcggtggcggccgctctagaactagtggatcccccgggctgcaggaattcgcacgagaccattacctagaacatcctaaaaaaaacataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacacacnntcaatcgtgggcggcggcancggccgggtgcccgctggccgccacgctgtcggagcgcttccgcgtgctgctgctggagcgcggcgcctcgccctacgacgacgaccgcatcggggacatggcccgcttcgcggacacgctgtcggacaccttcccgggctcgcccgcgcagcgccttcgtgtcgggaggacggcgtcatcaactcgcgcccgcgggtgctggggcggcggcagctgcatcaacgccggcttctacacgcgggccagcgacgactacgtgcgggggcggtcgggtgggaacctggggcgccgccggggcgncgtaccggttgggnggnaggaacntgntggccgttccngccggagctggggcccctgggcggccgggcntgccgggcggccctgctcnggggccggt

SEQ ID NO: 24327 - protein, 100 aa, Zea mays
  misc_feature: Ceres CLONE 1395310-F
  misc_feature (68)..(68): Xaa is any aa, unknown, or other
  misc_feature (73)..(73): Xaa is any aa, unknown, or other
  misc_feature (74)..(74): Xaa is any aa, unknown, or other
  misc_feature (76)..(76): Xaa is any aa, unknown, or other
  misc_feature (77)..(77): Xaa is any aa, unknown, or other
  misc_feature (81)..(81): Xaa is any aa, unknown, or other
  misc_feature (91)..(91): Xaa is any aa, unknown, or other
MARFADTLSDTFPGSPAQRLRVGRTASSTRARGCWGGGSCINAGFYTRASDDYVRGRSGGNLGRRRGXVPVGXXEXXGRSXRSWGPWAAGXAGRPCSGAG

SEQ ID NO: 24328 - DNA, 709 bp, Zea mays
  misc_feature: Ceres CLONE 1395313-F
  misc_feature: Encodes the peptide sequence at SEQ ID NO. 24329
  misc_feature (499)..(499): n is a, c, t, g, unknown, or other
aaagctggagctccccgcggtggcggccgctctagaactagtggatcccccgggctgcaggaattcgcacgagaccattacctagaacatcctaatcgaaaaatccaacgacccacactgagacgtcccctccccgctccgtcctctctcctctgccgccgagacgacgcgatggcggggtccgccgccttgccgccgctcgccgccttcgcgtcgctccttaccgcgcggcgcttcgccgccgccaggtccgcgctccggtccctgctcacgccgcgcctactggcggtgccgttcgcggacctcgccgcctcgtcgctcccgcgcggcgcgccgccgcacgccgtggtggcgttccacgacatgctcttccgcgcgtacgcggacgctgggcgcggcgtgccgcgcggccgaggcgctcgacgccgccgtgtcccgcctcggcagcctcgacccgcgctcgctcacgttctcgctgctctcgctccgccgcgccggncgcctcggagacgccgcgggtcttctggagcgggcgctcggctcgtgcccggactccgtctcgacgtgcgtcgcgtatgccgtctgaacgaccctctgtatgatggatgggggtgtacaactccccttggagtggtgggtgatataacctggctttgagttgcctttggattggggtttggatacaaatggtttgcattggctgtgacca

SEQ ID NO: 24329 - protein, 161 aa, Zea mays
  misc_feature: Ceres CLONE 1395313-F
  misc_feature (110)..(110): Xaa is any aa, unknown, or other
MAGSAALPPLAAFASLLTARRFAAARSALRSLLTPRLLAVPFADLAASSLPRGAPPHAVVAFHDMLFRAYADAGRGVPRGRGARRRRVPPRQPRPALAHVLAALAPPRRXPRRRRGSSGAGARLVPGLRLDVRRVCRLNDPLYDGWGCTTPLGVVGDITWL

SEQ ID NO: 24330 - DNA, 721 bp, Zea mays
  misc_feature: Ceres CLONE 1395314-F
  misc_feature: Encodes the peptide sequence at SEQ ID NO. 24331
  misc_feature (341)..(341): n is a, c, t, g, unknown, or other
  misc_feature (504)..(504): n is a, c, t, g, unknown, or other
aaagctggagctccccgcggtggcggccgctctagaactagtggatcccccgggctgcaggaattcgcacgagaccattacctagaacatcctaatcgaaaaaaccccaccagaccttcaaccgctacatttccgtcactaccggagccgccactccgacgaacgcgggcggcggagcggaagcgaaccagagcaccggtaaaaagaaaaggatgaggcttgggagtataaacggcttgcggttcacgcagcttaaacttgtcatccttgcgttcttcatgttgtttgttctctggaaatgggagaagggctcgtcatactacgattccgaaatcctccangccagatccgttggttctgactcatccagctaactcgaagtttgtagaccagcatacatccccagaagaagactttccaagtgcagatcgatcacaccggtcagtaggtaaagtagaaaagccggttactagtgcgctgccaccattgtctacgataggctanttctgttgatgttgcagatggggaatgaagtgccacctcctgagaagaaagaatggagtacgggaatggggaagttgggtttctgacaatcgtagacactatactccggggttttggttgtaagcaatggctttccagagaggtgggcctgcagactaacccagcgaaaagatttcgcgtatgaaaaattcagatggcagcctgaagcttgggagag

SEQ ID NO: 24331 - protein, 53 aa, Zea mays
  misc_feature: Ceres CLONE 1395314-F
  misc_feature (43)..(43): Xaa is any aa, unknown, or other
MRLGSINGLRFTQLKLVILAFFMLFVLWKWEKGSSYYDSEILXARSVGSDSSS

SEQ ID NO: 24332 - DNA, 704 bp, Zea mays
  misc_feature: Ceres CLONE 1395318-F
  misc_feature: Translation starting site: 206
  misc_feature: SWISSPROT Homolog: EC 2.4.1.115 Anthocyanidin 3-O-glucosyltransferase
  misc_feature (459)..(459): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (566)..(566): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
caaagctggagctccccgcggtggcggccgctctagaactagtggatcccccgggctgcaggaattcgcacgagaccattacctagaacatcctaatcgaaaaaggttcttgtcgactttacatatcttctctgatagccttcgtagtgaagagtaggatgagccaccctcctccacggcgttcctgcaggcatccctcatctccatggccttctccctcgccttcctcccttcctcgccaccgcccatcagctccttcaccgctcgctccagctccgaggcctccacgaaattgttcctcttcctgtccaccttcatcgccacggcgacgcctacataggccaccagcgtgaacgcgttcaggtgctgctcggcgtacagcggccacggtgccatcggcaccccgaaccacaggctctcgagcaccgagttccagccgccgtgtgtcacgaaacaccnaacggcggcgtgggctagtatctctttctgcggcgccttcgtcggccacaccaggcctctgcccttggtcctttcgaggaatccatcgggagannnntcggaaagtncgnnnnccccaacggtgcgccttttccggggggtggccggtgccccgcgagcacaaaaaaaagaaagcggtgcccgctacgctccaggccggcgggcgatccctcgtgcgctgggggggcgccgcgggagaacccttg

SEQ ID NO: 24333 - DNA, 740 bp, Zea mays
  misc_feature: Ceres CLONE 1395321-F
  misc_feature: Encodes the peptide sequence at SEQ ID NO. 24334
  misc_feature (383)..(383): n is a, c, t, g, unknown, or other
  misc_feature (426)..(426): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (437)..(437): n is a, c, t, g, unknown, or other
  misc_feature (438)..(438): n is a, c, t, g, unknown, or other
  misc_feature (456)..(456): n is a, c, t, g, unknown, or other
  misc_feature (471)..(471): n is a, c, t, g, unknown, or other
  misc_feature (501)..(501): n is a, c, t, g, unknown, or other
  misc_feature (514)..(514): n is a, c, t, g, unknown, or other
  misc_feature (524)..(524): n is a, c, t, g, unknown, or other
  misc_feature (560)..(560): n is a, c, t, g, unknown, or other
  misc_feature (632)..(632): n is a, c, t, g, unknown, or other
aaagctggagctccccgcggtggcggccgctctagaactagtggatcccccgggctgcaggaattcgcacgagaccattacctagaacatcctaatcgaaaaatattctcccaaaaaacccaacactccagtggcggcaaagacctaacatttcaaaatcaatggccaagaaccccaaggcgcccgacacccgcagtggccgttctcccaccagaaggccccgaccacgccgcgccaaggcggtgccagaagcctcctccgcagctgatatcgaagacctggctccctcagtgcctggggccgctgcccctggcgctgccgcacccacggccctgcgcgcacagcttgctccggtggtatgacgcgcaccgtagggacctgcncgtggcgatgcgtaagcggcagcgaggaaagagaggcgtacgngnnnnngtggnntgtcccgaggtgatgctngcagcagacgcgggntggccccgtgggtcgtcgcttactacgaancgggggaatgggncggcggtggnccgaaccgtacgaagccctcgccggcgctacgcaanggaggaggtgaacgagaagggtggggcggggtcttggctactaccgtaagggctcgattttctgctggaggnagcaaagcaatcatcgcaaaaagggggttgtttccttgcacggcgttagccccttcgggagggtctgggaattggggattacacagctggagcatcgcttcatggctt

SEQ ID NO: 24334 - protein, 66 aa, Zea mays
  misc_feature: Ceres CLONE 1395321-F
MAKNPKAPDTRSGRSPTRRPRPRRAKAVPEASSAADIEDLAPSVPGAAAPGAAAPTALRAQLAPVV

SEQ ID NO: 24335 - DNA, 712 bp, Zea mays
  misc_feature: Ceres CLONE 1395323-F
  misc_feature: Encodes the peptide sequence at SEQ ID NO. 24336
  misc_feature (507)..(507): n is a, c, t, g, unknown, or other
  misc_feature (559)..(559): n is a, c, t, g, unknown, or other
  misc_feature (631)..(631): n is a, c, t, g, unknown, or other
  misc_feature (648)..(648): n is a, c, t, g, unknown, or other
  misc_feature (649)..(649): n is a, c, t, g, unknown, or other
aaagctggagctccccgcggtggcggccgctctagaactagtggatcccccgggctgcaggaattcgcacgagaccattacctagaacatcctaatcgaaaaattttttcgactttcgagcgcagaaacgagagggccggagcagccgcagtcccggcgatcccgccgccggtcgccctcatacttcctcgtcactgccttcgtttctctttccaacaatcaagatgagccgtggcggtagcgcgggtggtggtcaaagttctctgggttatctctttggaagcggtgagccccccaaaccagcagtggcaccagctgtaagtgctccacctgctactgcaggtgctccacctgctgagaaaccacctgctgcaaagcctgatggcaccagtcagattgctgctggggttaccagccaaaccaataactaccacagggccgacggtcagaacaccggaaacttccttacggaccgtccttcgaccaaggtcccacgctgctcctggncgtggctcttcctgggataccctgtttggtgggcactgatgccgctcacaangctatcaccccccactgtcgccgcatgctttttctgatcgtgaacagccgttgtcatttcatgtgtaccaanctcccggtccgcgtggnnccgtagctggccctagattcaggggctaatcgtgtgctgaactcaatcaaaagcgctctgccc

SEQ ID NO: 24336 - protein, 123 aa, Zea mays
  misc_feature: Ceres CLONE 1395323-F
  misc_feature (95)..(95): Xaa is any aa, unknown, or other
  misc_feature (112)..(112): Xaa is any aa, unknown, or other
MSRGGSAGGGQSSLGYLFGSGEPPKPAVAPAVSAPPATAGAPPAEKPPAAKPDGTSQIAAGVTSQTNNYHRADGQNTGNFLTDRPSTKVPRCSWXWLFLGYPVWWALMPLTXLSPPTVAACFF

SEQ ID NO: 24337 - DNA, 693 bp, Zea mays
  misc_feature: Ceres CLONE 1395324-F
  misc_feature: Encodes the peptide sequence at SEQ ID NO. 24338
  misc_feature (401)..(401): n is a, c, t, g, unknown, or other
aaagctggagctccccgcggtggcggccgctctagaactagtggatcccccgggctgcaggaattcgcacgagaccattacctagaacatcctaatcgaaaactctattagaatagccaggggcctcgctcctctccaccacgtactccactccatccatccatcatcgtctatccatgaagagcttgcaggaggagagggcggcgttggtgccgtcgccgtggccccagcaacagagaaaggacggcggcgagcatgatccggagcagctgatggatgaggatgacggtgacgatgaggaggatctgcaggatgagcagcacacaagaacaattaggacgtcgaccaagacggcggaagcatcgtcatcagcggagcggcgggtggccggcgtggtgganggcggcggcgggcgcagaagctgtgccccaccaagaggtgttggcctggtcatcgccggtctcctcgtgctggtcttggctcgtcgtcgtcggcggcggcggcaacacccagtcgtcgtcgctggatccacctcgacaatgcatcgtcgtttctgctaggcagcggcggcggcggcggcttggagcagcatcaatggcctcctcaccacgtcccttcacccgcagcggacctcgtgcccatacccttcagctgcggcggcacgggctcggattgtccccgtcgtcaaccgcc

SEQ ID NO: 24338 - protein, 127 aa, Zea mays
  misc_feature: Ceres CLONE 1395324-F
  misc_feature (75)..(75): Xaa is any aa, unknown, or other
MKSLQEERAALVPSPWPQQQRKDGGEHDPEQLMDEDDGDDEEDLQDEQHTRTIRTSTKTAEASSSAERRVAGVVXGGGGRRSCAPPRGVGLVIAGLLVLVLARRRRRRRQHPVVVAGSTSTMHRRFC

SEQ ID NO: 24339 - DNA, 720 bp, Zea mays
  misc_feature: Ceres CLONE 1395325-F
  misc_feature: Encodes the peptide sequence at SEQ ID NO. 24340
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (421)..(421): n is a, c, t, g, unknown, or other
  misc_feature (509)..(509): n is a, c, t, g, unknown, or other
  misc_feature (540)..(540): n is a, c, t, g, unknown, or other
aaagctggagctccccgcggtggcggccgctctagaactagtggatcccccgggctgcaggaattcgcacgagaccattacctagaacatcctaatcgaaaagaagacgcttcccgagcttctccttcgttcctcctcttccccgcggctctcctctgccccgcaccggcaccgctagggttttgccgccgacctctcgctcgcttccgggctccgcgaggcaaccgtccggaccggccggtcgaaatggtggatggtggaggaggtcgggaacaagatgcaatcgcagatgcgcctgcacgcggagccggatgacgccgccgccgacctccccctcccggcgctcttcgacagggcgtcgcggcttcacgccctggcctccagctccgccctcgaaccaggatgggatnnncgcaccggngttgagctgctgcggcgctgcgacgagatgggcggcaggctcggtcttttctcccccaacgagagcaaggacgacgtctccaccgcanacctcaagtacctactcgtcccatattaccnttgcggaaatgaccgagaagatggcgcaggagggatcggatcccggttcttaaggcgtcgcagaaccatttgaaggagttcattgctctatgcgaagtactagagcttattccagaggatgagctagaattgtctaggcagaagcagtctgatactatggcaacagaagagcacagaagg

SEQ ID NO: 24340 - protein, 119 aa, Zea mays
  misc_feature: Ceres CLONE 1395325-F
  misc_feature (53)..(53): Xaa is any aa, unknown, or other
  misc_feature (86)..(86): Xaa is any aa, unknown, or other
  misc_feature (96)..(96): Xaa is any aa, unknown, or other
MVEEVGNKMQSQMRLHAEPDDAAADLPLPALFDRASRLHALASSSALEPGWDXRTGVELLRRCDEMGGRLGLFSPNESKDDVSTAXLKYLLVPYYXCGNDREDGAGGIGSRFLRRRRTI

SEQ ID NO: 24341 - DNA, 709 bp, Zea mays
  misc_feature: Ceres CLONE 1395329-F
  misc_feature: Translation starting site: 258
  misc_feature (626)..(626): n is a, c, t, g, unknown, or other
  misc_feature (638)..(638): n is a, c, t, g, unknown, or other
aaagctggagctccccgcggtggcggccgctctagaactagtggatcccccgggctgcaggaattcgcacgagaccattacctagaacatcctaatcgaaaaagtcatctcgtctcaggttgcggccgaaccagagccccgtcccaactccaccacctctcttctctacggcgcgagcaagggcggcgccggccgcggcgtcggcgggaaccgggcctcgctctccccatctctccgatcacttctgtcctgtgaaaatggcggatgaactacgctcaacgtctgtgggtcagaagttccatgggcagtccgtgctgttgagcagaatctcttcctattccgccatgaacaaccctgtattcaacaatgcctattctgcttacaatgtgccccagaggtcatatcatgggatgaatgcaactgctggactctcatctgtcatggcaccatctcctgtctttgcttctgccccaaaagagaaaggcttttctggatttatgatcgactttatgatggggtggagtttctgctgctgtctccaagacagctgcagctccgattgagcgtgtcaagcttttgattcagaaccaggatggaaatgctcaagactggcaggctttctgaancggacaaggggnattggggactgctttggcggaatccaaaaaaggggggtttggttccgggggggaggaaacccggtatgggt

SEQ ID NO: 24342 - DNA, 804 bp, Zea mays
  misc_feature: Ceres CLONE 1395333-F
  misc_feature: Encodes the peptide sequence at SEQ ID NO. 24343
ggggaggccgcccctctgtaccggcttagcgggccgcgtctgtaaatcatttaaaaatgagagtccccgcggggggggccgctctagaactaggggatcccccgggctgcgggagattcgcacgagaccattacctataacatcctaatcgaaaaggttttccggatctcgcctcccgaggcacagacgctgccggcgtgagccgcggcccacaaggctaagcacccaccatggccttgggagctctcgtcacgcccaggctgggcagctccggccgcgacccttgcatctgccgttgcccagggagccgttgcccagcggatagcatctcctctgctctccaggatgggagtgatagatcgtctgcttcagcacaaagccagccgcagcagatgtcatcggtatcgaggtagggactaggaattccggcgtctccgtcatgggaaggggagacaccgcgggtgagcgagaacgcagaagatcgcgaggacgactccctccattgttgccagagaatgagaatggtgacctggtgggactcgcatcacagcggaggccggaggggggacccgggtgggcccgaacggcaatcgcctcggggcgcaggcggcgtgatcggaagggctgtttggtgggccgtcggttcccggaagggaggatgcccacaggggccctgtagaaaggttggccgagggccccgaaatggggtgatgggcggggaccagatgatggtacgcgcaagaggaggtgtgcgcacttagtgtggaattgggcggcgcgctggctcttatccgcaaacgctgc

SEQ ID NO: 24343 - protein, 79 aa, Zea mays
  misc_feature: Ceres CLONE 1395333-F
MGRGDTAGERERRRSRGRLPPLLPENENGDLVGLASQRRPEGGPGWARTAIASGRRRRDRKGCLVGRRFPEGRMPTGAL

SEQ ID NO: 24344 - DNA, 1129 bp, Zea mays
  misc_feature: Ceres CLONE 1395335-R
  misc_feature (986)..(986): n is a, c, t, g, unknown, or other
gttgtgagaattgggtaccgggccccccctcgaggtcgaaggtatcgataagcttttttttttttttttttgctttcagtgtgtcgacattcaaattgggcctagatcatcaaggccgcttttagaatcaactcgtgccaacagtgtctccagctcgatttagcaaatgggcattgacttccacaaatccagatatcttactgctagcacatcacgtgcagacatcaattttttttttcttggctgtgagcaagcaaagataggagcacaccatcaattctaacaaagattaacactagctgcacagcatacaatgggagattaacacaaatgcagatacgtggaatgtaacgatcatatacagggtcccagggagtacaagttccataccaagtcatcgctgaaaggaagcatcagtcctttcccccactttgattatgggaagtttgaaggaggggcggtccaaatgctgcagcctgcttagaacctaaatactcgcttggagggacacttaaggtgaaagatacaaaatccccaacgcaagctctcttttggggagacgttctcccgggaagaatataaaaaaatagtcaggagtcccctccggcatactggggggggggggcaagaccttgaccgattaaaagcagcctcgggagctgtgttttgatcctagactccttactaaccacattattagaagtacatctcccaacaaggggtggtcaaagagatgcatattatggtggtccttctaggaggtgggctactgagataatgattattctcttccgatatattcggaggaatcttagggcgcacggcgctctattaagaaaagtggcctaggatccataaatgagaacaagtatcaaaagagaccgctcgcgctccgtgtcggaaatttcgataacaccaaaaatatagtcctctgtctcatgattctaattctcgcaacttatactctggtgttgcgtagctgactnatgaaatcatgcgcttgttcgcgccactactatatagaattcagtgagaggtagcagtgacattcgtacatattgaatatatactacggctaccgctgggtggtcgggtttataaatagagaagaatgcggcgtgagggcgtg

SEQ ID NO: 24345 - DNA, 711 bp, Zea mays
  misc_feature: Ceres CLONE 1395335-F
  misc_feature (642)..(642): n is a, c, t, g, unknown, or other
aaagctggagctccccgcggtggcggccgctctagaactagaggatcccccggcctgcacgaattcgcacgagaccattacctataacatcctaatcgaaaataaatcatgcattttttgtggataatcttaattttctcttcaggcgacgatgcttttggagcctcgacaatgacgggattgctgaactcaaaccttaataggtaggcatcaaagctttcagactcacttggaaccacatttaccgcatccttttcggcccaatctggagcaattccagttgctcatcactctgactcgttcaacactgatggaagttacaatcttccgagaatgcctggatcgacttgctacaggggaatgctgccatgagtgatcttccggactctgcgtttcaacaagctgtaggtaccattcctgatggagtccgttgaagcaagcttctagctggcatgcctcagatatctcatgtacatgcaggtgaaagaggcagaggaatgacctttggacctggtgctgccattgaatatcagcatgcttactcgaggtaacatccaagatgcatgcatggacgatgattccgcgggtactaccgactctactcatgaaatggctgtatgtgcgactagcggatagtcgggncccctcataggtactggcgaaatatggccaggcatccgataatggcatatgatcatacctggacgtatg

SEQ ID NO: 24346 - DNA, 725 bp, Zea mays
  misc_feature: Ceres CLONE 1395337-F
  misc_feature: Encodes the peptide sequence at SEQ ID NO. 24347
  misc_feature (333)..(333): n is a, c, t, g, unknown, or other
  misc_feature (413)..(413): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (657)..(657): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
aaagctggagctccccgcggtggcggccgctctagaactagtggatcccccgggctgcaggaattcgcacgagaccattacctagaacatcctaaaaaaaaagcagtccaaacacgcaacgcaacactcgccttcccctcccaaccctccgaaccgaagcagcaaagctagacgatgacgctgacgatcccggacgaggtgcgcgccaaggcggaggtgtacgtgggcgacgcggcggggcaggagaagacgcggctgctcctccaggagacgggcctcccgagcgggctgctcccgctgcgggacatcatcgagtggcggctacgtggaggnagacgggcttcgtgtggctccggcagcggccgcaaggtggaccactacttcgccaaggccggccgccacgtgcctacggncgccgaggttggtcggcggtggccggacaagggccggctcaagaagatcacgggcgtcaaggccaaggagatggctgctgtgggtcaccctccacgagatctgcgtcgacgacccgcccactggtaagctccactgcaaggccatcggcggcctgtcccgcagcttccccgtcgaggccttcgaggccgaggagccggcgcgcccggaacccggcggtgtcgtcccagggacgggaggannnanggaaggannnnnnnnnnnnnnnnnnnnnnnnnnnnnnnnnnnnnnnnnnnnnnnnnnnnnnnnnnnng

SEQ ID NO: 24347 - protein, 121 aa, Zea mays
  misc_feature: Ceres CLONE 1395337-F
  misc_feature (80)..(80): Xaa is any aa, unknown, or other
MTLTIPDEVRAKAEVYVGDAAGQEKTRLLLQETGLPSGLLPLRDIIEWRLRGGRRASCGSGSGRKVDHYFAKAGRHVPTXAEVGRRWPDKGRLKKITGVKAKEMAAVGHPPRDLRRRPAHW

SEQ ID NO: 24348 - DNA, 715 bp, Zea mays
  misc_feature: Ceres CLONE 1395338-F
  misc_feature (282)..(282): n is a, c, t, g, unknown, or other
  misc_feature (287)..(287): n is a, c, t, g, unknown, or other
  misc_feature (288)..(288): n is a, c, t, g, unknown, or other
  misc_feature (291)..(291): n is a, c, t, g, unknown, or other
  misc_feature (360)..(360): n is a, c, t, g, unknown, or other
  misc_feature (672)..(672): n is a, c, t, g, unknown, or other
  misc_feature (673)..(673): n is a, c, t, g, unknown, or other
acagctggagctccccgcggtggcggccgctctagaactagtggatcccccgggctgcaggaattcgcacgagaccattacctagaacatcctaatcgaaaagaacacatacctaattatcacctgtaagccagctgaaccacatctcgtcgtgcacatccggagcccgggaacacacacacacattgccatggccatgcccatgcccaagcccgtcctgagcctgctcgtgcacctacacgccgccgtcctgttccttcccgccccggccggcggcgcggnctacnncgntctgcgctacggcgcgcgccccgacggcgtgccggccgcggcggggcccttcctccgcgcgtgggcggncgcctgccgctcgccccttccgcgcgccgtggtcgtgccgcccgggttctccctggtgccccccgctcccttccccgcccccgtggcccgtccgccccgcgccgtccgccgtctccccccccgccgtttgcccgctcgtcctcccccccctccggctcccccgccccgtcgcctctgtttctcctcccttgcgtccccccgctcccccggccccccccccctcccctgtccccccccgtcccccttggccccccccccccccgccttccctgtcccctgttcttcccccccccccccttgccctctcctctnntttccgttctttcccctcttctcttttcccccccctccccct

SEQ ID NO: 24349 - DNA, 700 bp, Zea mays
  misc_feature: Ceres CLONE 1395339-F
  misc_feature: Encodes the peptide sequence at SEQ ID NO. 24350
aaagctggagctccccgcggtggcggccgctctagtactagtggatcccccgggctgcaggaattcgcacgagaccattacctagaacatcctaatcgaaaaagccagcaggacaccactcatcttcttctcccccgcctcgtttccatcgccaccaccctcttctcctgcggtcctcccccgtcccactcccacccccctcgcctccgcctccactgcagctgccgccatgcagagcctcctcctgcccaccgctgccgtggccccggtggcgcctccgtgcggaaggcggaatctcccgggacgcctctccgtccgcgcctccgcgacggtggtagcggcaccgcggcgggagacggatcccaagaagcgggtggtgatcacggggatggggctggtctccgttttcgggaacgatgtagacgcttactacgaccgcctgctagtcggggagagcggcatcgggcccatcgaccgcttcgacgcttctaagttccccacccgctttgccggtcaaatccgggggcttctcctccgagggatacatcgacggaaagaacgaccgccgcctcgatgattggctccgatactggatccttagtggcaagaagggtctcgaaggctccggtattggccccggcctccccgcccctggaaaaaattgacaaagaccggccccatgtgtttggcgccatggcaa

SEQ ID NO: 24350 - protein, 115 aa, Zea mays
  misc_feature: Ceres CLONE 1395339-F
  misc_feature: SWISSPROT Homolog: EC 2.3.1.41 Beta-ketoacyl-acyl-carrier-protein synthase I
MQSLLLPTAAVAPVAPPCGRRNLPGRLSVRASATVVAAPRRETDPKKRVVITGMGLVSVFGNDVDAYYDRLLVGESGIGPIDRFDASKFPTRFAGQIRGLLLRGIHRRKERPPPR

SEQ ID NO: 24351 - DNA, 708 bp, Zea mays
  misc_feature: Ceres CLONE 1395341-F
  misc_feature: Encodes the peptide sequence at SEQ ID NO. 24352
  misc_feature (456)..(456): n is a, c, t, g, unknown, or other
  misc_feature (490)..(490): n is a, c, t, g, unknown, or other
  misc_feature (546)..(546): n is a, c, t, g, unknown, or other
aaagctggagctccccgcggtggcggccgctctagaactagtggatcccccgggctgcaggaattcgcacgagaccattacctaacatcctaatcgaaaactcctccacgcgaatccgcatctccagactccaaccagcgctcgtccctccccgttctttcctcctcccttcagccatcgcagtcgcagcgcaggttcttggctggttgctggtgtcgacagcaaagtccgcaactccaatcctgcctgcgctcctcccgtcctcactcagcacccgcgcacgccgcctgcctgtcgattgagatctctttcacgcccctttctgccatcgcacaactgagccgcagctagtaacatccattttgctggtcaataagtcgtgggaggaagaagatggattatttgaaggtgcaggtggtagagtcatcatttgtagtggcgagcgagccgacgccnacgaaggcgctctggctctcttgctgaacatggntcagtccaacaaagccacaccccaacgatccactgtacagctccacgatgctgcgncggctgattttttcgacctgggcagactcaggaagctacggcaaagggcctgggtgccttctaccccctccgcgaacgctcgtaaaagggacaatggtaggaaagaaatcccttgaacgcaaaggggactctttggtgccctcccggggggggggattccca

SEQ ID NO: 24352 - protein, 29 aa, Zea mays
  misc_feature: Ceres CLONE 1395341-F
MDYLKVQVVESSFVVASEPTPTKALWLSC

SEQ ID NO: 24353 - DNA, 710 bp, Zea mays
  misc_feature: Ceres CLONE 1395342-F
  misc_feature: Encodes the peptide sequence at SEQ ID NO. 24354
  misc_feature (586)..(586): n is a, c, t, g, unknown, or other
  misc_feature (587)..(587): n is a, c, t, g, unknown, or other
  misc_feature (598)..(598): n is a, c, t, g, unknown, or other
  misc_feature (599)..(599): n is a, c, t, g, unknown, or other
  misc_feature (631)..(631): n is a, c, t, g, unknown, or other
  misc_feature (666)..(666): n is a, c, t, g, unknown, or other
  misc_feature (710)..(710): n is a, c, t, g, unknown, or other
aaagctggagctccccgcggtggcggccgctctagaactagtggatcccccgggctgcaggaattcgcacgagaccatttcctagaacatcctaatcgaaaactactgtagccgctgctgctcctctcctcccatctcaccacacaccgcagccccagcaagatcgcgcggaggccatggcgaagcccaagccttcctccgccggcgccaagccgaccgcggctgcgccaccggttacagtgcactcggcgctggtcacctacacctccatgctcgcgctcctctccctctgcccgcccttcgtcatcctcctgtggtacacgatggtgcacgcggacggatcggtggtgcggacttacgagcacctcagggatcacggcgtgctcgaggggctcaaggccatctggcccatgcccaccctcgtcgcgtggaagatcatcttcggcttcgggctcttcgaggccgtcctacagctgctgctccctgggaagcgcttcgaagggcccatctcgcctgccgggaacgtgccggtctacaaggcaaatggcttacaagcatatgcagtgaccttgaaacttaccttggnnttgggggtggnntcgggtatattaaccctgcaatagtgtatgantcacttgggggagaatactctggctctgttttggnaagctttggggttctgtatttttctctacataaggggccatgan

SEQ ID NO: 24354 - protein, 148 aa, Zea mays
  misc_feature: Ceres CLONE 1395342-F
  misc_feature: SWISSPROT Homolog: EC 1.3.1.21 7-dehydrocholesterol reductase
  misc_feature (137)..(137): Xaa is any aa, unknown, or other
  misc_feature (141)..(141): Xaa is any aa, unknown, or other
MAKPKPSSAGAKPTAAAPPVTVHSALVTYTSMLALLSLCPPFVILLWYTMVHADGSVVRTYEHLRDHGVLEGLKAIWPMPTLVAWKIIFGFGLFEAVLQLLLPGKRFEGPISPAGNVPVYKANGLQAYAVTLKLTLXLGVXSGILTLQ

SEQ ID NO: 24355 - DNA, 738 bp, Zea mays
  misc_feature: Ceres CLONE 1395344-F
acagctggagctccccgcggtggcggccgctctataactagtggatcccccgggctgcaggaattcgcacgagaccattacctagaacatcctaaaaaaaaatctgaagcaaaatgtaccgggaatgttgaagagcgggactcttaagcagtagtgagatgcggcggtgttgatccatcgcagtcgcagcgcaggttcttggctggttgctggtgtcgacagcgaagtccgcaactccaatcctgcctgcgctcctcccgtcctcactcagcacccgcgcacgccgcctgcctgtcgattgagatctctttcacgcccctttctgccatcgcacaactgagccgcagctagtaacatccattttgctggtcaataagtcgtgtgacggaaaaaatgtatctattgcacttgtaggcccccccggcggccctcctctggcccgcagtgggcgcttccccccacccccggggccgcgtcccttgcttgcccgtggtccgccgccacgttttccctctcccctgcctcccccccgcgggctcttcccccatgtccttcccgcgctcatccctttgccctttcccccgcgttttgggccgtttttcggacccgcagcggggccccgtctccccctccctttcccccgcccttccttacctccccccctttatcctctctcgtgcgttcttccgccctcactcccccggtttatttccttttcgcacaccttgtctctcccct

SEQ ID NO: 24356 - DNA, 627 bp, Zea mays
  misc_feature: Ceres CLONE 1395345-F
  misc_feature (309)..(309): n is a, c, t, g, unknown, or other
  misc_feature (390)..(390): n is a, c, t, g, unknown, or other
  misc_feature (554)..(554): n is a, c, t, g, unknown, or other
  misc_feature (555)..(555): n is a, c, t, g, unknown, or other
aaagctggagctccccgcggtggcggccgctctagaactagtggatcccccgggctgcaggaattcgcacgagaccattacctagaacatcctaatcgaaaagccatggatttctcttaggctcacccgtccgctcggctcgcttccttccccactctctctgatcccgtcgcacttccctcctcgctgcagcccctctactattgcgattaccgtttcctcgctgccctttcctttttcggtcggcagcaatcaccggggcaagcgaaccctcgatttgcgtccccgctctctgctagcgcccctaanagaggagcgaagcgatgtctatgtcgaagacgggtcaggcccgcggagaaggatgagcagcagcagtcccgaaggaaagcnactgaggcagggcatcttgcgccccggggggaaccgcaaggggccaataaacccgccccgggcccacataagaaggggggtctcttacttggggggacctggggggggggggcccccctcttttttaaataggggggggccccctcccccccgagggggagggnngagggacccacccccatttattttttttgtaaaaaaagggggggaccaaaaattttttcgggggggaaaaaa

SEQ ID NO: 24357 - DNA, 705 bp, Zea mays
  misc_feature: Ceres CLONE 1395347-F
  misc_feature: Encodes the peptide sequence at SEQ ID NO. 24358
aaagctggagctccccgcggtggcggccgctctagtactagtggatcccccgggctgcaggaattcgcacgagaccattacctagaacatcctaatcgaaaacttcccctgcacaggctgtcgtccacaatgcccgcgccgctgatactacccacagtcgcgcgcgagctggcagagctcctcgtcgccctctccgccgcccgcgcgctcccaaaaggacagcagctccacggccatctcctcaaggctggacacgtccccgccaccgcctcctcccacgcgctgctcgcgcaccacctccttacgttctacgcgcgctgcgcgctccctgacctctccctccgtgccttccttgacctccccgcgccgccccttcccgctgcatggtcttccctcatctcctccttcgctcagaacggcctcgccgccactgccttcgacactttccgccgcatgctcgccgcgggcgtccctgccaccgaccgcttccatccctttggctgcaaaagccggtgccgctggcgagaccttgtcgcgccctcccgttctcccctcacgcgctcccagggccttgctggcaagactccggtcccgtggcaacgggttttgttggcctcgccgattggccaatttgattgccaagggcggaccaccttgcaaacagccccccggggtttatcctggtactgccccaacaggacagtt

SEQ ID NO: 24358 - protein, 192 aa, Zea mays
  misc_feature: Ceres CLONE 1395347-F
  misc_feature (84)..(118): Pfam Name: PPR Pfam Description: PPR repeat
MPAPLILPTVARELAELLVALSAARALPKGQQLHGHLLKAGHVPATASSHALLAHHLLTFYARCALPDLSLRAFLDLPAPPLPAAWSSLISSFAQNGLAATAFDTFRRMLAAGVPATDRFHPFGCKSRCRWRDLVAPSRSPLTRSQGLAGKTPVPWQRVLLASPIGQFDCQGRTTLQTAPRGLSWYCPNRTV

SEQ ID NO: 24359 - DNA, 598 bp, Zea mays
  misc_feature: Ceres CLONE 1395348-F
  misc_feature: Encodes the peptide sequence at SEQ ID NO. 24360
  misc_feature (271)..(271): n is a, c, t, g, unknown, or other
  misc_feature (336)..(336): n is a, c, t, g, unknown, or other
aaagctggagctccccgcggtggcggccgctctagaactagtggatcccccgggctgcaggaattcgcacgagaccattacctagaacatcctaatcaaaaagtgctgcatagccatacatgcatcgatccctagctctttgcttgccgcggatttctcctgctcatacaacacaagccatgaggggtttccagctgctactcatcatagtggcattgcttgccgggggagtgcactgcgcaagagcagcatcagcagcagatgcaccggnagctgcaccacagtccccccgaagcaccacagcagatgagcaaacgccaccggcaggcgctgggncaacatcacaccttcacctccacgaggtcggggaataacaaaatcgacggccacccagaaccgaagggttcaccaaggatcccagaccccccagggttgggcgggcccacaaggaaacctccctggaccggggcccccctgggaaaggggaaaaaaccccgcccaaaggggggtggaaaaaacccccctgtggaattgggagaacccaacccggggagccccggggaaaaaaaaaaaaatttttgtcccccaaaaagggggg

SEQ ID NO: 24360 - protein, 84 aa, Zea mays
  misc_feature: Ceres CLONE 1395348-F
  misc_feature (51)..(51): Xaa is any aa, unknown, or other
  misc_feature (73)..(73): Xaa is any aa, unknown, or other
MHRSLALCLPRISPAHTTQAMRGFQLLLIIVALLAGGVHCARAASAADAPXAAPQSPRSTTADEQTPPAGAGXTSHLHLHEVGE

SEQ ID NO: 24361 - DNA, 645 bp, Zea mays
  misc_feature: Ceres CLONE 1395353-F
  misc_feature: Encodes the peptide sequence at SEQ ID NO. 24362
  misc_feature (645)..(645): n is a, c, t, g, unknown, or other
aaactggagctccccgcggtggcggccgctctagaactagtggatttcccgggctgcaggaattcgcacgagaccattacctagaacatcctaatcgaaaagtctcttttccagttccagacctgaagaaactccgaccggtggcggcaggatctgtgccgcgatggcgacgtcgaacaccgctcggatggaggacggcggcggtgacctgcggagcaccatcaagaagtggaacatcatctaccctgtctacctcaactccaagaagacggtcgccgagggccgccgcatcgccgctgccaaggcctgcccggaccccacctgcatcgagatcgctgactgctgttcgcacctcaagatcccccacgccatcgagttggataaggcgtaccctcgggatttcttccaggtggggagggtcagggtgcagcttaagaaagatgacggctcccccgtcaatcctgctattaaaacaaagaagcagctgatgatccaagtagcagagctagttcccaagcatcacggaaggacaaagaagcaagagttcaatttgaggaaacctccatccttccactatgatttgcttctcttaggcttcctgacgttaatgtgtggccttattggtatccctccatcaaatggtgn

SEQ ID NO: 24362 - protein, 160 aa, Zea mays
  misc_feature: Ceres CLONE 1395353-F
  misc_feature (24)..(120): Pfam Name: SRP19 Pfam Description: SRP19 protein
MATSNTARMEDGGGDLRSTIKKWNIIYPVYLNSKKTVAEGRRIAAAKACPDPTCIEIADCCSHLKIPHAIELDKAYPRDFFQVGRVRVQLKKDDGSPVNPAIKTKKQLMIQVAELVPKHHGRTKKQEFNLRKPPSFHYDLLLLGFLTLMCGLIGIPPSNG

SEQ ID NO: 24363 - DNA, 642 bp, Zea mays
  misc_feature: Ceres CLONE 1395363-F
  misc_feature: Encodes the peptide sequence at SEQ ID NO. 24364
  misc_feature (613)..(613): n is a, c, t, g, unknown, or other
  misc_feature (642)..(642): n is a, c, t, g, unknown, or other
aaagctggagctccccgcggtggcggccgctctagatactagtggatcccccgggctgcaggaattcgcacgagaccattacctagaacatcctaatcaaaaaatattttggttccaaatcgaataacccaatgccgccgtagccgtctgcctcctcgctttcctttcgtccgtacgccgccggctcgcaccgccgacagtcctcagtccagaactccagatcgagcctctctcttcccagatcgggtcctaggctacagcagccgccgcatccgtcaccttcacaccgcgtgcgtgctctctctcccccctccccctctccgtgcgacgactgggtgggctaccgccgccttacgcaaggtgccgagaacttcgccaaaatctgcgccggagaagagcgcccaccagatcaggagctgagaaggcgcgctggtcggtggatgacgatggcgggtggcgggggactgaaccggtcttcatcgagggggcagctgccgccgcaagagctgcttgacgatctctgcagccggttccttctgaatgtgcccaaggaagaactggagtccgtcgagaggatcctgttcctgctggagcaggcgcactggttctatgnaggacactccggtgagcacacccccaacn

SEQ ID NO: 24364 - protein, 65 aa, Zea mays
  misc_feature: Ceres CLONE 1395363-F
  misc_feature (19)..(65): Pfam Name: DCP2 Pfam Description: Dcp2, box A domain
  misc_feature (56)..(56): Xaa is any aa, unknown, or other
MAGGGGLNRSSSRGQLPPQELLDDLCSRFLLNVPKEELESVERILFLLEQAHWFYXGHSGEHTPN

SEQ ID NO: 24365 - DNA, 670 bp, Zea mays
  misc_feature: Ceres CLONE 1395381-F
  misc_feature (388)..(388): n is a, c, t, g, unknown, or other
  misc_feature (391)..(391): n is a, c, t, g, unknown, or other
aaagctggagctccccgcggtggcggccgctctagaactagtggatcccccgggctgcaggaattcgcacgagaccattacctagaacatcctaatcgaaaactgctagtgctcagtcctcgccctctcgctttccgagggagcctttgcctttcccctccgcccgccagccattaatggcggcggcatctccatccactcccccctcgcccccctcccactgctgctacttctagaagcgctggtggcagggcaggcggtatcccggccgctggcgctggcgcgagagttggttggtggtggtgttcagccccccctccctctcaggtttagggtggagcgatccgtgcaggccaaacgcgggtgcgtgaccccaaagggaaaccgncgncttttttctcttctgcccgcccgcttttccatcccctctcaaactaatcggccccgcccggaacataacaaaaaggtcccccgctttctttcccccttccccctggcccctggtttgggtttgcctcggccccccccccccctttttggattcaacaaggggtccttcccggcggggggcgcggccccttggggaaaatgggggggggcaaaaaaaaattttaaagaacccctccccggggggcctccccccccggggggagggcccccccagtgggga

SEQ ID NO: 24366 - DNA, 638 bp, Zea mays
  misc_feature: Ceres CLONE 1395390-F
  misc_feature: Encodes the peptide sequence at SEQ ID NO. 24367
  misc_feature (638)..(638): n is a, c, t, g, unknown, or other
agagctggagctccccgcggtggcggccgctctagaactagtggatcccccgggctgcaggaattcgcacgagaccattacctagaacatcctaatcgaaaacacttggcgctagggtttcccccctctcatttcccctcctcctcccgctccccctggctccccaagcctcgacgcccggctagggttttgcctccttcccgccgccgctgtttcagcgagcgagaccgaggggtagagaaagagcggtgcttagccacccatgtcgctgcgtccgagcgagcgggtcgaggtacggcggaaccgctacaaggtggcggttgacgcggaggaggggcggcggcggcgcgaggacaatatggtggagatccgcaagagccgccgtgaggagagcctcctcaagaggcgccgtgaggggctccaagcccaggtccctgcccctccctccggggtcgagaagaagcttgaaagcctcccagctatggttagtggggtttattcggatgataataaccttcagcttgaggccaccacacagttccgcaaattgctctctatagagaggagtccccccatcgaagaagttatcaaaacaggtgtagttccaagatttgtgcagtctctcaccagagaggatn

SEQ ID NO: 24367 - protein, 125 aa, Zea mays
  misc_feature: Ceres CLONE 1395390-F
  misc_feature (4)..(92): Pfam Name: IBB Pfam Description: Importin beta binding domain
MSLRPSERVEVRRNRYKVAVDAEEGRRRREDNMVEIRKSRREESLLKRRREGLQAQVPAPPSGVEKKLESLPAMVSGVYSDDNNLQLEATTQFRKLLSIERSPPIEEVIKTGVVPRFVQSLTRED

SEQ ID NO: 24368 - DNA, 644 bp, Zea mays
  misc_feature: Ceres CLONE 1395392-F
  misc_feature: Encodes the peptide sequence at SEQ ID NO. 24369
aaagctggagctccccgcggtggcggccgctctagaactagtggatcccccgggctgcaggaattcgcacgagaccattacctagaacatcctaatcgaaaagttccgcttcgtaccagtcgctagttcttcctttcctccacagtgatggccaaatgctactcagattggcccccgattccgcctttccatccatcgcgaagaacgccgtcgcaatcccacgcctccccgatcacgatcaggcggcagatcgcgtccgtcgtgctccactgctccagatcgctgcgctcccctcctcgaggccaagaacctgcccgatgagttcgaggccgtaccggccgacgccgtcgccggcgctgccgaacgccgccccgaagctggcgatgtctaacaagttcatccgaggcctctgcgccgacccgcagaccgagcacctgggcttccagggctacaggagggcgctgctgcagcccgagatccggctggagaataagacggacaacgcgctgaccctgcagctgatcagggagaagcacagaggctccctggagctgctggtcgaggacttcatgggccacggcgcgctcccggagaatgggacgtgcgcgcggctcgtcacctgctgcatcagtgacgacaacgtt

SEQ ID NO: 24369 - protein, 109 aa, Zea mays
  misc_feature: Ceres CLONE 1395392-F
MSSRPYRPTPSPALPNAAPKLAMSNKFIRGLCADPQTEHLGFQGYRRALLQPEIRLENKTDNALTLQLIREKHRGSLELLVEDFMGHGALPENGTCARLVTCCISDDNV

SEQ ID NO: 24370 - DNA, 625 bp, Zea mays
  misc_feature: Ceres CLONE 1395411-F
  misc_feature: Pfam Name: Phosphoesterase Pfam Description: Phosphoesterase family
  misc_feature (395)..(395): n is a, c, t, g, unknown, or other
  misc_feature (399)..(399): n is a, c, t, g, unknown, or other
  misc_feature (526)..(526): n is a, c, t, g, unknown, or other
aagctggagctccccgcggtggcggccgctctagaactagtggatcccccgggctgcaggaattcgcacgagaccattacctagaacatcctaatcgaaaaatcgattcattcaactgaacagcaagcgcacctaccctacccgccgccgccgaaggcgaaggcctagctcccggtccggcgcgatggctgccgcggcccgccgcggcccgccgcggccccggggcgctcctcctcgtggcgctcctcctgctggcgctggtcgtctccgggcactgcctggacgcgcaccaccgcgggctgaagcgccgccggcggaagcacgagattcactctccgatcaagacggtggtggtcgtggtgatggagaaccgcagcttcgaccacatgctcggntggntccgccgcacccgccccgacatcgacggcctcacgggccgcgagtccaaccgcctcaacgccgtcgacccctcgtcccggatatcttcgtcacggacgaggccggctacgtcgactccgaccccggncacggtttcgaggacatccgggagcagatcttcgggtccgccgacacctccgcggtgccgccgcccatgtccggcttcgcccagaacgcgcgcggctgg

SEQ ID NO: 24371 - DNA, 707 bp, Zea mays
  misc_feature: Ceres CLONE 1395421-F
  misc_feature: Translation starting site: 290
  misc_feature: SWISSPROT Homolog: EC 3.4.22.14 Actinidain
  misc_feature: SWISSPROT Homolog: EC 3.4.22.30 Caricain
  misc_feature (12)..(12): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (398)..(398): n is a, c, t, g, unknown, or other
aaaaggtctgcngtgggccgattgggcgaggctgtgtgtgttcgagtggggggggtgggggaggatgtttnnnnntnnnntaaaaagtggagctcaccgcggtggcggccgctctagaactagtggatcccccgggctgcaggaattcgcacgagaccattacctagaacatcctaatcgaaaaaccaaaagaaagaaaccaactaaaatcccaaaagagaggaaaggcataaacagacggtagaaggaagaaagggacgctcgtctcggctcgtcacgtgccgccgccatggctgctctgggccgtggcctgcccctcctcctgctcctcctcctcgccgtagcgggggccgccaacgccgcggcggcgcccggcggcatgtccatcatcacctacnacgaggagcacggcgcgcgggggctggagcggacggagccggaggtgcgggccatgtacgacctctggctcggggagcacggccgcgcctactacgcgctgggcgagggcgagggcgagcgcgaccgccgcttcatcgtcttctgggacaacctccgcttcgtcgacgcgcacaacgagcgggccgggagcacgcggcttccgcctcgggatgaacaagttcgccgacctcaccaacgacgagttccgcggcgcggtactcggtgccatggtccccgccggccgaccggggagccgtcgtggggggaaa

SEQ ID NO: 24372 - DNA, 618 bp, Zea mays
  misc_feature: Ceres CLONE 1395423-F
  misc_feature: Encodes the peptide sequence at SEQ ID NO. 24373
aaagctggagctccccgcggtggcggccgctctagaactagtggatcccccgggctgcaggaattcgcacgagaccattacctagaacatcctaatcgaaaacccccacagaaccgtctccccagcccggcgcctcacggtcgcaatttattgcttgcgcaccgcctcgccgctttggcgtggggcgtttgcctgtgtggcgctgggcatgtgccgtgcccgtggcttgcttcgtcgtgctcactagtcacgagagagggaggaggctctgcttctgctgccgcttcttcttctcctgctgctcttccggagataagcagggggccgggacagctgactagctgagaggcatggggatggacgccggcggcggcaagctgccgtacagctacgccggccagcaggacggcgggaagctggtgaagagcgtcagccgcgtggagccgcgcaggttcggcctgggcctcgtggcgggcttcctcgtcgtcacctgcgcctacttctccaccgccaagttcgacgccatccagatcgccatgaccagccgacccgtctccagcaatgcggctgggcgtcggagtcggctcgcctgggagtgggcgccgccgccgccgacac

SEQ ID NO: 24373 - protein, 89 aa, Zea mays
  misc_feature: Ceres CLONE 1395423-F
MGMDAGGGKLPYSYAGQQDGGKLVKSVSRVEPRRFGLGLVAGFLVVTCAYFSTAKFDAIQIAMTSRPVSSNAAGRRSRLAWEWAPPPPT

SEQ ID NO: 24374 - DNA, 783 bp, Zea mays
  misc_feature: Ceres CLONE 1395426-F
  misc_feature (76)..(76): n is a, c, t, g, unknown, or other
  misc_feature (78)..(78): n is a, c, t, g, unknown, or other
  misc_feature (83)..(83): n is a, c, t, g, unknown, or other
  misc_feature (84)..(84): n is a, c, t, g, unknown, or other
ggggcggcggccccccgttccgcgcgtatgtagtgggaagggggcgcgcggtaggagggggggggagtggggaaanancacannttgttaaaaagctggggctcccggcggtggcggccgctctagaactagtggatcccccgggctgcaggaattcgcacgagaccattacctagaacatcctaatcgaaaaacttggcgctagggtttcccccctctcatttcccctcctcctcccgctccccctggctccccaagcctcgacgcccggctagggttttgcctccttcccgccgccgctgtttcagcgagcgagaccgaggggtagagaaagagcggggcttagccacccatgtcctgcgtccgagcgagcgggtcgaggtacggcggaaccgctacaaggtggcgcttcacggggaggaggggcggccggggagcgaggacgatatgggggacatccgccaagatccggcgtggggaagaggcttcctaaggaggcgccgtggagggccccccaaggggaagggggcgcgtggccccctcccatcgcgggggggaggaaggaaggtttgggatagccctcccacggtatcggcccagctggcgggcttaacccccgcacggaaaagaaaacccttccggcctgcggggggcccgccccccaccgggctaccccgcacacggtcgcctccccgtagtggcgacgagggcggagtcccccctccattcccaaaagcaagtttaatccatgcgccctgtggccggcgggataccgcggcagcg

SEQ ID NO: 24375 - DNA, 810 bp, Zea mays
  misc_feature: Ceres CLONE 1395430-F
  misc_feature: Encodes the peptide sequence at SEQ ID NO. 24376
  misc_feature (11)..(11): n is a, c, t, g, unknown, or other
  misc_feature (68)..(68): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
ggggtggtttnggggggggggggcgacaacaaattactgaggctacgtttccgggggggaggtggtgnagggnnnncccaaactggggctccccgcggtggcggccgctctagaactagtggatcccccgggctgcaggaattcgcacgagaccattacctagaacatcctaatcgaaaaatctagcggcagagaccaaagtgcccatcgcaccatgtcggccgccgaaaccgctgtttctccgacgacgacgccgcagccgcagctgcaatcggatccgaacgccgccgccgacgcggccagttccaattctctctgggtggccgacgagacgcataccctaaccgagggtcctgctccaaccccaaccaaaccacctgtcgccttcctccttctggggaaggggacgacggggatcactgcctccggcggtcctgttgggggggaaggaagtggcatcctgtttctgctgcggcggcggcttaacgccgacgaagtaaagagggggggggaggcggccgtgggtcccccgaagggaggaagcgggtgctggagcaaccttcgtggaacaaatccccggcgcgcgggaaacggggaagcttgaatcgcgggggggggattcccgggggccgggtcccgggcgaaggccctggccgccctggggcggggggggctattccggctccaaaccccccgggggcgaaggcggccaaaggccttttccccctggaaaccacggagcgggccccgctattaataaagggggcacacttctcagggcccgtcgccccacggggaaaacaacagatg

SEQ ID NO: 24376 - protein, 129 aa, Zea mays
  misc_feature: Ceres CLONE 1395430-F
MSAAETAVSPTTTPQPQLQSDPNAAADAASSNSLWVADETHTLTEGPAPTPTKPPVAFLLLGKGTTGITASGGPVGGEGSGILFLLRRRLNADEVKRGGEAAVGPPKGGSGCWSNLRGTNPRRAGNGEA

SEQ ID NO: 24377 - DNA, 645 bp, Zea mays
  misc_feature: Ceres CLONE 1395444-F
  misc_feature: Encodes the peptide sequence at SEQ ID NO. 24378
aaagctggagctccccgcggtggcggccgctctagaactagtggatcccccgggctgcaggaattcgcacgagaccattacctagaacatcctaatcgaaaaagctaggttcctatgcccaaagtcacacagcttcttctccttctacttctccttcctcctctcctcaccggcaccttgatctaatctcttccatcctagcttgctcgccgctgccagtctctcctccgcctgcaacgactcccatgtctcagtcttctcctctcttctccgtcgcccgagcgcacgccggagcaggagggcgagccgtggcagccgctctcctgctccgtcgtcgccccattgcacagctgccgcacagcatccatggcctacggtgtctctctccagccagagcgacaccttccaagacgctcctcagcctcccccgcgccacgctgtcctccttcgccgaccccgacggcgacggcggctccagcgcgaaagccagcgacggcggcgccaaggccggcgccggcggggaggagcaggtcggggaatgcgagatgtcggagatggccagggcgttccacatctcgccaggggtggcgacgtccatctccgtgacgatcgcgttcgccgccctcaccgtgccgctggcgatgc

SEQ ID NO: 24378 - protein, 33 aa, Zea mays
  misc_feature: Ceres CLONE 1395444-F
MSEMARAFHISPGVATSISVTIAFAALTVPLAM

SEQ ID NO: 24379 - DNA, 643 bp, Zea mays
  misc_feature: Ceres CLONE 1395450-F
  misc_feature: Encodes the peptide sequence at SEQ ID NO. 24380
  misc_feature (280)..(280): n is a, c, t, g, unknown, or other
  misc_feature (296)..(296): n is a, c, t, g, unknown, or other
  misc_feature (297)..(297): n is a, c, t, g, unknown, or other
  misc_feature (525)..(525): n is a, c, t, g, unknown, or other
aaagctggagctccccgcggtggcggccgctctagaactagtggatcccccgggctgcaggaattcgcacgagaccattacctagaacatcctaatcgaaaaaggattagtttgaccccctccagtacgtccgcaccgcaaggcctctcgccgtccttggacattctccgtccgtcgcctttgcctggggcagataacaatatctgatatccctgggccttcgccgtccgggcccccctaccttctctcatccgtcctccacaaagagaagggggagagnagttttagggggaggnnaggggcggcaggaggagccattattatttcttcttccagcggcaattcctggccaccaccgggcgcgctatattactccgggttcgtggacaagcatgcagaggggcgtgtccttccctggcggaatggcgaaggagtgcccgcccgccgagctctggctcccggacgagttcctggacgacgacttcttctccgaggaggagaaggcggcggtcgcggcaaagcganagccgacccaggaggaaggggatggacggcctctcgcaccgcgcggccggctcgtccgtcggggggggggaggggaaacgggtccccctgcaaagggcgcaagtgttagcgggctcgg

SEQ ID NO: 24380 - protein, 83 aa, Zea mays
  misc_feature: Ceres CLONE 1395450-F
  misc_feature (45)..(45): Xaa is any aa, unknown, or other
MQRGVSFPGGMAKECPPAELWLPDEFLDDDFFSEEEKAAVAAKRXPTQEEGDGRPLAPRGRLVRRGGGGETGPPAKGASVSGL

SEQ ID NO: 24381 - DNA, 674 bp, Zea mays
  misc_feature: Ceres CLONE 1395459-F
  misc_feature: Translation starting site: 264
  misc_feature (379)..(379): n is a, c, t, g, unknown, or other
  misc_feature (409)..(409): n is a, c, t, g, unknown, or other
  misc_feature (579)..(579): n is a, c, t, g, unknown, or other
ggagctccccgcggtggcggccgctctagaactagtggatcccccgggctgcaggaattcgcacgagaccattacctagaacatcctaatcaaaaatcgctctctcctttgcacccctagctagctagtactactgctgctcctccgacttgctcttcgcgcagcaggacggagaaacaagaaccatccctccccctaccggctaccgctgctactcatggtcgcgcgcactgcctcctggtgccgccgcgtatgatccagacatgaatagggcgcacagcagcagctccaagctcatcaacgagaagctcgtggaacaccggatctccactgcgaagcactgcccccactgcggcgagaaaatcgacagcaaaccggnattggggtgggctggccggcaggcgtcaangttcgatccaactggacagggagctgatcgagcacctcgagggcgaaagtgaaggatgaaggttcgagatctcaccctctcatcgacgaggtcatacccacatagatggggaggacgggatatgttacaccaccccgaaaacttcaaggggggacagggaagggcctaanaaaggattttcttccccggggcggccaaggcctaaccgagggccccggggaaagggggaaatcccgccgggggggacgcccccaggggaaacagg

SEQ ID NO: 24382 - DNA, 870 bp, Zea mays
  misc_feature: Ceres CLONE 1395462-R
ttgggtaccgggccccccctcgaggtcgacggtatcgataagcttttttttttttttttttcttttttttttttttttttttttttttttttttttttttttttttacccttacgaataataacgacaagatgttaaaaagagtaaacataacagataaaccagactttttgcctggccagcaggacaaccgataacgtgccaaaaacctcgaacaatagtgaaaattaagctatcacaggtagcttagctagggataagataaacggcaagcatgcgatgcgacacttagtcgacctcctccatcttgctttcaccagcgtcgtcctcaagctgagggatctcggcctctgcctcaacaggctcgtcctcatcgatgctcaaaccgagtttgagcatgcggtggatccggttgccaaaggtgttggggtcatccaggctgaagccggaggtcaggagagcagtctcgaacagcagcatcacgagatccttgactgacttgtcattcttgtcagcctcggcacgcttgcggagctcatccatgatagggttctctgggttgatctccattgtctttttgctcgacatgtagcccgccctgctcgagtccctcagggcttgggccttcatgatcctcctcatgtggggcgggccagccattctcgccagtcacaaaggagcccgggtgagtcccacaacgcggtatcaaaaacccacccccttttttaaatttgttcacccagaaaccccccttgaaggaactttgcaaaacccccccaaaaaatttctcctttaaggtccccaccttccccctttctttcgtcgggcctcagttgttccttcaagagttctaaaaaccccctcctctggg

SEQ ID NO: 24383 - DNA, 772 bp, Zea mays
  misc_feature: Ceres CLONE 1395463-F
  misc_feature: Encodes the peptide sequence at SEQ ID NO. 24384
  misc_feature (1)..(1): n is a, c, t, g, unknown, or other
  misc_feature (6)..(6): n is a, c, t, g, unknown, or other
  misc_feature (7)..(7): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (43)..(43): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
nggggnncccccccnnnaannnccccccaccaccgcggggggntnnnnnnnnnntcaaagctggagctccaccgcggtggcggccgctctagaactagtggatcccccgggctgcaggaattcgcacgagaccattacctagaacatcctaatcgaaaaatcccatcccctcaggcctcagtcgtcagtccctcacacactcactatacactgctctgctgcagcaagaaggaagaagctagcgcctccctagctctcgttgtcagcaatggccaccaccgccgcgtccagcctcctcaagtcctccttcgcgggctcccggctcccttcggccacgcgcaccaccaccccgtcgtccgtggccgtggccaccccgcgcgccggcggcggccccatccgcgcgtccatctcctcctcccccaccccgccctacgacctgacgtccttccggttcagccccatcaaggagtccatcgtgtcccgcgagatgacccggcgctacatgacggacatgatcacccacgccgacaccgacgtggtgatcgtgggcgcccggtccgcgggcctggtcctgcgcgtacgagctggtcaagggacccctccgtgagcggccgccatcggtggaagcagtcccgtgccccccggggcggcgggggcggtgggttggggccgggcaagctgttcttcgggccaatgggtgggtgcggcaaggcccggccgccaaccgtggttccctgggaacgaagcctggggccggtggaggcctacctaa

SEQ ID NO: 24384 - protein, 112 aa, Zea mays
  misc_feature: Ceres CLONE 1395463-F
MATTAASSLLKSSFAGSRLPSATRTTTPSSVAVATPRAGGGPIRASISSSPTPPYDLTSFRFSPIKESIVSREMTRRYMTDMITHADTDVVIVGARSAGLVLRVRAGQGTPP

SEQ ID NO: 24385 - DNA, 735 bp, Zea mays
  misc_feature: Ceres CLONE 1395464-F
  misc_feature: Encodes the peptide sequence at SEQ ID NO. 24386
aaagctggagctccccgcggtggcggccgctctagaactagtggatcccccgggctgcaggaattcgcacgagaccattacctagaacatcctaatcgaaaactgctcctctaccccttcctctcccggcgaccagctggcctctcctttgttgaggcgagagacccccacccgatccggcgatggacgccgcgtccaggccgcctccgccccacggagcaggggtccgcgtccgcgccccgctggtggagtctgtctcctgctactgcagattagatacaggccttaaaactgttgttgaggccaggaagtttgttcctggcgcgaaaatgtgcatgcaacctggagtcaaacaaaacaagcgcaagtcaaggggctcaaaaaaggaaaggtgcaggactcaagcaccacttttacctggccttcctgatgatcttgctattgcctgccttatacgagttcctcgacttgaacagccccaactcaggatggtttgcaaaagatgggaaccgtcttttgtctgggaattacttttactccttgcgtaagaaaattggagtgccagaagaaatggtgtatgtctttaaaagggaccgggaagggaagaatcctggtatgcctttgacccactcaccagctatgggaagcactcccccagttccacagagtattcaaagcattgggctttgggggggccgctcggaggggtggcatctggacttgttggggggaaaa

SEQ ID NO: 24386 - protein, 121 aa, Zea mays
  misc_feature: Ceres CLONE 1395464-F
MDAASRPPPPHGAGVRVRAPLVESVSCYCRLDTGLKTVVEARKFVPGAKMCMQPGVKQNKRKSRGSKKERCRTQAPLLPGLPDDLAIACLIRVPRLEQPQLRMVCKRWEPSFVWELLLLLA

SEQ ID NO: 24387 - DNA, 716 bp, Zea mays
  misc_feature: Ceres CLONE 1395465-F
  misc_feature: Encodes the peptide sequence at SEQ ID NO. 24388
  misc_feature (622)..(622): n is a, c, t, g, unknown, or other
  misc_feature (623)..(623): n is a, c, t, g, unknown, or other
  misc_feature (631)..(631): n is a, c, t, g, unknown, or other
gctctagaactagtggatcccccgggctgcaggaattcgcacgagaccattacctagaacatcctaatcgaaaaatcaccaaccatccagtcataactcacgcaggcagagacgcgcaccaccagaccagcagcagaacgaaagggatctccggtccccgggccccggctcctcccctcccgattccaatctggtctcaccgggcctggcggcgagggagagatggggaagaaccaggcgtacaaggcgatgcagcgggcgcggctggggtcctcgtccggcgcgccgggcgccgccgacgcccccgaagacggcatggtcggtccccttcctctcccctaggagatctctgtttcccatctgcacttccgagttccaggctcgcaatccatcctgatccgattatttccgcagccatattactatgctaattatatacaatagagtaggcttccagcccgctgagaattttggctaccatcccactttcgctttgggtgaaagataaagaaaagaactttggctaacgaggggcgtcgcagacggacggttcattccatttctcagagtggcatgcggcgcgcctggccagccttaacaagacgcacaccctcacctgggnnagagtcangaagaagcagaaggaagaggaactgaaaggggtgagctggaggctgacaaagcaaaatgatgagagagataagagctcaactggt

SEQ ID NO: 24388 - protein, 39 aa, Zea mays
  misc_feature: Ceres CLONE 1395465-F
MGKNQAYKAMQRARLGSSSGAPGAADAPEDGMVGPLPLP

SEQ ID NO: 24389 - DNA, 508 bp, Zea mays
  misc_feature: Ceres CLONE 1395467-F
  misc_feature (253)..(253): n is a, c, t, g, unknown, or other
aagctggagctccccgcggtggcggccgctctagaactagtggatcccccgggctgcaggaattcgcacgagaccattacctagaacatcctaatcgaaaaatcgcttcagctcggcgtcttcacaaacgccggcgcaaactctcgcccgagcccgacagatcttcaattccccatttccgccccaccgaatcggacctttcacggcccaggtcctccggggtttcctttcccaaagggggtccccccccccncggttttttttaaagaaaggggaaatgaggggggtttccctcccatcgggaggcggtttcaagggaaaggggggggaaattttggcccaaagggttcccgcggggggcaaaggccgggaaaaaaaccggggaacacaaaaaggcctccccaccccctttcccaaaaagggggggggggaaaaaaaacccccccccgaaatatttttttttgtttataaaaacaccccccctttttttaataaaagggggggcccc

SEQ ID NO: 24390 - DNA, 730 bp, Zea mays
  misc_feature: Ceres CLONE 1395468-F
  misc_feature: Encodes the peptide sequence at SEQ ID NO. 24391
  misc_feature (402)..(402): n is a, c, t, g, unknown, or other
tggagctccccgcggtggcggccgctctataactagtggatcccccgggctgcaggaattcgcacgagaccattacctagaacatcctaatcgaaaaaaagcttaccgtctccaccgcatctcatctcgccggcgagccagcctaaccaatcgccaatgctcacctcgttgcttccaccgcccaccgtcccgatctccaaaccctccgcgtcggcgtcgcccaagaccgccaagcccaggtccgccgtgctctccgcctccgccctcgccctcgcccccgcctcgacatccgattccgacgatgcgcccggcgggggcgagggcggcggcgtccgcctctcctcgctcatccgctccctctgcgccgcggggcgcacagcagaggccgcgcggcgtgttccngcggcggggccggcggcgcgggcgtcctcgcctacaacgccatggtggccggctactgccgcgcgggccagctcgaatccgcgcgccgccttgccgccgcggtccccgtcccgcccaacgcctacacctacttcccccgtcgtccgcgccctctgcgcgcgggggccggatcgccgacgcgctcgcggggctcgacgagatgccccgccgcgggtgcgcccccatccgcccatgtacacgtcatcctcgaggccgcctgcaggggtgccggtttcggagcggcgtcagggtgttcgagatctacccgccaggggctgcgccctccacg

SEQ ID NO: 24391 - protein, 191 aa, Zea mays
  misc_feature: Ceres CLONE 1395468-F
MLTSLLPPPTVPISKPSASASPKTAKPRSAVLSASALALAPASTSDSDDAPGGGEGGGVRLSSLIRSLCAAGRTAEAARRVPAAGPAARASSPTTPWWPATAARASSNPRAALPPRSPSRPTPTPTSPVVRALCARGPDRRRARGARRDAPPRVRPHPPMYTSSSRPPAGVPVSERRQGVRDLPARGCALH

SEQ ID NO: 24392 - DNA, 727 bp, Zea mays
  misc_feature: Ceres CLONE 1395469-F
  misc_feature: Translation starting site: 358
  misc_feature (526)..(526): n is a, c, t, g, unknown, or other
  misc_feature (527)..(527): n is a, c, t, g, unknown, or other
  misc_feature (535)..(535): n is a, c, t, g, unknown, or other
  misc_feature (536)..(536): n is a, c, t, g, unknown, or other
  misc_feature (541)..(541): n is a, c, t, g, unknown, or other
  misc_feature (542)..(542): n is a, c, t, g, unknown, or other
  misc_feature (548)..(548): n is a, c, t, g, unknown, or other
  misc_feature (549)..(549): n is a, c, t, g, unknown, or other
  misc_feature (554)..(554): n is a, c, t, g, unknown, or other
  misc_feature (562)..(562): n is a, c, t, g, unknown, or other
  misc_feature (580)..(580): n is a, c, t, g, unknown, or other
  misc_feature (584)..(584): n is a, c, t, g, unknown, or other
  misc_feature (587)..(587): n is a, c, t, g, unknown, or other
  misc_feature (590)..(590): n is a, c, t, g, unknown, or other
  misc_feature (611)..(611): n is a, c, t, g, unknown, or other
  misc_feature (622)..(622): n is a, c, t, g, unknown, or other
  misc_feature (626)..(626): n is a, c, t, g, unknown, or other
  misc_feature (636)..(636): n is a, c, t, g, unknown, or other
  misc_feature (682)..(682): n is a, c, t, g, unknown, or other
  misc_feature (701)..(701): n is a, c, t, g, unknown, or other
  misc_feature (702)..(702): n is a, c, t, g, unknown, or other
  misc_feature (724)..(724): n is a, c, t, g, unknown, or other
  misc_feature (727)..(727): n is a, c, t, g, unknown, or other
ggagctccccgcggtggcggccgctctagaactagtggatcccccgggctgcaggaattcgcacgagaccattacctagaacatcctaatcgaaaaacacaatacgcacacttcgcaaagcgtcttcctccgaccccatcgcctctgtggcttcctggctgtctgactgcgtctgcctggtcgtacgcgagcgcgtgcgtcccttcaccgtcacgagcggcgcacaccgtcaccgccacgctccgtcgccttccagaaaatctaaaccccagcggagccggccacggccagtcagccctcacacggactccgacgcgctgcccgctcgcctgccaaacccccaccccctcgccggcgatgctgccgcgtcgctttagcaaccacccgggctcctcctcacccctcccgttcctcgtcgtctgcggcctgctcctcgctgcggccgtagcattttccccggccgctgccgccgaggccgctggccgcggcggcggcggcggcggcgctgggcacgagggccgcgcgnngaagccgnnagtcnnagcggnnagcgnagcgcgcngggatggggtggccgtgncggnagncgncggcgaagtgatggctcaggncaatgccacgnaggncaagggaggncagctcgccgacatgatcgaccgcgcgctggagaaggagttcccgnagtccgagagcgagcaggnncgcggaaagaccgatcctggtnacn

SEQ ID NO: 24393 - DNA, 651 bp, Zea mays
  misc_feature: Ceres CLONE 1395478-F
  misc_feature: Encodes the peptide sequence at SEQ ID NO. 24394
ggagctccccgcggtggcggccgctctagaactagtggatcccccgggctgcaggaattcgcacgagaccattacctagaacatcctaatcgaaaaaaaccaacaggtgttgcctgcccaagtgcccagcctcgcttctccagtcaattctcagcctcgtcctccgcctccctcccgctctctcctctccttggcctccgcttccgctcctgcctggaggctgcatcaaaccctaccgctccggacctcccggctggccgcgagatgcgacgcctgtccggcccctaatccttctcctcgatactgcccctcgcccgcccgcccgccggcatgggccgctacgggcccttccctgccgccgccggtgatggcgggggctgcctgcccctgccgattgtagcggctgaaggcgcgctggctgtcctggacggcgccattgcgaccgcggccttcgtgcagttagcaaggattcataggcacaaccagctacaaggatggactcggcaaaagatattccattttatgattgttctatcaaacatagtattcctagtatatttcgtgtctaccatcattgctacttgtcagagatggatttgctgggtacatggatgtggatttgttctcatggctagtccacagatattgctt

SEQ ID NO: 24394 - protein, 107 aa, Zea mays
  misc_feature: Ceres CLONE 1395478-F
MGRYGPFPAAAGDGGGCLPLPIVAAEGALAVLDGAIATAAFVQLARIHRHNQLQGWTRQKIFHFMIVLSNIVFLVYFVSTIIATCQRWICWVHGCGFVLMASPQILL

SEQ ID NO: 24395 - DNA, 744 bp, Zea mays
  misc_feature: Ceres CLONE 1395482-F
  misc_feature: Encodes the peptide sequence at SEQ ID NO. 24396
tggagctccccgcggtggcggccgctctataactagtggatcccccgggctgcaggaattcgcacgagaccattacctagaacatcctaatcgaaaagtctcttttccagttccagacctgaagaaactccgaccggtggcggcaggatctgtgccgcgatggcgacgtcgaacaccgctcggatggaggacggcggcggtgacctgcggagcaccatcaagaagtggaacatcatctaccctgtctacctcaactccaagaagacggtcgccgagggccgccgcatcgccgctgccaaggcctgcccggaccccacctgcatcgagatcgctgactgctgttcgcacctcaagatcccccacgccatcgagttggataaggcgtaccctcgggatttcttccaggtggggagggtcagggtgcagcttaagaaagatgacggctcccccgtcaatcctgctattaaacaaagaagcagctgatgatccaagtagcagagctagttcccaagcatcacggaaggacaaagaagcaagagttcaatttgaggaaacctccatccttccactatgatttgcttctcttaggcttcctgacgttaatgtggggccttattggaatccctccatcaaatgggggcatttccccaatcacccatgccccgaaagagtttgggtactcctcaggatcagctgctttcgaacccggctagaacccactgccccaaagagccttgacgccaa

SEQ ID NO: 24396 - protein, 107 aa, Zea mays
  misc_feature: Ceres CLONE 1395482-F
  misc_feature (24)..(108): Pfam Name: SRP19 Pfam Description: SRP19 protein
MATSNTARMEDGGGDLRSTIKKWNIIYPVYLNSKKTVAEGRRIAAAKACPDPTCIEIADCCSHLKIPHAIELDKAYPRDFFQVGRVRVQLKKDDGSPVNPAIKQRSS

SEQ ID NO: 24397 - DNA, 854 bp, Zea mays
  misc_feature: Ceres CLONE 1395486-F
  misc_feature: Encodes the peptide sequence at SEQ ID NO. 24398
  misc_feature (38)..(38): n is a, c, t, g, unknown, or other
  misc_feature (47)..(47): n is a, c, t, g, unknown, or other
gtttacccccctcccttttaccccccccaaaaaacccncgcgcgcantattcaaagctggagctccaccgcggtggcggccgctctagaatagtggatcccccgggctgcaggaattcgcacgagaccattacctagaactcctaatcgaaaaacatcgacccagccatctcctcaccctcgttcaccacacagtccgccactcctttagtagcttgtgatttgtacgtcgacaagatcactggtcgggtgggggacgacgacacatggggaagggtagtgtgggtgcatcatggtgggcgttcctcctgctcgccggggtgctgctggtccgtacagccacgggccggggcggaagacaggattggtcctaacgggaaccgaagggaggacctggggtgggtgcaaataaggagatgaaaaggggcagtacccaaaaagaccccccccgccgtaaaagggtaatggcaaaaaagcaaagtggcccccaggggggcaccaaaacaaagttggaaaccggggcgaaggaaccgggccaactggggggggtgggaaagcccttaacgtttctccccgctcccgagagagaggggccaaaggggcccggttcaccaagtgccccggcggcccccgcccaaaggggcgccaacccccgggggaagaacaccacacaaaaatggccattgaacgcggggggcccccccccccagcatgggaaatgtggcgcccaccacatggggaacaaaaagaggccgcggggccccgcgggaaaaccaagaaaaggctgcggcgaaaaagtgccccccgggaaagggggcgcaataccaacccccccacaccgtgtggtcgacgggg

SEQ ID NO: 24398 - protein, 35 aa, Zea mays
  misc_feature: Ceres CLONE 1395486-F
MGKGSVGASWWAFLLLAGVLLVRTATGRGGRQDWS

SEQ ID NO: 24399 - DNA, 793 bp, Zea mays
  misc_feature: Ceres CLONE 1395489-F
  misc_feature (259)..(259): n is a, c, t, g, unknown, or other
aagctggagctcaccgcggtggcggccgctctagaactagtggatcccccgggctgcaggaattcgcacgagaccattacctagaacatcctaaaaaaaaaaataggacaagccccagcagtttgccactcccacgcgaaacagaagccccagcagggcggcactcccgacgcgacgcccctgcttgccggccgggaggctcactcgactctgcctccacttcctcgtctgtccgttggagcacggcgccgatgggcgncgcgccagcgctcgcgacggagctgctggacccgcccgggaccccgaattcccggaaggaaaaccgggggttggggcccgatccaccagaaccgggaggtggctttccagaaacacggaacaaggggttcggggggcccgaaatcaaaagaaacggggtccccaaacccgtgctctccggggaaaaaggggggtggggaaaaaaaaggggcccccccggggggcccggggtttccccccccccacaatggagccccccccccccggaaaaggggaaaggggggtttaaaaaaaaaaaaaaagggaaattttgggggtggggaaaaccccccccggggggggttttttggggagaaatgagttttatctccccggggagaaaaaaaaagaaaaaaaaaatttttttggggggggttttcgcacaaaaaaaaataacaccccctcccccacaaacagggggggagaaattttttgggggggggggcgcccaaaaaaaaaaaaccccctttttttatatttcggcgcgcgggggggg

SEQ ID NO: 24400 - DNA, 753 bp, Zea mays
  misc_feature: Ceres CLONE 1395490-F
  misc_feature: Encodes the peptide sequence at SEQ ID NO. 24401
  misc_feature (385)..(385): n is a, c, t, g, unknown, or other
  misc_feature (430)..(430): n is a, c, t, g, unknown, or other
  misc_feature (457)..(457): n is a, c, t, g, unknown, or other
  misc_feature (490)..(490): n is a, c, t, g, unknown, or other
aaagctggagctccccgcggtggcggccgctctagaactagtggatcccccgggctgcaggaattcgcacgagaccattacctagaacattcctaatcgaaaaactctcgcccccgacctcatggaaggatccgcctctcgcgcgcccccgccgacgcacgcaactcgcagacggcgcccccccagatccacttctcgctggccgctcagatcctccatatcctgacctctccctcctcttgctgcagatgatatgctagagcgtcagcaaggcggactctccaaacctccagagagggagggaggcagcagccaatgcccagcacgtaccaatctgcgtggcgggaggtgcccggactgcgtacccacgggcgagcaggatttntgacgatccacgacccgatgaagtcgccgtgcgtcggtgacgcanaaggcggcagtggccatcgtgcgctgnacgcccagtcccttcctctcggagcgaaacggnggggggccgtgggtggctgccggacgaaatggatatcgtccgagagcgagcaaaatagggggtaagcatttattcaagcggaagtggggaagaaatggtactagtgaaagtgggaggaaatggacacagaacacggagcgaagctggattcctcaaggcggtcggcactcgcacgttctatttttttggggtagggcaaccttcccaaagtcgcttgctaccaagtgcccccccgtgttggggtaattaggggccagtccgcc

SEQ ID NO: 24401 - protein, 79 aa, Zea mays
  misc_feature: Ceres CLONE 1395490-F
  misc_feature (24)..(24): Xaa is any aa, unknown, or other
  misc_feature (39)..(39): Xaa is any aa, unknown, or other
  misc_feature (48)..(48): Xaa is any aa, unknown, or other
  misc_feature (59)..(59): Xaa is any aa, unknown, or other
MPSTYQSAWREVPGLRTHGRAGFXTIHDPMKSPCVGDAXGGSGHRALXAQSLPLGAKRXGAVGGCRTKWISSESEQNRG

SEQ ID NO: 24402 - DNA, 715 bp, Zea mays
  misc_feature: Ceres CLONE 1395494-F
  misc_feature (477)..(477): n is a, c, t, g, unknown, or other
  misc_feature (478)..(478): n is a, c, t, g, unknown, or other
  misc_feature (517)..(517): n is a, c, t, g, unknown, or other
  misc_feature (551)..(551): n is a, c, t, g, unknown, or other
  misc_feature (576)..(576): n is a, c, t, g, unknown, or other
  misc_feature (578)..(578): n is a, c, t, g, unknown, or other
  misc_feature (609)..(609): n is a, c, t, g, unknown, or other
acagctggagctcaccgcggtggcggccgctctagaactagtggatcccccgggctgcaggaattcgcacgagaccattacctagaacatcctaatcgaaaaatcgtcctctcctttgccagcgccgccgaacccgccaccagccttctcccatcctcgaagcacggaaggctcccagaaggagctctcacctcgcagccatctctggcacgtccgtccttcttctccctcggtccctccccttctccacagctatcggattggcgttggagtggagatcgacccgggctcggaattcccttcgttggtaaggaaccctaatttggtcagatgggacttccaacttcgacaaaccccgcgaggtcgatcgatctcagttgacgggcggcattggcccttttttttttgggtgtcccccaattacaagccagatcggcggcgcccctgacatcctcaccccggcccgggggacgcccnncccggggaggcggcgccccctttccggattgtagtgtanagcccgcgcacgtaccgaataaccgcccccgcgnccgccccgctgacgcgcgcgcggcncntttcgtggtgtgtttttccgctcggtccganccgccccccgcccgatcgacccctttgtgcgtccctcgcacgagtatagcgaccgaaggcgggctctgctgtctccccccacccctcccccttgcgcacgttggcc

SEQ ID NO: 24403 - DNA, 654 bp, Zea mays
  misc_feature: Ceres CLONE 1395499-F
  misc_feature: Encodes the peptide sequence at SEQ ID NO. 24404
  misc_feature (411)..(411): n is a, c, t, g, unknown, or other
  misc_feature (465)..(465): n is a, c, t, g, unknown, or other
  misc_feature (525)..(525): n is a, c, t, g, unknown, or other
tggagctccccgcggtggcggccgctctagaactagtggatcccccgggctgcaggaattcgcacgagaccattacctagaacatcctaatcgaaaaatcgatcccagccccaggccatggcgacgaggtggaggaggtcgctgctctgggtcgccgtcgtccagttcctgaccctgtgcgtcgccgagcatctcgtagtggaagcatacaaaaagtcctacattgtgtatctgggatcacatgcatatggccgtgatgcgtcggcggaggagcatgctcgcgcaacccagtctcaccaccacctcctggcatcgatcctcggcggcgacgaccaccaccaccatgagacggcgcggcagtccatcttctactcctacaccaagagcagcatcaatggcttcgcggcgcanctgggaggagtcggtcgcgcagcagatcgcggagcaccctgaggtgggtggcgntgctggagagcaagatgcttcagctgcacaccacgcggtcctgggacttcatggactggnagcgcgacggtcacgtcctccctggctcatctggacacggctaggtcgggacagacgtcatcatcgcagctcgaaagggggagtgtggcccgagtccaagctccaggacgacgggggcagtgcattttc

SEQ ID NO: 24404 - protein, 111 aa, Zea mays
  misc_feature: Ceres CLONE 1395499-F
  misc_feature (98)..(98): Xaa is any aa, unknown, or other
MATRWRRSLLWVAVVQFLTLCVAEHLVVEAYKKSYIVYLGSHAYGRDASAEEHARATQSHHHLLASILGGDDHHHHETARQSIFYSYTKSSINGFAAXLGGVGRAADRGAP

SEQ ID NO: 24405 - DNA, 806 bp, Zea mays
  misc_feature: Ceres CLONE 1395501-F
  misc_feature: Encodes the peptide sequence at SEQ ID NO. 24406
  misc_feature (23)..(23): n is a, c, t, g, unknown, or other
  misc_feature (35)..(35): n is a, c, t, g, unknown, or other
  misc_feature (36)..(36): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (806)..(806): n is a, c, t, g, unknown, or other
ttttttttttttttttgtttttngggaggggggtnncnnnnnaaannnnaaaaactggcgctcaccgcggtggcggccgctctataactagtggatcccccgggctgcaggaattcgcacgagaccattacctagaacatcctaatcgaaaaactactagtgatcagaccagtgagctagcgactgtaccatgcagcagctgtaggagagcctggtggtatgtaggataggagtagcgccagccgccaagtgcgcgtccgggctggctgcttccacgagcaggagggagccgcaccgccgggctcccgcaatgtcgcctcctccgcccccgccgctgctgcgcaacgagctgtcgcgcacgacccccccgctggacctgcgacctggtttgctgccggccatccgccgccgcggccggccttcgtgtttgatcctcaagatctcctcctccctcccccctcctccgccccccccaccgatacgagacccaccgaatggacgcccccgcacccccccccgcgtccccccttccgaaaacaagccaaacccccaccctcggccccacccaccattcagtctatcccgccgaagttttcacagggcgcaccccaagaggcttgtccccatctctcatccttcttcccacccccttctctatctctcatactccccttcttccgttctctctcttacccgctcccacgctctacttcctctgaacacccccacacccccgggcctcaaccaccccccccgcctccccgcgccccccccaccccccccgcccccccgccccttcgcccccn

SEQ ID NO: 24406 - protein, 74 aa, Zea mays
  misc_feature: Ceres CLONE 1395501-F
MDAPAPPPASPLPKTSQTPTLGPTHHSVYPAEVFTGRTPRGLSPSLILLPTPFSISHTPLLPFSLLPAPTLYFL

SEQ ID NO: 24407 - DNA, 630 bp, Zea mays
  misc_feature: Ceres CLONE 1395505-R
  misc_feature (541)..(541): n is a, c, t, g, unknown, or other
tcgaggtcgacggtatcgataagcttttttttttttttttttgcctcatgtttctttcatttctcttgaggacgaacagacctgtctactaattcaatgttacaatatactgtggtttcatggcgggagcaaagagcctgagcgcctaataaagcctagatctctcctgtaaattcgaaaaaaaaagaatggtttcttccttaatgccatcatcctctcatcttaatgacagacatcacaacacagatgttcttttgaaacctcatctccccctccttttttcagtaatttggtttacatgtatatttgtgcaaaatcatcagggtgttttgttttcatttactcccttatggacccttgcgagaaagctgaatcaaagagttggctttcctctgcgctctacttgtacccgactttgcaatatcagacagatgttcttgcagacccaatccaagtgcgtgcgccataagggagttgttatgaagacctagctcgagcagaacagatagtgcacactccttgttcttgggagtcccttccnttgtgatctgaacaagaatctcaacaaaagacgttgtccccacttcacttcgacaaccagaatgtgatgccaggaggagaaaaatggaa

SEQ ID NO: 24408 - DNA, 749 bp, Zea mays
  misc_feature: Ceres CLONE 1395505-F
  misc_feature: Encodes the peptide sequence at SEQ ID NO. 24409
tggagctccccgcggtggcggccgctctagaactagtggatcccccgggctgcaggaattcgcacgagaccattacctagaacatcctaatcgaaaaatctatcacatcgaccgatccatgctgccgtggtccatctttccgcgacaggctcccgggggcgactcggagcctgagccagaggcgtacccgtccgaacagctgtcggacgaggccctggtggaggacctcctcgccgccctcgccgccgcgcggtcattccaggagttccgccgctcgcagcgcaaggagtcattcggtctccagcgctggctccagctcgtgctcccgctcatccaggagatccgcgagatcgcgccgtccctcagtgatgacgcctaccgccgcctcgccctcctcggtcgtgcattccacgctgctcgccggctcctccgctgctgccacgacggcagcaagatcttcctgtctttggagagcgaggctgtgctcgggcggttcagggccgtgtatgagaagatgaatcttgcattggatgggatgccttactctgagattggcatctccgatgaagtcaaggaacaggttgagctcatcaatgcgcaactgaagaggtgcaagaagagaagtgatacccaggacatggaacttctcatgggatttatgatgatactccagaacaaggacgggaatgcagatagagctatattggaaaggctagcccagaagctcgagctgcaaagcctggcggatt

SEQ ID NO: 24409 - protein, 210 aa, Zea mays
  misc_feature: Ceres CLONE 1395505-F
MLPWSIFPRQAPGGDSEPEPEAYPSEQLSDEALVEDLLAALAAARSFQEFRRSQRKESFGLQRWLQLVLPLIQEIREIAPSLSDDAYRRLALLGRAFHAARRLLRCCHDGSKIFLSLESEAVLGRFRAVYEKMNLALDGMPYSEIGISDEVKEQVELINAQLKRCKKRSDTQDMELLMGFMMILQNKDGNADRAILERLAQKLELQSLAD

SEQ ID NO: 24410 - DNA, 789 bp, Zea mays
  misc_feature: Ceres CLONE 1395507-F
  misc_feature (203)..(203): n is a, c, t, g, unknown, or other
  misc_feature (207)..(207): n is a, c, t, g, unknown, or other
  misc_feature (209)..(209): n is a, c, t, g, unknown, or other
aaagctggaagctcacgcggtggcggccgctctagactagtggatcccccgggctgcaggaattcgcacgagaccattacctagaacatcctaatcgaaaagagactctgagtctcgctcgcaccccgtcccccgcagcctgtgctctgggttggagggaggtgagctgcgagggagcgcggagggggcgaggagatggaggnagananggggaggacgagacgcggatcgatgagacagaaccacaaggaggggccaggaccgacggacctgccgatcggggagaaccgaggccccctactcgaataagactcagatcttctttgttttgtaaatctatcccaaacacacattgcgtacaaaagatggaaggccggtacgggttgaaagatggtacccgccggcagccgctttttttcccacccaacatcgcccaaaatctcccgccaacaacacgggcgcccaccataacataaaataaaccctcgcccgcgcggtttacctactaccgattattcaccgtacacacacgttcgcgaattgagtgatatattgggcggagcagccacaatgcctcaaaatacgggcgcgattaaccgtcgcccttttccgaggaggttggaccatacctctaagttcgtgttttaatacacaggtacaatccataaacacagccgccgcccctgttgaccacctatcgcggtcttccaaacgaaggtgaatggaggaacgaaagcggccgaggaaccaacagggatataagaacaggagtttttgctacactatgag

SEQ ID NO: 24411 - DNA, 671 bp, Zea mays
  misc_feature: Ceres CLONE 1395517-F
  misc_feature: Encodes the peptide sequence at SEQ ID NO. 24412
  misc_feature (511)..(511): n is a, c, t, g, unknown, or other
  misc_feature (520)..(520): n is a, c, t, g, unknown, or other
  misc_feature (559)..(559): n is a, c, t, g, unknown, or other
  misc_feature (596)..(596): n is a, c, t, g, unknown, or other
aagctggagctccccgcggtggcggccgctctagaactagtggatcccccgggctgcaggaattcgcacgagaccattacctagaacatcctaatcgaaaaccccatctcgcccgccgttttcgtccttatcgatctcctcgcacctcgtggcggcacctctccccttcgatccaccaagggtttaggatcggcggcgatggcggcgaggctggcacagctgcgcgctcaggcggtgcaggcggcggagttcgcctcgaagcacggcggctcctactacaaggagctcatggagaagaacaagcagtacgtcgtgcagccccccaccatcgagaaatgccaggagctctccaagcagctcttctacacccgcctcgcaagcctaccaggtcggtatgagtcattctggaaggagcttgatggtgtcaagcaggtatggaagaacaggaaggacctcaaggttgaggaccttggggatgcgactttatttggagttgagctttatgcatggntctgcgtangcgagattgttggcagaagtttcaccttaaccggctatnaggtctagttgatttccagtgatttaagacctgcttnataaatcgacaccttagctgatgcttggcgaaacgaccatgatacctgccttcctcacaattttgtttcctggaa

SEQ ID NO: 24412 - protein, 122 aa, Zea mays
  misc_feature: Ceres CLONE 1395517-F
  misc_feature (8)..(122): Pfam Name: ATP-synt_G Pfam Description: Mitochondrial ATP synthase g subunit
  misc_feature (105)..(105): Xaa is any aa, unknown, or other
  misc_feature (108)..(108): Xaa is any aa, unknown, or other
  misc_feature (121)..(121): Xaa is any aa, unknown, or other
MAARLAQLRAQAVQAAEFASKHGGSYYKELMEKNKQYVVQPPTIEKCQELSKQLFYTRLASLPGRYESFWKELDGVKQVWKNRKDLKVEDLGDATLFGVELYAWXCVXEIVGRSFTLTGYXV

SEQ ID NO: 24413 - DNA, 678 bp, Zea mays
  misc_feature: Ceres CLONE 1395518-F
  misc_feature: Translation starting site: 294
  misc_feature (1)..(1): n is a, c, t, g, unknown, or other
  misc_feature (16)..(16): n is a, c, t, g, unknown, or other
ntttgaaaataaaaangataattaaatatttttaaaaaggaataaatgggtacaacaaacaaccaaagtggggctccccgcggtggcggccgctctagaactagtggatcccccgggctgcaggaattcgcacgagaccattacctagaacatcctaatcgaacaaatttatttcctccgcttcagctcccattctccgccaaataaacccccgaaaagcaggagaggcgagacccggaagtggaaggctagggttagggtcccagctccccgttgcctgggcgagccgagtgatggccgcccctgccccctccggcgcagctagtgccgccgcctcaccgtccccgctgatgcagctgccgtcgccgttcgcggagctcgtcaagggcccctccggcctcgagaaggtcgtgcttcgcggcgctcgcaactgctgtgccgagatttatcctttatggaggtcaagtaacatcatggaagaatgacaatggggaagacttgcttttcctcagcagcaaggctattttcaaacctccaaaagctattcgtgggggtataccaaatctgctttcccccaaatttggatcaccagggaaaatctttgaaacaacttggaattccgctagaaaccgggttttgggaactattggacaaacaatcccaccccccctttaaccc

SEQ ID NO: 24414 - DNA, 593 bp, Zea mays
  misc_feature: Ceres CLONE 1395521-F
  misc_feature: Encodes the peptide sequence at SEQ ID NO. 24415
  misc_feature (276)..(276): n is a, c, t, g, unknown, or other
  misc_feature (329)..(329): n is a, c, t, g, unknown, or other
aagctggagtccccgcggtggcggccgctctagaatagtggatcccccgggctgcaggaattcgcacgagaccattacctagaacatcctaatcgaaaactcacctgcagtcccgctccccaccccgccaccaccgacgctgggatgaaggccgtgccagccgacagcgccgcgcccccggtgccgatgccgatgccgatgccggcgaccaagatcaccattcccgtttccgcggtgggcggcacggaggcggcgctcctcgggaaggggcggtancaggtctggggcttgggcgccatcgcgctcctcgcgctctggtccatgtccgncggctccgtctcactccggtggtcctcctcgggtgacctcgctccgtctacggggacctgaacgtcccgttcgccgacgacctcgattcccttgaaatggagggaaagggaaaatttagtgggacgaatgggggaacatgaacccccggacccaggggatgagggacggtttcccacgggtttgggaaggaaggggttttgagggttggaaaaacaaagaaattggctgggggaaaaaaaggccaagcccccggaaagcactta

SEQ ID NO: 24415 - protein, 81 aa, Zea mays
  misc_feature: Ceres CLONE 1395521-F
  misc_feature (44)..(44): Xaa is any aa, unknown, or other
  misc_feature (62)..(62): Xaa is any aa, unknown, or other
MKAVPADSAAPPVPMPMPMPATKITIPVSAVGGTEAALLGKGRXQVWGLGAIALLALWSMSXGSVSLRWSSSGDLAPSTGT

SEQ ID NO: 24416 - DNA, 1045 bp, Zea mays
  misc_feature: Ceres CLONE 1395522-R
caaattgggtaccgggccccccctcgaggtcgacggtatcgatactcttcttttttttttttattcacacttagtaattgctaataaaattttgaccaacttctaaaagcaatgctcagcctcagcccttactttgttgatcagccttacacttcacatgaactcccacctttgttgagttcatgtcacattattccccacaacttgttgatcgatgaacgtatgtgagctaactcttgctgtctcacacccccccacaggataagaaccggtggtcgaagaggaaccgcctaacactgaggcattcgacttgatctaggtggcgtttctcagttgacattggcaccgacgatccgtagttcgttttatgtatgacaccttattctagaagaaagtacgtccgctggcgcaaaaattactcgggatgattttaggacatttgatactccattaacactcctaaaaatgaaaattaggttggtccctccttgcgccaaagtaatcataaaggccccccagggacttttgccctttttaaaaaaccggggaggtttacaacataaacattatggggccaccaaataaagatatgacccccaatttaaaaatgaccgagcgcgcgaattaggggggggatggtgaagagtggccgtgggagggggaactcgataggggaggatgagaaatgcgtagctgagagggtgaatatacgcatagggttgggtaccatatactggggtaaaaattaaatcccgataacacctcttcttaaagagggttaatctaagcaagtaaccctgaaatttatttaccaccccctcggcaatatcctctattataaaatatattgaaaaaaacagggccctgcctctctacacccaccaaagaaagaaagcgttaattatatgtccgaattgaaggtgtgggatggagcttggggaggggagggccacatatgtatgggtgtgtgggggggaaagtatgaggggcgcgatgtaacgagagcgggtggtataggttagagaggagggtttatatcttgccg

SEQ ID NO: 24417 - DNA, 737 bp, Zea mays
  misc_feature: Ceres CLONE 1395522-F
  misc_feature (667)..(667): n is a, c, t, g, unknown, or other
aaagctggagctccccgcggtggcggccgctctagaactagtggatcccccgggctgcaggaattcgcacgagaccattacctagaacatcctaatcgaaaaaggaggacaagatagacgacacagcacctttttgggttgccccttccctttccccgcgtggcgatcgtagggttctccgcgagtgaggaagagtactgcgcgtcctccgtgacttcctggagatcgctggggcttctggacgttggtgtttcatttgcatgtctgccggctgccatgaggcgtgccgagatgtacctgatgatgacgtcgacgatgaaggagcagtgcgccgccgggagtataccgcctcatccagtacgacctcgccggcgctccgctcggctccggcgccgcggtcctcaaccaccacgctgccgcgctcccgatccacgacggcgaagagctctcccgctccgccctcgacgagccgatccttgacgtcccgctctctttcctcagagagtacctggagcagaaaaaacatctggggggattactcattctgctcccgacaaataatgactgtgtggatgacaagggcaattcaaaggtgtactgactgagctggagaagtgcttctgcatgaacaagttcatatccggggactttgctgtgcgtgacgacnatcttgatagctgctggcagatatcataaaattgcctcacaggtcaacaggctctgcaactacagaggtc

SEQ ID NO: 24418 - DNA, 695 bp, Zea mays
  misc_feature: Ceres CLONE 1395534-F
  misc_feature: Encodes the peptide sequence at SEQ ID NO. 24419
  misc_feature (372)..(372): n is a, c, t, g, unknown, or other
  misc_feature (509)..(509): n is a, c, t, g, unknown, or other
aagctggagctccccgcggtggcggccgctctagaactagtggatcccccgggctgcaggaattcgcacgagaccattacctagaacatcctaatcgaaaaatcgcttcagctcggcgtcttcacaaacgccggcgcaaactctcgcccgagcccgacagatcttcaattccccattccgcccaccgatcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatgggcaaagtgctggnagatagaccgcgggacatcacgatgatgccttcagcaccttcttcagccagactggtgctgggaagcacgttccccgtgcaatctttcgtgatctagaacccactgtgatcgatgaggtgcgcactgggacgtaccngccagttcttccaccctgagaagctcatcaggggccagggaggatgccgcttaacaatttggccgggggcccctacccaattggaaagaaaattgttgatttgggcccttgaacgaatcccaaggtttggttgaaaaatggacccgccctccggggttttcgggttcttcaggggccggggggggg

SEQ ID NO: 24419 - protein, 39 aa, Zea mays
  misc_feature: Ceres CLONE 1395534-F
MRECISVHIGQAGIQVGNACWELYCLEHGIQPDGQSAGR

SEQ ID NO: 24420 - DNA, 751 bp, Zea mays
  misc_feature: Ceres CLONE 1395540-F
acagctggagctcaccgcggtggcggccgctctagactagtggatcccccgggctgcaggaattcgcacgagaccattacctagaacatcctaatcgaaaaaaaaagcagcagcagcagaccttcttgacctagcaagcaatggggccgccgttcctcgccgtcgccgtcatcgtcgccttcctggccgccgccgcgcaggccgccgaccccttcgccttcttcgactgggacgtctcctacatcaccgcctcccctctcggcgtcccgcagcaggtcatcgcagtcaacaagcagttccccggccctatcatgttcgtctctaccctctacaatgcgttcgtccttgtgctcttccgcttagacgcccccgtgggcgtcccctgtcctcgccttctgccgctgcccgattcgctggcacgatgcggccctttcgcctctttctgttacgttttccgccgccccggcccctcgcccctccgtatccccgatcgctggtgcccggctggtcctctctcctctctcgtccccccccccccgcccttaaatatcgctctcgtttcgcctcccccccccccccccccgattcccgcctcccccgtcttttcccgcaccccatgcggcccctctcttatcgcatgcccccgcggccccgccgcccccggcgtcgggttaagttggattcgtatggcccccgccccctcccccgttcccgccctccccttctctcttcccacccccccttccctccc

SEQ ID NO: 24421 - DNA, 687 bp, Zea mays
  misc_feature: Ceres CLONE 1395544-F
  misc_feature: Encodes the peptide sequence at SEQ ID NO. 24422
  misc_feature (196)..(196): n is a, c, t, g, unknown, or other
  misc_feature (422)..(422): n is a, c, t, g, unknown, or other
  misc_feature (538)..(538): n is a, c, t, g, unknown, or other
tggagctccccgcggtggcggccgctctagaactagtggatcccccgggctgcaggaattcgcacgagaccattacctagaacatcctaatcgaaaaaagcgagcgtgaggtggtggacggaaccgtcgcctgctgcgggctgcctacgagatctaggcgagcgagcgagcgcggccatgggtgctcgctgctccnagctctccgtctgctggtggcctccccgcttcaaatcgccgatgctcgagaatggcgccgccgaagatgacggcagcggcgtgccggtgttcgccgagtacagcctcgccgagctccggggggccaccgacggcttcgccaccgaccgcatcgtgtcggagcacggcgagaaggcgcccaacgtggtctaccgcggcacgctcttcagctccggccgcaccgtcgncatcaagcgcttcggccgctccgcctgggcggactcacgacaggtcctggagggagcgagggctggtgggcagctgcgcagtcgccggctgggcaatctgatcggtggctgctacnagagccgcgagcgtctcctcgccgccgaggtcatgccgcccgagaccttgggaaagcatctttttcactgggaagaccattcccgttggagtgggcaatggaggacgagggcttgcattttagggggcaaaaggggtgggaaacctggg

SEQ ID NO: 24422 - protein, 170 aa, Zea mays
  misc_feature: Ceres CLONE 1395544-F
  misc_feature: SWISSPROT Homolog: EC 2.7.11.1 Non-specific serine/threonine protein kinase
  misc_feature (7)..(7): Xaa is any aa, unknown, or other
  misc_feature (82)..(82): Xaa is any aa, unknown, or other
  misc_feature (121)..(121): Xaa is any aa, unknown, or other
MGARCSXLSVCWWPPRFKSPMLENGAAEDDGSGVPVFAEYSLAELRGATDGFATDRIVSEHGEKAPNVVYRGTLFSSGRTVXIKRFGRSAWADSRQVLEGARAGGQLRSRRLGNLIGGCYXSRERLLAAEVMPPETLGKHLFHWEDHSRWSGQWRTRACILGGKRGGKPG

SEQ ID NO: 24423 - DNA, 742 bp, Zea mays
  misc_feature: Ceres CLONE 1395550-F
  misc_feature: Encodes the peptide sequence at SEQ ID NO. 24424
  misc_feature (625)..(625): n is a, c, t, g, unknown, or other
  misc_feature (628)..(628): n is a, c, t, g, unknown, or other
tggagctccccgcggtggcggccgctctagaactagtggatcccccgggctgcaggaattcgcacgagaccaacctagaacatcctaatcgaaaagaacacgatccctttctcccctttccctgcgtagtgcggagctccagtgaaggaaccaaacagcgcaacacacgaacacaccaggcggcaggctccaccccgtccttttcctgccttttccccccgtcgagttaatccatccagtcgccaaaagctttgctaaatttcacgtgtctcgcctcgagtcgtccctaatccgacgatgccttgttctactcctaaaaaaacccaaagatcctgactttctcttgctgctagcctcccttttcccttctcccttaatcgcactgttggaagctcttcgctgtcacccccacccacctccggcgctcttttttagcattttccttgggctctggactccaaaatcccagccttttgtttgcttctctgtctcttgctgatgggtgtccccgggtccaggactcttgatttgctcctcgcgggggttcggtcccatggcggcagctgcgctggcaatggcagagaaggtggtgcccgagctccgagtgaggtgtgagacgccgccntcnatgctgcgcgaggtggcccgtgaaatggcccgcaagatgggcgcggggcttgaaaaaggacgccggaacaaggccaaatcgtccctctctacgtcgaaagctccccacgggaaa

SEQ ID NO: 24424 - protein, 63 aa, Zea mays
  misc_feature: Ceres CLONE 1395550-F
  misc_feature: SWISSPROT Homolog: EC 2.7.1.1 Hexokinase
MAAAALAMAEKVVPELRVRCETPPSMLREVAREMARKMGAGLEKGRRNKAKSSLSTSKAPHGK

SEQ ID NO: 24425 - DNA, 847 bp, Zea mays
  misc_feature: Ceres CLONE 1395551-F
  misc_feature (15)..(15): n is a, c, t, g, unknown, or other
  misc_feature (16)..(16): n is a, c, t, g, unknown, or other
  misc_feature (18)..(18): n is a, c, t, g, unknown, or other
aataattagataggnngnaggggtgctctgttcgttgtactccccccctctcaaagctggagctccaccgcggtggcggccgctctagaactagtggatcccccgggctgcaggaattcgcacgagaccattacctagaacatcctaatcgaaaacccgggatcctcgttttgtttcccttcccccacccttcctcttcctccctatctatcagcactgctcgccggcgccgcctctgcaaaaggctcacttttgcctccggaacccagcggaatccgccggcggaccggaaacactcgctcggccccctcaccccctgtctgcccggacgtcggagcgcgtcccctccgggcgcgcaccagcagtccgtgcaggtggagcccggaggaggaagaaggcggacgaggccccagtcactaatctgccggagagcgggcacagcaggaaaagaggatggttccggctcgccgctcggacccccaagcctacccgattggcccttggccctggcaccagcgggaaaagagcggaaccctttggccgcagcccacctaacgaggtggtgtcctgcgtctgggtcccaaaaacaaaggcctgccacgcctcctctctcacgaaatgatttttgactcggcctagccctgccctctcccaccccatgccctccccccccaccccgcacaccagagcggacatcaatttcttcgcacgggtctatcgtccaactcgctgcattttcgcaaagcaaacagaccgcgcctgctgggcttccgtcggccctatgcacctcgccctcccccaaaaacgctaccccccccccctccttctcctcttcccgccctctctc

SEQ ID NO: 24426 - DNA, 724 bp, Zea mays
  misc_feature: Ceres CLONE 1395552-F
  misc_feature: Translation starting site: 288
  misc_feature (480)..(480): n is a, c, t, g, unknown, or other
  misc_feature (617)..(617): n is a, c, t, g, unknown, or other
aaagctggagctccccgcggtggcggccgctctagaactagtggatcccccgggctgcaggaattcgcacgagaccattacctagaacatcctaatcaaaagtttatacgttcagggctactattgaagcagactccacccggcgcgtcctcgtctcgtctcgtctcgcacgcacccctcactttccttgtcaatcgactcgcgatcgaatccgccccgagtcgattccgccgcggaccgcccggttcacttcccttttctcccgagatctcgactctcgagcaagtatgggtgaggcgaaggacaacgaggtgtacgaggaggacctagtcgactatgaggaggaggtggagaatgtcattgatggcgcccccaccaacggctcctcagatggtcgtcaagaaggggtacgtagggatcaccagcttcggggttcagagacttcctgctcaagccagagcttcttcgcgccatccaggnatatggcgggtttgagcatcccttctgaagtgcaacatgagtgcatccctcaagctattcttggggaatgggatgtcatctgtcaagcaaaatctggaatggggtagaaatgggcagtttttgtcctgtcaactctncagcagatttgatccctgttgctggccagtagctgcgacccttgttgttgtgccacacaagagaattagcttaccagatttgcatggaaattttgagaggtttagca

SEQ ID NO: 24427 - DNA, 642 bp, Zea mays
  misc_feature: Ceres CLONE 1395554-F
  misc_feature: Encodes the peptide sequence at SEQ ID NO. 24428
  misc_feature (354)..(354): n is a, c, t, g, unknown, or other
  misc_feature (356)..(356): n is a, c, t, g, unknown, or other
  misc_feature (382)..(382): n is a, c, t, g, unknown, or other
  misc_feature (426)..(426): n is a, c, t, g, unknown, or other
  misc_feature (517)..(517): n is a, c, t, g, unknown, or other
aaagtggagtcctcgcgggcggccgctctagaatagtggatcccccgggctgcaggaatcgcacgagaccattacctagaaatcctaatcgaaaagttgggtgccgtgcgagctccaagtacccctgtctccctcccgtcttgcgggcttgcctttgcctgttccatttccggctcctccagttggtagtgtcgtttcaatgcgagagccgtccttccgagcttgattgcccttgaagcgaattggtgttgtgtcgttgccggtgaggaggagaggggaatatggctcccacggaagaagcagcaggggaggacgagcggctgctgaaagatcttctcgcttcttcgtcagatnangaaggagaggatgaagagagtacaangacacagtccgatgaatctactaaggggggattgtgataacggncgggtcccgtagccgccttatcgaagtgaagatgtcaatgatagggcatggtaagtgacagcaacaggccaatgtgctgaaatctgatggngcgttgcaatcaaagggcttggaacaaggttccaaaagcaccaaccattaaggggggggcttaaatgccttcaacccggttcccaaagacgttattggttgaaaattgccgggtggggcttaata

SEQ ID NO: 24428 - protein, 45 aa, Zea mays
  misc_feature: Ceres CLONE 1395554-F
  misc_feature (25)..(25): Xaa is any aa, unknown, or other
  misc_feature (34)..(34): Xaa is any aa, unknown, or other
MAPTEEAAGEDERLLKDLLASSSDXEGEDEESTXTQSDESTKGGL

SEQ ID NO: 24429 - DNA, 681 bp, Zea mays
  misc_feature: Ceres CLONE 1395555-F
  misc_feature: Encodes the peptide sequence at SEQ ID NO. 24430
  misc_feature (528)..(528): n is a, c, t, g, unknown, or other
aaagctggagctccccgcggtggcggccgctctagaactagtggatcccccgggctgcaggaattcgcacgagaccattacctagaacatcctaatcgaaaaattttcttctcccgttcacttctctttggcccgaaaccgaaagctagtgcttgattcggtcgtttttgggcaccgaacacgttcttgggaccgccgccgccgccctacttccagtcccagctgctcaggtctccatcggcctcgagccctttgccggcgacgagcactcacaacaccagggtgtaacaatgtcttcttcaatggaatcgtcataccttcctgctacaactgagtcattagcccaagctcaagaggctaaggatgcttcagagtccatttcaatcctttaccgtgtcattcaggacccatcttcttctgctgatgcactgagaacaaaagaagttgcaattacaaatcttacaaactacctcactaaagaaaacagagctgaggagctgcgtaatcttttgacccagctcagaccanttttttgcagttattcctaaggcaaagactgcaaaaattgtccgtggaataaattgatgctgtcgccaagatacctggaacatcagatcttcagatttcactctgcaaaggaaatggtagaatggacccgtgcagagaagcgtactttcctcc

SEQ ID NO: 24430 - protein, 85 aa, Zea mays
  misc_feature: Ceres CLONE 1395555-F
  misc_feature (80)..(80): Xaa is any aa, unknown, or other
MSSSMESSYLPATTESLAQAQEAKDASESISILYRVIQDPSSSADALRTKEVAITNLTNYLTKENRAEELRNLLTQLRPXFCSYS

SEQ ID NO: 24431 - DNA, 658 bp, Zea mays
  misc_feature: Ceres CLONE 1395556-F
  misc_feature: Encodes the peptide sequence at SEQ ID NO. 24432
tggagctccccgcggtggcggccgctctagaactagtggatcccccgggctgcaggaattcgcacgagaccattacctagaacatcctaatcaaaaatccaactcacacacaggctcaccccaccaacagcaagcgaaaatctcccgatcccctctggtctccgcggcgaagatgtcggggcgcggcaagggcgggaaggacctgggcaagggcggcgcgaagcgccaccggaaggtgctccgcgataacatccaggggatcacgaagccggcgatccggcggctggcgcgcaggggcggcgtgaagcgcatctccgggctcatctacgaggagagccgcggcgtcctcaagatcttcctggagaacgtgatccgcgacgccgtcacttacaccgagcacgcgcgccgcaagaccgtcacagccatggacgtcgtctacgcgctcaagcgccagggccgcaccctctatggcttcggcggctaggctaggccggccgcgcctcgctgtcgtcgctgcgggtctattgtttttgcaattcccaagtaggggctcggtggcaaaaatgctggttactggggaactaaaccaagcaggttggggcgggctgaaaaaaggccattggggacttgctgtttgtccaaaaaaaaaaaaaaaaaa

SEQ ID NO: 24432 - protein, 103 aa, Zea mays
  misc_feature: Ceres CLONE 1395556-F
  misc_feature (25)..(94): Pfam Name: Histone Pfam Description: Core histone H2A/H2B/H3/H4
MSGRGKGGKDLGKGGAKRHRKVLRDNIQGITKPAIRRLARRGGVKRISGLIYEESRGVLKIFLENVIRDAVTYTEHARRKTVTAMDVVYALKRQGRTLYGFGG

SEQ ID NO: 24433 - DNA, 741 bp, Zea mays
  misc_feature: Ceres CLONE 1395557-F
  misc_feature: Encodes the peptide sequence at SEQ ID NO. 24434
ccgcgctggagctcaccgcggtggcggccgctctacactagtggatcccccgggctgcaggaattcgcacgagaccattacctagaacatcctaatcgaaaaatattctcccaaaaaacccaacactccagtggcggcaaagacctaacatttcaaaatcaatggccaagaaccccaaggcgcccgacacccgcagtggccgttctcccaccagaaggccccgaccacgccgcgccaaggcggtgccagaagcctcctccgcagctgatatcgaagacctgggtccctcagtgcctgggcgcgctgcccctggggctgccgcacccagggccttgcccgcacacgctcctcagggggtacgatttttcccggaccgccaccgcatgcgtactcgggttcacttttttcacgatttcttgcccccccatcccccataacgcgaaaccctcccccctggggccggcggacgcaccccgaatgaccagatgtcgaaagcgcaccacatgccgcccggcacttccgccctccccccaccccggacacttgccgccgttaccctccccgcccccaaccacccacaacccctctctcggaaggatcccgccactaaatggaatgcattattaaggcatttccgcgtcaccacgggggccacgagtggcgtaagagtaaaattatgagtcccccccggaccccccgaaccctcctatccacgtactctccccccccccttctcatccg

SEQ ID NO: 24434 - protein, 91 aa, Zea mays
  misc_feature: Ceres CLONE 1395557-F
MAKNPKAPDTRSGRSPTRRPRPRRAKAVPEASSAADIEDLGPSVPGRAAPGAAAPRALPAHAPQGVRFFPDRHRMRTRVHFFHDFLPPHPP

SEQ ID NO: 24435 - DNA, 635 bp, Zea mays
  misc_feature: Ceres CLONE 1395567-F
  misc_feature: Encodes the peptide sequence at SEQ ID NO. 24436
ccccgcggtggcggccgctctagaactagtggatcccccgggctgcaggaattcgcacgagaccattacctagaacatcctaatcgaaaaatcactgattctgattctgattccagccaccctgaccggcgaagcgcggctgacatttcccccccaccataccgccaccacctgagaagagatcgatccaatcagattaaccaattagcagggagggaggagaggggcaaaggcaatggccgggacggaggtggaggacccgccggcggcggcgttggaggtgcccgcgaaacgcggccttctgcggtacaactcgccgctggcgcaggtgtccctgctgggcctcatctgcttctgctgccccggcatgttcaacgcgctgtcgggcctcggcggcggaggccaggtcgaccccaccatcgccgacaacgccaacaccgcgctctacgcctgctttccggagttcggcgtgctgggcggcgccgcgcacaacctgctgggcccgcgcgcgacgctgctggccggcgcgctcacgtacccgctctacgccggctcccttcctctactacaaccaccgcccgggctcggaggtgttcccccgcacggggggcgcccctgctccgagcccggatcgg

SEQ ID NO: 24436 - protein, 133 aa, Zea mays
  misc_feature: Ceres CLONE 1395567-F
MAGTEVEDPPAAALEVPAKRGLLRYNSPLAQVSLLGLICFCCPGMFNALSGLGGGGQVDPTIADNANTALYACFPEFGVLGGAAHNLLGPRATLLAGALTYPLYAGSLPLLQPPPGLGGVPPHGGRPCSEPGS

SEQ ID NO: 24437 - DNA, 706 bp, Zea mays
  misc_feature: Ceres CLONE 1395568-F
  misc_feature: Encodes the peptide sequence at SEQ ID NO. 24438
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (23)..(23): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (706)..(706): n is a, c, t, g, unknown, or other
nnnnggggnnnccccccccccancccccgggcgggccccnnnnnntttaannnnnnccaaggctggagctccccgcggtggcggccgctctagaactagtggatcccccgggctgcaggaattcgcacgagaccattacctagaacatcctaatcgaaaactccaagaccaagaccaacaccactccactccctccatttccctcacctcccgcagcagctagccgccagccaacaaccgaaccaaccaaccaacccacaggccacagcgagcgagtaaagcgtccaatggtagcgatggcggccgtgcagcagcagcagcagcagcagcgccgcgacgcggaggcggagctcaacctgcccccgggcttccggttccacccgacggacgaggagctggtggcgcactacctctgcgcgcgcgccgcggggcgccgcccgccggggtccatcatcgccgaggtcgacctggaccgcttcgacccctgggacctgccggagcgcgccctcttcggccgccgcgagtggtacttcttcacgccgcgggaccgcgagtaccccaacggttcccgccccaaccgcgccggccgggtcggggtactggaagggcacggggggcggacaagcccgggggagcaaggggggccgggacggggggggaatcaaagaagggggctcgggggttctacccccgggaaagccccccn

SEQ ID NO: 24438 - protein, 136 aa, Zea mays
  misc_feature: Ceres CLONE 1395568-F
  misc_feature (21)..(117): Pfam Name: NAM Pfam Description: No apical meristem (NAM) protein
MAAVQQQQQQQRRDAEAELNLPPGFRFHPTDEELVAHYLCARAAGRRPPGSIIAEVDLDRFDPWDLPERALFGRREWYFFTPRDREYPNGSRPNRAGRVGVLEGHGGRTSPGEQGGPGRGGNQRRGLGGSTPGKAP

SEQ ID NO: 24439 - DNA, 753 bp, Zea mays
  misc_feature: Ceres CLONE 1395569-F
  misc_feature (667)..(667): n is a, c, t, g, unknown, or other
aagctggagctccccgcggtggcggccgctctagaactagtggatcccccgggctgcaggaattcgcacgagaccattacctagaacatcctaatcgaaaaatcgatcgtctatgcaagtttgcccattcgcattgatctgaatactgtacctactagtgcgagtgccactgtgccgcacctgcctgctcgccattactgcaagctgtgttcagtcgacgcttatttaggctctctcctacatctgatcccgctatgtagctagccaccactacataagtgccgcgccgagaatcacgacacacatcagatggcgcgctagccaagctgagctccgtgcgaccaacaaatgccccgaattagtaaggataatgctgggcgcccactccttggtgctccaacctcccccttggaaaataatccgtcatccggcttccgcgggcttggaaacctggaaccccctttttttcaaagggggaaaacccacctaccccccgcgggtggggccgggaaacttggggggaaaaatctaacttcccgggggggttcccccccttccttgcccccccctggggggggcgcccccctcccaaatctgggcgggtggtgcaccccattgggggcttttgggcccaaaaaaatctttttcccacaaaaccccccctccncttccttgtcccgggggaaatacaccagccccccccctttagggggggggaaaaaagagaaaaacacatttccctaaaaccacgtg

SEQ ID NO: 24440 - DNA, 734 bp, Zea mays
  misc_feature: Ceres CLONE 1395570-F
  misc_feature: Translation starting site: 429
  misc_feature (427)..(427): n is a, c, t, g, unknown, or other
  misc_feature (428)..(428): n is a, c, t, g, unknown, or other
  misc_feature (452)..(452): n is a, c, t, g, unknown, or other
  misc_feature (482)..(482): n is a, c, t, g, unknown, or other
  misc_feature (514)..(514): n is a, c, t, g, unknown, or other
  misc_feature (515)..(515): n is a, c, t, g, unknown, or other
  misc_feature (682)..(682): n is a, c, t, g, unknown, or other
aaagctggagctccccgcggtggcggccgctctagaactagtggatcccccgggctgcaggaattcgcacgagaccattacctagaacatcctaatcgaaaaacacacggaagaagccactagctctccgctctcgcctctcggccttctccttgtgccgccgaacaccctcacaagagtcggcctctcgatttctcagtccagccgcagcagcccccttccctccctcctccatcaggtgttgcctcccgcagatccaagtcggaattcggtccttcgtccccaaaccaccaatccggttgcattctttgggtttgctcacagcgcacacaaagccattttactgctgggaatggtggctggcacttagcgtctccggctcttgagtgatctccaagtcctttggatgctacagggaagtgagtgnnatgggggagtgcgaggacgcaagnagtacaggtgctgggaggagctgctgccgnacgcgctgggcctcatcttccgcaactggcgnntgcaggaggtgctcacgtcctgggcgcgggtgtgcagtcctggggggcggggtgggtgcccgcccctactggctggcagagatcgacatcgaggagtggagccagcagcagagcaagccggagcagatcgcccggatgccaaaactactcctggcccgcaacgccgntttctggccgccggaataagggtctccggcctggcctgggatccggggtttt

SEQ ID NO: 24441 - DNA, 681 bp, Zea mays
  misc_feature: Ceres CLONE 1395574-F
  misc_feature: Encodes the peptide sequence at SEQ ID NO. 24442
  misc_feature (681)..(681): n is a, c, t, g, unknown, or other
aaagctggagctccccgcggtggcggccgctctagaactagtggatcccccgggctgcaggaattcgcacgagaccattacctagaacatcctaatcgaaaaaactcgaaccgaagggacgaccgagcggagtctagactcgagagcaacctcgacctcccggatctctctcccacccacgcctcgtcggcgccgtcgtctgctgcagcgatggcctcccccgacctgctcttcaatctgcggaacctcttctacctgggcgcctaccaggcagccatcaacaacagcgacgtcccgggcctcgacggcgacgccgccgctgagcgcgacgccctcgtcttccgctcctacatcgccctcggctcctaccagctggtgatcagcgagatcgactcgtcagccgctacctcgctgcaggccgtgaagctgctcgcgctgtacctcactggagacaaggaaggtgctatctccagtctcaaggaatggttgagtgattcagcaattggaagcaatcctgttctgcggttgattgctgaatctctctccccaaactacccctcggcagcgcccggcgatgtggccaacgaagcccgatcgccctggccaggccgccgccggctccggcgagaagagctgacgggaggaggccgtggccacctgctcgctgcgactggtcgactn

SEQ ID NO: 24442 - protein, 157 aa, Zea mays
  misc_feature: Ceres CLONE 1395574-F
  misc_feature (3)..(157): Pfam Name: Coatomer_E Pfam Description: Coatomer epsilon subunit
MASPDLLFNLRNLFYLGAYQAAINNSDVPGLDGDAAAERDALVFRSYIALGSYQLVISEIDSSAATSLQAVKLLALYLTGDKEGAISSLKEWLSDSAIGSNPVLRLIAESLSPNYPSAAPGDVANEARSPWPGRRRLRREELTGGGRGHLLAATGRL

SEQ ID NO: 24443 - DNA, 895 bp, Zea mays
  misc_feature: Ceres CLONE 1395575-R
ccaattgggtaccgggccccccctcgaggtcgacggtatcgataagcttttttttttttttttttaaaccgaaagaaacttggctcttctttatggttaatagataatattcctatagaagaaaaggaaatgaactactgccaaattgcaaaaaatccaaagcatctgaaattctagatcttctacgctctaaacataaatcctcacttcttctaccaagcgtgcgacacaaactgaaagcagccagccgtccacctccatcgccaaactgtccgcccctcgtctcacacccaccatttattcctctgaatccatgcctgctactgaagagctgcccggcgtcttctcctctgatgccgtgccttctccagcggctgtccagtagcgcttgaaagggaagagcaccttctcacgcacgttggggccgtcctcatggtttgccagcagcgtctaccaacgcatccccttcaccgtcctctgcaccttgagaaggacatcgacgtcgacgcggaggatcacagttccctctgggcgcaggatccgatccatctccagcaggatgtcctccattctgcacctgcccttgtatacagtgaagatgccattggcaaccaatgaggtcgcatgttccttggataaattgaaaaagcctcacaccacccgtggaatatgccgaatgaaacccctcaagggacaccccgccccaggggtggaaatccccgggccgccctccggggaggaaggtttattgaacccaagacctttggggccaaaacaaaagggcgcgtgggaacaaaacccaaaacccacccccgggggggttcccacggtccccaaggaataattttccccgggttacacaggtttgcgcgttgttttcaaaccccctgtgtaa

SEQ ID NO: 24444 - DNA, 697 bp, Zea mays
  misc_feature: Ceres CLONE 1395577-F
  misc_feature: Encodes the peptide sequence at SEQ ID NO. 24445
  misc_feature (559)..(559): n is a, c, t, g, unknown, or other
aagctggagctccccgcggtggcggccgctctagaactagtggatcccccgggctgcaggaattcgcacgagaccattacctagaacatcctaatcgaaaaaattattgcctctctttcttgctcgccacagcttcgtcaaagacacgcggaaaagaagaggaagggggaggcgactcgaccgaggcccggtttcgatctctggtcctccgattgcgtccagatctaccagcaatggcatcatcttcggacccatggatgaaggaatacaatgaagcatccagacttgctgatgacatcagttccatgattgccgacagagggtctcttccacaatcaggcccagaaattatgcggcatacttcagccattcggagaaaaataactattcttggtactagactggatagcttggagtcattgtttggcagaattcctccaaagtcaatcactgacaaggagatgcataaacgccaagacatgctttcccagtttgaagtctaaagccaagcagatggcgacaagtttcaacatgtcaaactttcgctaacaggaaggantctgcttggtcaaagtaaaatgccagatgacatggagcagagttggctgggttagataaccaaggggaattggttgggccttcagagggcaaattatgaaagagccaagatgaggggtctcgaggaagctggggaaga

SEQ ID NO: 24445 - protein, 89 aa, Zea mays
  misc_feature: Ceres CLONE 1395577-F
MASSSDPWMKEYNEASRLADDISSMIADRGSLPQSGPEIMRHTSAIRRKITILGTRLDSLESLFGRIPPKSITDKEMHKRQDMLSQFEV

SEQ ID NO: 24446 - DNA, 656 bp, Zea mays
  misc_feature: Ceres CLONE 1395579-F
  misc_feature (579)..(579): n is a, c, t, g, unknown, or other
  misc_feature (593)..(593): n is a, c, t, g, unknown, or other
tccccgcggtggcggccgctctagaactagtggatcccccgggctgcaggaattcgcacgagaccattacctagaacatcctaatcgaaaagcaagaggtaacactcgcgtctcattctcccgttcttgaggggcaatcgcgaatcgcgctcctcgcggtagcggtcgattacccggctccgcccagatccgccgcggctgcgctccagttccctgtcgcgtgcgtagggctcctcgtccctccctctatccccggctgtgtacggactggggatcggggatccctccggaccgggataggattttcgttttgctggcgaggaagggagcttcccccgatagatgtctcacctccgataccctggatttcgtccgtggcgagtggctaccgcttctgctccttttgtgacagctgaatctttgtggttcgaaggcgattgacttgggttcactgacgcggtgacgcccaatgagctcccacgtctccacatcgcggggtcttcatcccccaggcaagctttgggacgttggactcacccggtgcgtggcagccgccagcacctatggctcagcccgagncaggccgcggtgantgaccagaggtcaggctggttgtcggttgcttggaatcaggactgtggatgcttcgctgccgg

SEQ ID NO: 24447 - DNA, 737 bp, Zea mays
  misc_feature: Ceres CLONE 1395581-F
  misc_feature: Encodes the peptide sequence at SEQ ID NO. 24448
  misc_feature (1)..(1): n is a, c, t, g, unknown, or other
  misc_feature (233)..(233): n is a, c, t, g, unknown, or other
  misc_feature (391)..(391): n is a, c, t, g, unknown, or other
  misc_feature (453)..(453): n is a, c, t, g, unknown, or other
  misc_feature (562)..(562): n is a, c, t, g, unknown, or other
naaagctggagctccccgcggtggcggccgctctagaactagtggatcccccgggctgcaggaattcgcacgagaccattacctagaacatcctaatcgaaaagaacccaagtcgaaaccctaacctcggccttgtcgatgtcggccgccacaaccgccccaacccctgcggtggccaccccgatggcgccgcctccgtcgtacccggcctcctccacgatctccgcctccgntgccgcgtcggtcgaggaagaggacgacctctatggccgcctcaagtcgctccagcgccacatggaggttcgtcgagaatccaggaggagtacgttaaagacgaacagaagaacctcaagcgcgaactcctccgtgcggcaggaggaggtcaagcggnatccagtccgtaccgctcgtcatcggccagttttatggagaatggtcgatggcaacaacggncatcgtgggttctactacgggcagcaactactaatgtgcggatcctcagcaccatcaaccgcgagctgctcaagccgtcagcatcctgtcgcgttgcatcgtcactccnacgctttttagtcgacgtgcttgccgcccgaggccgactccagattctcctttggctgggaatccgtcgggagaagcccaacgtcacctacacgaattttttggaggatgcgacatccaaaagcagaaataacgggaggggcgggtttgagttacccttgactccatcatgagtt

SEQ ID NO: 24448 - protein, 144 aa, Zea mays
  misc_feature: Ceres CLONE 1395581-F
  misc_feature (32)..(32): Xaa is any aa, unknown, or other
  misc_feature (85)..(85): Xaa is any aa, unknown, or other
  misc_feature (142)..(142): Xaa is any aa, unknown, or other
MSAATTAPTPAVATPMAPPPSYPASSTISASXAASVEEEDDLYGRLKSLQRHMEVRRESRRSTLKTNRRTSSANSSVRQEEVKRXPVRTARHRPVLWRMVDGNNGHRGFYYGQQLLMCGSSAPSTASCSSRQHPVALHRHSXAF

SEQ ID NO: 24449 - DNA, 709 bp, Zea mays
  misc_feature: Ceres CLONE 1395582-F
  misc_feature: Encodes the peptide sequence at SEQ ID NO. 24450
  misc_feature (365)..(365): n is a, c, t, g, unknown, or other
  misc_feature (366)..(366): n is a, c, t, g, unknown, or other
  misc_feature (627)..(627): n is a, c, t, g, unknown, or other
  misc_feature (628)..(628): n is a, c, t, g, unknown, or other
  misc_feature (632)..(632): n is a, c, t, g, unknown, or other
  misc_feature (633)..(633): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (680)..(680): n is a, c, t, g, unknown, or other
  misc_feature (682)..(682): n is a, c, t, g, unknown, or other
gctctagaactagtggatcccccgggctgcaggaattcgcacgagaccattacctagaacatcctaaaaaaaaagcagtccaaacacgcaacgcaacactcgccttcccctcccaaccctccgaaccgaagcagcaaagctagacgatgacgctgacgatcccggacgaggtgcgcgccaaggcggaggtgtacgtgggcgacgcggcggggcaggagaagacgcggctgctcctccaggagacgggcctcccgagcgggctgctcccgctgcgggacatcatcgagtgcggctacgtggaggagacgggcttcgtgtggctccggcagcgccgcagggtggaccactacttttcgcagggcggnncgcacgtgtcctacggcgccgaggtggtcgcgggtgcccgacagggccggttcaggaaaatcccgggcgtcagggccaggagatgctgctgggggcaaccctccaaaaatttgggggcaacgacccgccccttggaaggttcccctggaaagccttcgggggccgtgcccccaaatttccccgggggaggccttcaaggccaaaaacccgggccccccggaaccggggtgtcttccccgggccgggggggaaaggggggtnntttnnaaaaaaannnnnnnnnnnnnnnnnnnnnnnnnnngggnnnggggacngngggggaggagagaaaggggaagagccg

SEQ ID NO: 24450 - protein, 187 aa, Zea mays
  misc_feature: Ceres CLONE 1395582-F
  misc_feature (2)..(152): Pfam Name: DUF538 Pfam Description: Protein of unknown function, DUF538
  misc_feature (74)..(74): Xaa is any aa, unknown, or other
  misc_feature (161)..(161): Xaa is any aa, unknown, or other
  misc_feature (162)..(162): Xaa is any aa, unknown, or other
  misc_feature (163)..(163): Xaa is any aa, unknown, or other
  misc_feature (165)..(165): Xaa is any aa, unknown, or other
  misc_feature (166)..(166): Xaa is any aa, unknown, or other
  misc_feature (167)..(167): Xaa is any aa, unknown, or other
  misc_feature (168)..(168): Xaa is any aa, unknown, or other
  misc_feature (169)..(169): Xaa is any aa, unknown, or other
  misc_feature (170)..(170): Xaa is any aa, unknown, or other
  misc_feature (171)..(171): Xaa is any aa, unknown, or other
  misc_feature (172)..(172): Xaa is any aa, unknown, or other
  misc_feature (173)..(173): Xaa is any aa, unknown, or other
  misc_feature (174)..(174): Xaa is any aa, unknown, or other
  misc_feature (176)..(176): Xaa is any aa, unknown, or other
  misc_feature (179)..(179): Xaa is any aa, unknown, or other
MTLTIPDEVRAKAEVYVGDAAGQEKTRLLLQETGLPSGLLPLRDIIECGYVEETGFVWLRQRRRVDHYFSQGGXHVSYGAEVVAGARQGRFRKIPGVRARRCCWGQPSKNLGATTRPLEGSPGKPSGAVPPNFPGGGLQGQKPGPPGTGVSSPGRGGKGGXXXKXXXXXXXXXXGXGTXGEERKGKS

SEQ ID NO: 24451 - DNA, 658 bp, Zea mays
  misc_feature: Ceres CLONE 1395583-F
  misc_feature: Encodes the peptide sequence at SEQ ID NO. 24452
  misc_feature (595)..(595): n is a, c, t, g, unknown, or other
aaagtggagctccccgcggtggcggccgctctagaactagtggatcccccgggctgcaggaattcgcacgagaccattacctagaacatcctaatcgaaaaatcatatggcatagccccaagcccccaacggatcgagcgcctccccgagtccccgttcccctgccccagctgaccgccgccgagacgtgtgccacaccgcctccccctcccgccgccacaaccttcgcctccacgcaattggccgcactcctttccacctcccgctacaggatagcgtgggccggtcggcggcgccgacgggtggagaactggagatccacccgcacgcggactgcttccttcgctagtcgatgggaagtaagcgttgttaggtctcatgatttcttttgggagatccggagacctaacaacgccaacttccccatccagaagttcctgcaggcgcagagcatcgtggcgcccagcgcttacatctccgtggccacgctggcgctgcacctggtgctcagctgggtcgccgtctacaggctgggcctgggcctgctggggggctcgctcgtgctcagcttcagctggtgggtcatcgtcgcggnccagttcgggtacatcgtcaccagggcccggtgcagggacacctggacgggattcaccacgca

SEQ ID NO: 24452 - protein, 218 aa, Zea mays
  misc_feature: Ceres CLONE 1395583-F
  misc_feature (198)..(198): Xaa is any aa, unknown, or other
SGAPRGGGRSRTSGSPGLQEFARDHYLEHPNRKIIWHSPKPPTDRAPPRVPVPLPQLTAAETCATPPPPPAATTFASTQLAALLSTSRYRIAWAGRRRRRVENWRSTRTRTASFASRWEVSVVRSHDFFWEIRRPNNANFPIQKFLQAQSIVAPSAYISVATLALHLVLSWVAVYRLGLGLLGGSLVLSFSWWVIVAXQFGYIVTRARCRDTWTGFTT

SEQ ID NO: 24453 - DNA, 708 bp, Zea mays
  misc_feature: Ceres CLONE 1395588-F
  misc_feature: Encodes the peptide sequence at SEQ ID NO. 24454
  misc_feature (358)..(358): n is a, c, t, g, unknown, or other
  misc_feature (388)..(388): n is a, c, t, g, unknown, or other
  misc_feature (422)..(422): n is a, c, t, g, unknown, or other
  misc_feature (691)..(691): n is a, c, t, g, unknown, or other
cgctctagaactagtggatcccccgggctgcaggaattcgcacgagaccattacctagaacatcctaatcgaaaagatccgatggcccgcgccgccgctcgcctcctccccatcttcctcccatggcggcgtcctcccccgccctgcctcctccgccggggcttcctaaaccctagcagccccagaacctccgcgcgcgtcgacaccctcgttctccctggagacgagcgcttgcccttcccctcgcccccacgcctcccgaaccagctgcgtcctgactacgggagtggcggcggaggcggcgctccctcgaccatcgcggccatcgtcacctcactcggcggaggccctgcagcgntggggatcgtgcggatctccggccccgatngcgtcgccgtcgccgaccgcgttttccgcccagncgggaccaggagggcgtcgacgccgtggcaaccgcgcagccacttttgtgagtacggactcgcgctcgacgcggacggcagcgtaattgacgaggttttgggtggtgccatgctctccccgaggtcctacacgcgagagggatgtgtggagcttcagtggcatggcaacgatctctgcttggcgcgcgggctcagggcttgctttggagctggaccaaacttgctgatcctggggagtcaccctttcgggcattctggaatgaaaggtngacttggccaaggggga

SEQ ID NO: 24454 - protein, 209 aa, Zea mays
  misc_feature: Ceres CLONE 1395588-F
  misc_feature (93)..(93): Xaa is any aa, unknown, or other
  misc_feature (103)..(103): Xaa is any aa, unknown, or other
  misc_feature (114)..(114): Xaa is any aa, unknown, or other
  misc_feature (204)..(204): Xaa is any aa, unknown, or other
MARAAARLLPIFLPWRRPPPPCLLRRGFLNPSSPRTSARVDTLVLPGDERLPFPSPPRLPNQLRPDYGSGGGGGAPSTIAAIVTSLGGGPAAXGIVRISGPDXVAVADRVFRPXGTRRASTPWQPRSHFCEYGLALDADGSVIDEVLGGAMLSPRSYTREGCVELQWHGNDLCLARGLRACFGAGPNLLILGSHPFGHSGMKGXLGQGG

SEQ ID NO: 24455 - DNA, 687 bp, Zea mays
  misc_feature: Ceres CLONE 1395589-F
  misc_feature: Encodes the peptide sequence at SEQ ID NO. 24456
aaagctggagctccccgcggtggcggccgctctatgaactagtggatcccccgggctgcaggaattcgcacgagaccattacctagaacatcctaatcaaaaattttccaaatccgtctacgccctcacgcacgcggcccaactagcctaacaaaccctagctagatttagaaaaaaagtttgtccccaatccgaaccgacgaggagctcgccgccgtgagatgtccgagtacgacgagcgctaccagggcaacgccgacatgcccgcagccgaaggcggctatccgcaggccgagtacgccgccgccgccgcgcctgccgccgggggttcgccgcccgcagacagcaagccctccgggttctccgaccacgccgacggccgctcctcccagcaccagcatgagacacaatcacatgacagtggttcctcgaaatctcgagaaagggaccgagaacgcgataagggcaaggatagggagcgtgacagggatcgtggccgagaaaaggggagggaccgagacagggataaggatcgtgaaagaagtgacagagacagagatcgcgatcgccacccacaggaccatcgagagcgcagcgagaaaagggaacaccgggatcgttctgatggatcgagaccgagaccgcgatggccgagaccgcctccggtgaggtccgccccctcaaggc

SEQ ID NO: 24456 - protein, 89 aa, Zea mays
  misc_feature: Ceres CLONE 1395589-F
MRHNHMTVVPRNLEKGTENAIRARIGSVTGIVAEKRGGTETGIRIVKEVTETEIAIATHRTIESAARKGNTGIVLMDRDRDRDGRDRLR

SEQ ID NO: 24457 - DNA, 803 bp, Zea mays
  misc_feature: Ceres CLONE 1395590-F
  misc_feature (1)..(1): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (733)..(733): n is a, c, t, g, unknown, or other
nttccccccccccccnnnnccccctctccccccccccctaaagaatctttgccaaagctggactccccgcggtggcgggcgctctttactagaggatcccccgggctgcaggaattcgcacgagaccattacctacaacatcctaatcgaaaaatcaaccatattattgagaccaacaagcaacatagaaagcggaatccagtagcaacaatagagcaacaatggcgaccaagatattttccctccttatgctccttgctctttctactgagttgctaacgcgacaattttccctcaatgctcacaagctcctatagcttcccttcttcccccataccttccatcaattatagcttcaatatgtgaaaacccagctcttcaaccatataggtttcaccaagccatcgcagcaagcaacatacctttatcgcccttgttgtttcaacaatcgccagccctatcttttggtgccagcccttgccacataccttccggggcacaaccagctgcccgcacctccagctacctcctgctcacaccaagcagctcctgggcaaaccttttctcccctacctctccgaaaccaacccaatttccttgccattgcacccaaccctgtcctacaactgaaacccctggttggctttattttgcaggaaactcccccattcaccacctagacccagactagcctacgtggccccacttctccacgcacccaccccactcctcnttcccccatttcaaccccagttgggggcgcgtaattgaaaacccccgggctcgtgttaaatgtggggaag

SEQ ID NO: 24458 - DNA, 671 bp, Zea mays
  misc_feature: Ceres CLONE 1395593-F
  misc_feature: Encodes the peptide sequence at SEQ ID NO. 24459
  misc_feature (518)..(518): n is a, c, t, g, unknown, or other
  misc_feature (521)..(521): n is a, c, t, g, unknown, or other
aaagctggagctccccgcggtggcggccgctctagaactagtggatcccccgggctgcaggaattcgcacgagaccattacctagaacatcctaatcaaaaatccagaacggcagaaccttctagaccaaaccttcgacccatcacctcgagctccagccatgtcgctctcgtcggcgcgccagcgccgggccactgcagcgtcgccaccgacagatgatgggtacgccaaggacgccaaggacaggaggcggcggcccggcggagacggggacagcgaggacgagggtatcaagtggttcctcccgttcctggcgctcgggctcctccgccacatgagcgcgtcctccaacctgatccacgactgcgacgaggtcttcaactactgggagcccctccacttcctcctctaccgctccggcttccagacatgggagtacagttccgactttgctcttcggtcatatttgtacctttttctttcatgctcttgtagctgggcctgcttcattgatcttnggngaggataagggtcgtggggtctactcagtgagaatctttcttgggctcatttcaactattaaccgaacttggttctggggggttgctcctttccaaaaaaaattggaaagccggcttgggctggtaatggccccttggcaaggcaattgt

SEQ ID NO: 24459 - protein, 122 aa, Zea mays
  misc_feature: Ceres CLONE 1395593-F
  misc_feature (120)..(120): Xaa is any aa, unknown, or other
  misc_feature (121)..(121): Xaa is any aa, unknown, or other
MSLSSARQRRATAASPPTDDGYAKDAKDRRRRPGGDGDSEDEGIKWFLPFLALGLLRHMSASSNLIHDCDEVFNYWEPLHFLLYRSGFQTWEYSSDFALRSYLYLFLSCSCSWACFIDLXXG

SEQ ID NO: 24460 - DNA, 605 bp, Zea mays
  misc_feature: Ceres CLONE 1395594-F
  misc_feature: Encodes the peptide sequence at SEQ ID NO. 24461
gctctagaactagtggatcccccgggctgcaggaattcgcacgagaccattacctagaacatcctaatcgaaaaatctcaccacacaccgcagccccagcaagatcgcgcggaggccatggcgaagcccaagccttcctccgccggcgccaagccgaccgcgcctgcgccgccggttacagtgcactcggcgctggtcacctacacctccatgctcgcgctcctgtccctctgcccgcccttcgtcatcctcctgtggtacacgatggtgcacgcggacggatcggtggtgcggacttacgagcacctcagggatcacggcgtgctcgaggggctaaaggccatctggcccatgcccaccctcgtcgcgtggaagatcatcttcggcttcggcctcttcgaggccgtcctacagctgctgctccctgggaagcgcttcgaagggcccatctcgcctgccgggaacgtgccggtctacaaggcaaatggcttacaagcatatgcagggaccttgataacttaccctgggttgtggtgggtcgggatatttaaccctgcaatagggaatgaacccttgggggaaaaaactctgctctggttttggaa

SEQ ID NO: 24461 - protein, 162 aa, Zea mays
  misc_feature: Ceres CLONE 1395594-F
  misc_feature: SWISSPROT Homolog: EC 1.3.1.21 7-dehydrocholesterol reductase
MAKPKPSSAGAKPTAPAPPVTVHSALVTYTSMLALLSLCPPFVILLWYTMVHADGSVVRTYEHLRDHGVLEGLKAIWPMPTLVAWKIIFGFGLFEAVLQLLLPGKRFEGPISPAGNVPVYKANGLQAYAGTLITYPGLWWVGIFNPAIGNEPLGEKTLLWFW

SEQ ID NO: 24462 - DNA, 598 bp, Zea mays
  misc_feature: Ceres CLONE 1395595-F
gcgggtggcggccgctctagaactagtggatcccccgggctgcaggaattcgcacgagaccattacctagaacatcctaatcgaaaaaccagtggcaggcgagcgagaggcggttgaggaggagcggacggaaccgtcgcctgctgcgtctgcctgcgagatctaggcgagcgcggccatgggtgctcgctgctccaagctctccgtctgctgggggcctccccacttcaatcgccaatgctccaagaatggcgccccccggaaatgattgaaaaacgggggtgcccgttgttcccccaaaaaaagttttcaacaccccccgggggggcccccgaaagggtttccccccccatctctttttggtcggaaacaccgggaaaaaaagcccccccacgggggttttaccggggggcccccccttttgtttcccggggggcccgcggtcgatttaataggcctttgtcgccccctcccctgggggggggaactccccccaatttttctttgggaaaagagaagggcttttttgtccaccccccccccataagggggggtgtggggcacaactatttgcggtttgctcttttttttaaaaaag

SEQ ID NO: 24463 - DNA, 742 bp, Zea mays
  misc_feature: Ceres CLONE 1395597-F
  misc_feature: Translation starting site: 243
  misc_feature (724)..(724): n is a, c, t, g, unknown, or other
ggagctccccgcggtggcggccgctctagaactagtggatcccccgggctgcaggaattcgcacgagaccattacctagaacatcctaatcgaaaagggtctccgtgtcgtctctgcgactccacttgctcttttcgctggccctggctacttgcggcaactcccatctccacgcgctctcccatccgagatctcaaccgcctcgccggcgagcgactgacgggcggacggtcccgccggctatggggaactgctgctccgatgaggtgagccacgccggtgctcatcccgtcggctccgccaccgccaaagccgcctccgcagcctccgccgcggccgatcgctttctccgctcccgtggtgccggcgcgtccacgcagatcgagttatctctctctgcatcaaatttgggtgatcaagaatattttcccaagagtaatcccatgggtggttgtgtattccaaaaagagagatggtacactagaagaaattgggcgcagtgaagtaattttaaattcattgaacccattttggacgaccaaaatcagtgtgcagtaccagttttgagttcttcagcaattggtgtttcaggtctttgacaccacccagcagttcccgtgatgtcagtgaaaagatgcttaagctagaggaaacagagtttcttggaggagctaactgtctttttgtccgaggttatcacccaaacggacagactgctgactcngaaagctgggtgccctga

SEQ ID NO: 24464 - DNA, 816 bp, Zea mays
  misc_feature: Ceres CLONE 1395598-F
  misc_feature: Encodes the peptide sequence at SEQ ID NO. 24465
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (21)..(21): n is a, c, t, g, unknown, or other
  misc_feature (30)..(30): n is a, c, t, g, unknown, or other
  misc_feature (31)..(31): n is a, c, t, g, unknown, or other
  misc_feature (38)..(38): n is a, c, t, g, unknown, or other
  misc_feature (39)..(39): n is a, c, t, g, unknown, or other
  misc_feature (41)..(41): n is a, c, t, g, unknown, or other
  misc_feature (42)..(42): n is a, c, t, g, unknown, or other
  misc_feature (48)..(48): n is a, c, t, g, unknown, or other
  misc_feature (780)..(780): n is a, c, t, g, unknown, or other
nnnnnnnnnnnnnnnnggggnaaaaaacannggagaannanngaggancaaaggaaaaaacggggagctccccgagggaggcggccgctctagaactagcggatcccccgggctgcaggaattcgcacgagaccattacctagaacatcctaatcaaaaaaaagcgatgcgcagctccgtaaccacttcgtcctcacttctcagtccaccttcccaccgcaaccacttcaccacctcctcacagtcccagcaatggagctagtagcgtggctcgtcatcgtgtcctcagtatccctcgctgggctcctgccagtggtctcggtgtcgacgacgaccccgcagcagcaatgtggcggcaataatgccggacctgccggagtgagagcaggctaactggtcgccgacctcgaaccgctaactccgcgggcggcagaaacgaacgcgtcccctgttacccgcaccctctactaacagagctggtgccaccatccgaccgagaccaaacttggcggcggttcgtggcccccctctcctcccgaaccggctcgaaacggtggaccctcggttggctcgcgccggccttttctctggcacgacgggtcaaacgttcccgcctcggccccattacaacaccagcaacctgggcgtgggcccggtgggacattggaacatagattacatgggttggtggtcaaatgtccacaaagcaaaggcctttcagccaaaaacaaccgaacccccaccaacaaacaaccacgcacccagacacggtaaacaacntacaactattcccctccaagacgaaacctggatccc

SEQ ID NO: 24465 - protein, 46 aa, Zea mays
  misc_feature: Ceres CLONE 1395598-F
MELVAWLVIVSSVSLAGLLPVVSVSTTTPQQQCGGNNAGPAGVRAG

SEQ ID NO: 24466 - DNA, 733 bp, Zea mays
  misc_feature: Ceres CLONE 1395602-F
  misc_feature: Pfam Name: EIN3 Pfam Description: Ethylene insensitive 3
  misc_feature (400)..(400): n is a, c, t, g, unknown, or other
  misc_feature (413)..(413): n is a, c, t, g, unknown, or other
  misc_feature (427)..(427): n is a, c, t, g, unknown, or other
aagctggagctccccgcggtggcggccgctctagaactagtggatcccccgggctgcaggaattcgcacgagaccattacctagaacatcctaattgaaaacttccaatttttctcccaaataaaaaccagccgcagcgggaggtggcgcgacgcgaacccacccaccctgcgaacccggccgcaaaattctcctctcggattccgccgccgcgaaccgtcccctcgacgaggctgctgcgatagatttttcttaccattcgaatagttgatgagcgagaatacagagcaagaatcttgatggtgcgtgtggtacaacttggttaaggaaagctgactgcttgaagtgaccatgttggaccatcttgctatcattgcgtctgagttaggggacgacgcancggattttgaggntgatggcatcgacnacctcagcgagaacgatgtcagcgactaggagatcgatgctgacgagctcgcccgacgaatgtggaaggacaaggtcagctaaagaggatcagggaaaggcagcaaaagcttgccctggcacgggtttggaacttggaaaaacccagaccaaagaagattccgacccaacccctccgaaaaaaaatgcccggggccccaaaaggggaaccccaaggaaaatggctcaaattttgggggggggggcaaggccccaaagggtttgggacgggaaatttttcggggaaaagggaaacccgggcaggggg

SEQ ID NO: 24467 - DNA, 694 bp, Zea mays
  misc_feature: Ceres CLONE 1395612-F
  misc_feature: Encodes the peptide sequence at SEQ ID NO. 24468
  misc_feature (522)..(522): n is a, c, t, g, unknown, or other
  misc_feature (581)..(581): n is a, c, t, g, unknown, or other
  misc_feature (582)..(582): n is a, c, t, g, unknown, or other
  misc_feature (604)..(604): n is a, c, t, g, unknown, or other
  misc_feature (655)..(655): n is a, c, t, g, unknown, or other
  misc_feature (656)..(656): n is a, c, t, g, unknown, or other
  misc_feature (664)..(664): n is a, c, t, g, unknown, or other
  misc_feature (665)..(665): n is a, c, t, g, unknown, or other
aaagctggagctccccgcggtggcggccgctctagaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgcctgccgccagcatctccaccgcttgccgaggcgtcaggatctccgtcgcagnggcccgcgccgtcgccatcctcagctcgtcggcctcaccagcagccgcgacagcgcggnncttgtagctgtccagcgcggtnccacccttgggggggtcgcgggttcttagccgggcccgccctgaagcggcnngcgcgcgnnaccgtcgaaggtttccgctggcagcagcg

SEQ ID NO: 24468 - protein, 109 aa, Zea mays
  misc_feature: Ceres CLONE 1395612-F
  misc_feature (73)..(73): Xaa is any aa, unknown, or other
  misc_feature (93)..(93): Xaa is any aa, unknown, or other
  misc_feature (101)..(101): Xaa is any aa, unknown, or other
MLLTSCRQGRGMASLSCARADGVVRSGALPAKLLLCASCCFPTAAPVADGEVQVLACRQHLHRLPRRQDLRRXGPRRRHPQLVGLTSSRDSAXLVAVQRGXTLGGVAGS

SEQ ID NO: 24469 - DNA, 703 bp, Zea mays
  misc_feature: Ceres CLONE 1395614-F
  misc_feature: Encodes the peptide sequence at SEQ ID NO. 24470
aaagctggagctccccgcggtggcggccgctctagaactagtggatcccccgggctgcagtaattcgcacgagaccattacctagaacatcctaatcaaaaactacacaacgcttatattacttacaacaagagataagcccacgaatcagtagatcgaggtcccgcccagtccagcagaagcgcacacggagatgtcccagctgagccctgctggccacatggctgcgacgctcctcctcatcctcctggcctccgcagcagcagcagcggtgtcagctgaccaacaggtctctgcctgccagaatgacatagacgcactgtggcgcagctgcaagcagttcgtccagaaggaggtgttcaagatgcctccgtccgaggactgctgccaaaccatcaaggccttagatgcgcccgagccctgtatctgggactacgtcggctccccggacgccaggagtaagctagacctggcaaaggcgttctctccgaccaaccagggggggccgcccggattattcgcgccgcacctcagaggcccggatggtacaaaggctcgaattgaatgtccccacacgaggtttatcccattttcgggattcccccccccccctttccccgcgagaccggttatggttagttcaactcccgcccccccccccgaaccgacttcctctgcgattctcccccccccccttgcccct

SEQ ID NO: 24470 - protein, 170 aa, Zea mays
  misc_feature: Ceres CLONE 1395614-F
MSQLSPAGHMAATLLLILLASAAAAAVSADQQVSACQNDIDALWRSCKQFVQKEVFKMPPSEDCCQTIKALDAPEPCIWDYVGSPDARSKLDLAKAFSPTNQGGPPGLFAPHLRGPDGTKARIECPHTRFIPFSGFPPPPFPARPVMVSSTPAPPPEPTSSAILPPPLAP

SEQ ID NO: 24471 - DNA, 649 bp, Zea mays
  misc_feature: Ceres CLONE 1395615-F
  misc_feature: Translation starting site: 236
  misc_feature: SWISSPROT Homolog: EC 5.3.1.5 Xylose isomerase
tccccgcggtggcggccgctctagaactagtggatcccccgggctgcaggaattcgcacgagaccattacctagaacatcctaatcaaaaaatattagaaaagaaaactctgttcaaccacccgccgagttcagcagcactctcctccgccctcttccaggtccagcagagattgggggcgcgtgggcatcggagattgcctcgggagcgcgtttcctggtcaactaaggccggcatgaagggctgctcagagcgcttgctgtttctgctgctgctgctggcatcgtcgtcgttactgtccgctgtgattgccgcgcagcagacttgccccgccgacctcgacagcaaatgcgatggtggcgcgctggaattgatgattggggaggggggagttctttccccggcgtcccgaaaatcaagtatgagggtccaacaagcaagaaccctcttgcttataagtggtataacaagggaggaagtgattctcggtaagaagatgaaggattggatgcgcttcagtgttgcgttctgcacaacgttccgcggactggcgctgatccttttcgtgctccaacaaagactggccttgggagatggcacaaattcttggccctggctaaaaaagaaggaagctcactttgagtccatg

SEQ ID NO: 24472 - DNA, 696 bp, Zea mays
  misc_feature: Ceres CLONE 1395619-F
  misc_feature: Translation starting site: 340
  misc_feature (423)..(423): n is a, c, t, g, unknown, or other
  misc_feature (451)..(451): n is a, c, t, g, unknown, or other
  misc_feature (463)..(463): n is a, c, t, g, unknown, or other
  misc_feature (465)..(465): n is a, c, t, g, unknown, or other
ggagctccccgcggtggcggccgctctagaactagtggatcccccgggctgcaggaattcgcacgagaccattacctagaacatcctaatcgaaaaacgggtgcccagccgccgcacagtctttcgaactgaggaaccctaggcccagcactcggcgacggcggcgcgccaccggcgacgggatcagcggcatcactcccctccttccccggcgcggcggcgccctgcacctaggccctagcactgcagcactcgacaacaggatcagcggtcgcgcccccctcctccttccccggcgcggcggcgccctgcagatctgccactgtccgcctgccggtcatggagcacctccggtggcgccccacagtggacgagcgcgacttcattgagtgtgcgctccagtctgacctccgtggtgacggncgccactcctttgacttcccgcagctcnagatcaccttcngnaggggaggatgcctcgtcagaggtgcagctcggggagacacacgtgatgggctacgtgaccgtgcaactggtgcaaccataccggacagcccgaatgaggggaccctgccaaattcaccggttctccccctgcccgacccctctgggagccgggggggccgggggaataaaaatggagtttgccggtaattgccggggcccccgaaagtcaggttggaagggaacccttgg

SEQ ID NO: 24473 - DNA, 832 bp, Zea mays
  misc_feature: Ceres CLONE 1395620-R
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (584)..(584): n is a, c, t, g, unknown, or other
  misc_feature (832)..(832): n is a, c, t, g, unknown, or other
nnnncgacgattgggtaccgggccccccctcgaggtcgacggtatcgataagcttttttttttttttttttcatgaattttttgttttttttttttttttttttttaaagggcaacatggcgcattttttttttttttttttttattttcaaattaaaaatcattttaatttttctaggtttacaacttttgctttatacacgtggcctttctctaaataaatcaggaaagttctataacttggcaaatcaaattataaatagaaacccctattctaatatcttgccctccgagggcctgaagaagtaaccataatgatggcccccttacttttcccgtacatggacaaggaggaaccagccttgaaaaagaaaatctgtggttggaggacctcccttggcgaccccgctgtccttacaacattcacgcaaacatacgcacgttcggtgttgaggctccgctgcttcgccgggggtatcaagtgcctagtctgcaaccacagcggatcggtgctccccgtgtagctgtactccgggtcctacaacgggctcctaacgccgcaaacatgtgcgatggtcttgacntggcgggaagtgccaccaccgaaaccttgtggagccggtggccctcactccccctgccaagcaagtcctcgtcgggtaaaatgctagcaatccccggacacaaatgcgtgtaggaaaccctactacggatattcttctttcaccgacgctccttgtaggcttttttctggaaggttccttctcttgagctgcgttagtagaaaaaattgggtcctctgctccttgtaccgaacctcagtcgggagagn

SEQ ID NO: 24474 - DNA, 600 bp, Zea mays
  misc_feature: Ceres CLONE 1395627-F
  misc_feature: Encodes the peptide sequence at SEQ ID NO. 24475
  misc_feature (526)..(526): n is a, c, t, g, unknown, or other
aaagctggagctccccgcggtggcggccgctctagaactagtggatcccccgggctgcaggaattcgcacgagaccattacctagaacatcctaatcgaaaagaccctcgcttcacttgtcacggactcgcgtccacaaaccacaaccagctcactcaagaacaaagaacccaacccatggcttctcccaagccgctcctcctgctcgccacctcgttcctgagctgcggcctcctggtggccgccgactacgccccaatgaccctgaccgtggtgaacaactgcccctacccggtgtggccgggcatccaggccaactccgggcacgacgtcctggagggcggcggcttcttcctcccgccgctctcccacaagtccttcccggcgccggcccacccctggtccggccgcatctgggcgcgcacgggctgcgcgggcgccggcgcgcagctccactgcgccacgggcgactgcggcgggcggctccagtgcggcggggctccggcgggcgcggggccccgcgacngcttggcgcaggtgaaaacttccaccacggggaaacggaccaaaaccttcgtacggggtggaaacgggggggaa

SEQ ID NO: 24475 - protein, 141 aa, Zea mays
  misc_feature: Ceres CLONE 1395627-F
  misc_feature (117)..(117): Xaa is any aa, unknown, or other
MASPKPLLLLATSFLSCGLLVAADYAPMTLTVVNNCPYPVWPGIQANSGHDVLEGGGFFLPPLSHKSFPAPAHPWSGRIWARTGCAGAGAQLHCATGDCGGRLQCGGAPAGAGPRDXLAQVKTSTTGKRTKTFVRGGNGGE

SEQ ID NO: 24476 - DNA, 746 bp, Zea mays
  misc_feature: Ceres CLONE 1395629-F
aagctggagctccccgcggtggcggccgctctatactagtggatcccccgggctgcaggaattcgcacgagaccattacctagaacatcctaatcgaaaattccacctctcaatctcaccccacgcctgccccgagctccaaccctaaaggaacacacccctgcttgcggcggcggggagcggtcttgggcgtccgccttttgctgtggcccagccgtgacagatccgggccccgcgccgttaggtcggtgtttcttcggcgacggtgtagccgctggatgttagtctggcggatcggcgcccgctgctcgcgtgattctatttatgcggcgcccagctgtaacctttgtgtcacatgtttgttttcttagcatctcagggggacaaccgcgtttttattcattcccctcccctaacccccatgcctgctacccgctcgccttgtcataaatgccgcgccccccccgcttgccttccccccttcacccgtaccttccttccccgtctgttcacactgtctccgttctctctacctttaccgtgcacccgcattagccctcgtcctctatcccgatatcttcgccccactctccttcttgtttatatctcccccactaccttgtaccccaccccccactttatatcctctatttgtttggccctcccaccccagtgatcgggcctctatgccgcgggcatccttacacccggcaagccgactcccccgtcttttgttccacttcgtc

SEQ ID NO: 24477 - DNA, 664 bp, Zea mays
  misc_feature: Ceres CLONE 1395630-F
  misc_feature: Encodes the peptide sequence at SEQ ID NO. 24478
tggagctccccgcggtggcggccgctctagaactagtggatcccccgggctgcaggaattcgcacgagaccattacctagaacatcctaatcgaaaaatccgctccccggcttccgcttccctaccccccgcatcacctaccaacggcgactccatgggggccttcgcgaaggaggagcaccagctcctagtccagctcggcctcgggcaacgcatcccaggcgcgttcgcatgcggagcgcggggcggatcatgtcccaccgtcacctccacgagcccgaccaacaatcaggtcatcgcagaggccgtggaggcgtccgtgcacgactaccaggagggcatgcgcgtctgcttcgatgccgacaagacatggatggggattgctgctccaaagcgaggagagatcgctaggcgaatcggagatgcactgggagcacagctccatcaccttgggaggcttgtgtcagttgacatgcggaaaattcttcctgaagggatcggtgagggacatgaaatcatcgacatgtgtgatgtatgctagtggggtctaggctgccactaagtggatcctgtataccatctgaacgagcataccatatgactgatggaggtgcggaatcccacttggaagctgcgcgtggtactagcgacgtttaatttctcc

SEQ ID NO: 24478 - protein, 128 aa, Zea mays
  misc_feature: Ceres CLONE 1395630-F
  misc_feature: SWISSPROT Homolog: EC 1.2.1.3 Aldehyde dehydrogenase (NAD(+))
MGAFAKEEHQLLVQLGLGQRIPGAFACGARGGSCPTVTSTSPTNNQVIAEAVEASVHDYQEGMRVCFDADKTWMGIAAPKRGEIARRIGDALGAQLHHLGRLVSVDMRKILPEGIGEGHEIIDMCDVC

SEQ ID NO: 24479 - DNA, 666 bp, Zea mays
  misc_feature: Ceres CLONE 1395634-F
  misc_feature: Encodes the peptide sequence at SEQ ID NO. 24480
  misc_feature (561)..(561): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (619)..(619): n is a, c, t, g, unknown, or other
  misc_feature (620)..(620): n is a, c, t, g, unknown, or other
  misc_feature (627)..(627): n is a, c, t, g, unknown, or other
  misc_feature (629)..(629): n is a, c, t, g, unknown, or other
  misc_feature (635)..(635): n is a, c, t, g, unknown, or other
  misc_feature (636)..(636): n is a, c, t, g, unknown, or other
  misc_feature (638)..(638): n is a, c, t, g, unknown, or other
  misc_feature (653)..(653): n is a, c, t, g, unknown, or other
tggagctccccgcggtggcggccgctctagaactagtggatcccccgggctgcaggaattcgcacgagaccattacctagaacatcctaatcgaaaaagatcgttccgtaagggcacccatcgtcatagatacgattcatagcttctgccactacttgtgcgcgaagagccaagaaatgcgtcaggggttgtgaagggaaggagtgccgatggccggtggccacccggcgccgctgcggcctgtggtggttgcgatgaaaggccacccagggtctggcaagtccacggcggcgcgcgccatcgcgaccgcgctttgctgtccgctcctggacaaggacgatgtgagggactgcatgttgcccctagagggcttggctgctgctgggatgctcaacgacctctcctacgccgtgctgtggcggatggctgagcgccaggtaaggctcggactgtctgtcgtcatcgattcaccgctgtcacgccgctctcacctcgacatgctgacacgcctagccggtgtgcttgtggtcgtcgtggagtgtcgccctggtgataacgagnaatggcgcccggagctggagagccgtgggtcgctgtgcccaagggggggcgnnnnncnnccccgcncncccccnncnccccctccccccttnccgcccccccccc

SEQ ID NO: 24480 - protein, 152 aa, Zea mays
  misc_feature: Ceres CLONE 1395634-F
  misc_feature: SWISSPROT Homolog: EC 2.7.4.14 Cytidylate kinase
  misc_feature (118)..(118): Xaa is any aa, unknown, or other
  misc_feature (135)..(135): Xaa is any aa, unknown, or other
  misc_feature (136)..(136): Xaa is any aa, unknown, or other
  misc_feature (137)..(137): Xaa is any aa, unknown, or other
  misc_feature (140)..(140): Xaa is any aa, unknown, or other
  misc_feature (143)..(143): Xaa is any aa, unknown, or other
  misc_feature (148)..(148): Xaa is any aa, unknown, or other
MAGGHPAPLRPVVVAMKGHPGSGKSTAARAIATALCCPLLDKDDVRDCMLPLEGLAAAGMLNDLSYAVLWRMAERQVRLGLSVVIDSPLSRRSHLDMLTRLAGVLVVVVECRPGDNEXWRPELESRGSLCPRGGXXXPRXPPXPPPPXPPPP

SEQ ID NO: 24481 - DNA, 605 bp, Zea mays
  misc_feature: Ceres CLONE 1395635-F
  misc_feature: Encodes the peptide sequence at SEQ ID NO. 24482
  misc_feature (270)..(270): n is a, c, t, g, unknown, or other
ggagctccccgcggtggcggccgctctagaactagtggatcccccgggctgcaggaattcgcacgagaccattacctagaacatcctaaaaaaaaagcagtccaaacacgcaacgcaacactcgccttcccctcccaaccctccgaaccgaagcagcaaagctagacgatgacgctgacgatcccggacgaggtgcgcgccaaggcggaggtgtacgtgggcgacgcggcggggcaggagaagacgcggctgctcctccaggagacgggnctcccgagcgggctgctcccgctgcgggacatcatcgagtgcggctacgtggaggagacgggcttcgtgtggctccggcagcgccgcaaggtggaccactacttcgccaagggcggccgccacgtgtcctacggggcccaggtgtcgggcgtgggccgaaaaggcccggcttaagaaaatcccggggggtcaaggcccaaggaaaaggtggctgggggccccccctccccggagatttggggtggacgaaccccccccacggggaaagctcccccctggaaggggccatccggggggcctgggcccccgaaattttcccgcggggaggggctttg

SEQ ID NO: 24482 - protein, 91 aa, Zea mays
  misc_feature: Ceres CLONE 1395635-F
MTLTIPDEVRAKAEVYVGDAAGQEKTRLLLQETGLPSGLLPLRDIIECGYVEETGFVWLRQRRKVDHYFAKGGRHVSYGAQVSGVGRKGPA

SEQ ID NO: 24483 - DNA, 678 bp, Zea mays
  misc_feature: Ceres CLONE 1395641-F
  misc_feature: Translation starting site: 400
aagctggagctccccgcggtggcggccgctctagaactagtggatcccccgggctgcaggaattcgcacgagaccattacctagaacatcctaatcgaaaagatccgcgattcgcgtgcgacgggctcgcgtccacgacaacgataaggtcacacaagagacgatgaatgctgcttatgccttcgccacttgcgtgcgcacgtgatcgccacatagaatcctgagctgtggccatctgacggcagacgactaccgcccagtgaccctgaccgcgtagaaccactgaccctacccggtgtggctacgcatcctcgccgactccggcgacgacgtcctggagggcggcgtcttcttcctcgcgacggtactcccaaagtccttcccggcgccggcccagccatggtccggccgaatatgggcagcgcacgggctgcgagggcgccagctcatacaatgactgcgctacggacgactgcgacgcgctgctccagtgcctgccctctcggagacgcggatgccggtactatgatgcaggtgaagcaccactatgaaagctaccaggagtcgtacgaccttgaccggtgaaaaggcttccgaagtgagacagaccatgccctagcaagaggaacgggcttcttgcatcgacctcgaatggggcaaaaccctcaactaaagctg

SEQ ID NO: 24484 - DNA, 573 bp, Zea mays
  misc_feature: Ceres CLONE 1395642-F
  misc_feature (282)..(282): n is a, c, t, g, unknown, or other
  misc_feature (306)..(306): n is a, c, t, g, unknown, or other
  misc_feature (307)..(307): n is a, c, t, g, unknown, or other
cgctctagaactagtggatcccccgggctgcaggaattcgcacgagaccattacctagaacatcctaatcgaaaaaatcaactcgtttctctccgattgctcctccgagtccgagactccgttctctcccgcatccaccgccgtctcatccccaatccgagcaacgcctcccctcgcctccaaaaccctaacccctcctgtcaccggcgggggcatgaaccggtgatcgcttacctggtctcgtctgtctgcgcacgcgcgaggtcagtgagtgagcattgncggtggtcccgatcgccccgcggnnggggccatgggcgtcctgtggcggggaattcggggggggggggccaaaacccgggggccggggggttaaaaatatttaaaaaccccagggggggaaaaattgaaaaaaaaaaaaactcccccgcggggggaataacccacaagggaaaaccgccccaaaaagagggggttttttgagggaaaaaccggggcgggggtcccccccctacaaaaaaggggtgagaggggaagggcccccccgggaaaaaaatttctccccaaaaaaat

SEQ ID NO: 24485 - DNA, 650 bp, Zea mays
  misc_feature: Ceres CLONE 1395643-F
  misc_feature: Encodes the peptide sequence at SEQ ID NO. 24486
  misc_feature (332)..(332): n is a, c, t, g, unknown, or other
tggagctccccgcggtggcggccgctctagaactagtggatcccccgggctgcaggaattcgcacgagaccattacctagaacatcctaatcaaaaaacgacgtcactagtagagccgtagagggcaagaggcgacggaatgacggagcggcaggtggcggagctgggtcccgggacggcgtgctgcggctggaaccactgtggccgccgcctcgccgctggcgccgtcgatggctccgtctccgtctatgactcccagccgccaccctcgttcaagtggcaggcccatgagcaagccattgtgaatgtcgtctggcttcctccagagtatngcgatgctatagcttgtgcttgtgctgatgccacactgtctttgtgggcagatgctgctgctgatatccacttacgaccctggagaattgtaaaatcctccaggatggcaactctcatatactaaatgtacatttttggatacatctgggaattccgaaaaatgggtactgcatactcagatggccaaggtcagggctacgagctcttggattccttggaaattagacaaggggcagcttccaggcagagttccagaacattactgatccaatcctctagatttgggaaaaccctgcttgcacttctgcatccatagc

SEQ ID NO: 24486 - protein, 105 aa, Zea mays
  misc_feature: Ceres CLONE 1395643-F
  misc_feature (65)..(65): Xaa is any aa, unknown, or other
MTERQVAELGPGTACCGWNHCGRRLAAGAVDGSVSVYDSQPPPSFKWQAHEQAIVNVVWLPPEYXDAIACACADATLSLWADAAADIHLRPWRIVKSSRMATLIY

SEQ ID NO: 24487 - DNA, 648 bp, Zea mays
  misc_feature: Ceres CLONE 1395645-F
  misc_feature: Encodes the peptide sequence at SEQ ID NO. 24488
  misc_feature (387)..(387): n is a, c, t, g, unknown, or other
  misc_feature (388)..(388): n is a, c, t, g, unknown, or other
  misc_feature (521)..(521): n is a, c, t, g, unknown, or other
  misc_feature (523)..(523): n is a, c, t, g, unknown, or other
  misc_feature (557)..(557): n is a, c, t, g, unknown, or other
aaagctggagctccccgcggtggcggccgctctagaactagtggatcccccgggctgcaggaattcgcacgagaccattacctagaatcctaatcgaaaaatccactgtaccggagctccaccacgtcctccggcaagaaacagatgaaagacagcgacgacgagggcgccggcgatggcgtcaaccgcccgcacccgtccaacaaccttccactgccggctccacactccgacccgaacctccagttctcgggtgggacggacgatgagtcctcgaaccgggacagcagctcctctgccaccggcggcgcgagcccggggtactactccgactacccgtccagcttcagcggcgagtgctcgccgtacaacatgtccccctggaanncagacatggcgtctccctggtcgcaccacagcgaggccgccgggctcggagggcggccgccacgatgggcgcggggacgagtctcacagctcggctggtgaagggaagaagggcacatctactcgctcgccgncnaagggggacacgctgtacacccggctcgaacagnagaacattcccgtctggggcaagcagaagaactccggaagggttcaggtcctcgagcgggctccgggaaagggatcgtcattgtccgggga

SEQ ID NO: 24488 - protein, 114 aa, Zea mays
  misc_feature: Ceres CLONE 1395645-F
  misc_feature (81)..(81): Xaa is any aa, unknown, or other
  misc_feature (82)..(82): Xaa is any aa, unknown, or other
MKDSDDEGAGDGVNRPHPSNNLPLPAPHSDPNLQFSGGTDDESSNRDSSSSATGGASPGYYSDYPSSFSGECSPYNMSPWXXDMASPWSHHSEAAGLGGRPPRWARGRVSQLGW

SEQ ID NO: 24489 - DNA, 618 bp, Zea mays
  misc_feature: Ceres CLONE 1395647-F
  misc_feature: Encodes the peptide sequence at SEQ ID NO. 24490
  misc_feature (363)..(363): n is a, c, t, g, unknown, or other
  misc_feature (618)..(618): n is a, c, t, g, unknown, or other
aaagctggagctccccgcggtggcggccgctctagaactagtggatcccccgggctgcaggaattcgcacgagaccattacctagaacatcctaatcaaaaaaccaggcaagcaagcgggagccgccaactcgtgcctctcggcagcggcgtctgaactctgaaccgaccgaccgaccgaccgttccgttccgttcaccccaccatggaggcgccgccgggaccggggcccatggagctggacgccccacctcccgccgccgccgccgcggcgattcctcccgccggcagcgacaagcacaaggacgggggaaggggggagacgctttgtgaccgggccatatcatctccaccaccatcggcnggaaagaacggcgagcccaagcggaccatcagttacatggcagaacgtgtcgtgggcacaggctcatttgggatcgtctttccagctaaggtgtctggaaaacaggaaaagaaccttcccccatcaagaaaggggctgcaaagaaccggcggtttaccaagaacccgggaaagtttgcaaattttaatggggggggccatgggggaacccccaaaggttatttttggccctgagaaaaactgggttttttttctn

SEQ ID NO: 24490 - protein, 138 aa, Zea mays
  misc_feature: Ceres CLONE 1395647-F
  misc_feature: SWISSPROT Homolog: EC 2.7.11.1 Non-specific serine/threonine protein kinase
MEAPPGPGPMELDAPPPAAAAAAIPPAGSDKHKDGGRGETLCDRAISSPPPSAGKNGEPKRTISYMAERVVGTGSFGIVFPAKVSGKQEKNLPPSRKGLQRTGGLPRTRESLQILMGGAMGEPPKVIFGPEKNWVFFL

SEQ ID NO: 24491 - DNA, 679 bp, Zea mays
  misc_feature: Ceres CLONE 1395648-F
  misc_feature: Encodes the peptide sequence at SEQ ID NO. 24492
aaagctggagctccccgcggtggcggccgctctagaactagtggatcccccgggctgcaggaattcgcacgagaccattacctagaacatcctaatcgaaaaatcacaccaccaaacggaccaggcgaggcgacctccaggccctagctctgtggtgtgcgcctcgatactgcgactgctgggcagccggagcccgtcccatcggccgccaaactgtgcgccccgggtgcccactacgccactactgcagtctgcactctgcagataacacagacgaagggggaagccgatggccgccgtggcaagccccgccctccggctccggccgagagccggctctacggcggagacctcctcctccgcccctcctcgatgtcgcttcggctccttctctcactcctgtttcaagtttggtaggtcatttccagttcagagagtcaatggaatcacgatgcagcatttcggtactctaaaagctcaagtcttttagcagtactggcgaccatgatggacgatttcatattaagaggactatatgctttgctgctacggacaagcaggagccggtcgtttcacgttactcagacatgcctgttttgcatgaggcagaaagtgctactaaagttacccctgcatctgaaaactcctacttcgctggcagaggtgctgcaaaatcaga

SEQ ID NO: 24492 - protein, 66 aa, Zea mays
  misc_feature: Ceres CLONE 1395648-F
MAAVASPALRLRPRAGSTAETSSSAPPRCRFGSFSHSCFKFGRSFPVQRVNGITMQHFGTLKAQVF

SEQ ID NO: 24493 - DNA, 696 bp, Zea mays
  misc_feature: Ceres CLONE 1395652-F
  misc_feature: Encodes the peptide sequence at SEQ ID NO. 24494
  misc_feature (354)..(354): n is a, c, t, g, unknown, or other
  misc_feature (695)..(695): n is a, c, t, g, unknown, or other
  misc_feature (696)..(696): n is a, c, t, g, unknown, or other
tggagctccccgcggtggcggccgctctagaactagtggatcccccgggctgcaggaattcgcacgagaccattacctagaacatcctaatcgaaaaaatttcaaagcgtgaagctctgctcacgtcgtcgcctccgcgtccgccacccactcaacaacgcggcggcgaatcgcgggcggttcgccgtcgaccgccgccgcctttccctcgccagccccccgctcctgaagcaatggtactggaccacgccatcaggggctcggcggcccgcagggctgagacccaaaccctagcgccagtgctgctcatgggcccgccgcctccaccgccgatcccaccgacgacggggatgntactctcccggagcccccaccccccgggacgctcctgccgcacccgatgtacatggtgctcccgcgtgaggtcatcatttacatggacgagtgtctcagccgctccctcctcaagttcatttccgacgctgctcattgagccttcgatagagtacgagcgcaggaggccagagatcatcatcgagctctcgagatcatgattgattgggcaaacatcgtggcctaccacaaagtgaactgagactgcatcgcttcactcatggagttgaccttcgaattgcatgccctgtccgccgtatggacctgaagcctgacatcgatgtcctctgtgtaggccttgnn

SEQ ID NO: 24494 - protein, 30 aa, Zea mays
  misc_feature: Ceres CLONE 1395652-F
MYMVLPREVIIYMDECLSRSLLKFISDAAH

SEQ ID NO: 24495 - DNA, 656 bp, Zea mays
  misc_feature: Ceres CLONE 1395654-F
  misc_feature: Encodes the peptide sequence at SEQ ID NO. 24496
  misc_feature (613)..(613): n is a, c, t, g, unknown, or other
tggagctccccgcggtggcggccgctctagaactagtggatcccccgggctgcaggaattcgcacgagaccattacctagaacatcctaatcgaaaagaaaaggctagccaagaaaacgactgggcgcacgaggcttctgtgttctgtgacttctgtccctatccacacgaccccgacattccatgggcgactccggcggaccccaccaccaccgcccttcgccgccgcctctgctggacgccggcaagcgacggcgcatccccaacgtccgcctcgctggctccgtcccgctcccttcccacctgccccacccgcgccgcgtccccattgcccccgccaccaggtcccgcaaacccctccaacttcagcataacagcaaccagcatgaccacccctccgcggagccacccaataccctcctaaaacccttcgtcgacagcggcgacgacgtcgtcttggccgccgcttttccccgcaaggtcagggccccggcttgagggactggtggtggggagctactgccacgatgtgctaatccggggcgggcgcatagtgggggagacgctcggcggggctgcggccttcgtgtccaacgtgctcgacgccgcttcngcccagggcgccgcgctcaacgagacatcccccctttgtcgtt

SEQ ID NO: 24496 - protein, 104 aa, Zea mays
  misc_feature: Ceres CLONE 1395654-F
MGDSGGPHHHRPSPPPLLDAGKRRRIPNVRLAGSVPLPSHLPHPRRVPIAPATRSRKPLQLQHNSNQHDHPSAEPPNTLLKPFVDSGDDVVLAAAFPRKVRAPA

SEQ ID NO: 24497 - DNA, 732 bp, Zea mays
  misc_feature: Ceres CLONE 1395655-F
  misc_feature: Encodes the peptide sequence at SEQ ID NO. 24498
  misc_feature (494)..(494): n is a, c, t, g, unknown, or other
  misc_feature (545)..(545): n is a, c, t, g, unknown, or other
  misc_feature (604)..(604): n is a, c, t, g, unknown, or other
  misc_feature (709)..(709): n is a, c, t, g, unknown, or other
  misc_feature (711)..(711): n is a, c, t, g, unknown, or other
aaagctggagctccccgcggtggcggccgctctagaactagtggatcccccgggctgcaggaattcgcacgagaccattacctagaacatcctaatcgaaaacccggttttctagggtttaaagagcttgccgagcccgccgtgcgccggccggcacatctccactactttccgccatcgccggagccgaccccttcgtctccgcacgcggcaatggcattctccttcgcctcgccggctgcgtcgaaccctttccagacgccggcgacgccgaatccctttcaaacaccggctccggccacctcgcaggcgccatccctatcgccttcgccgttccagttcagcttccagcagcagccgcagccacagcagcaggtgggcgccggcggcgcaacctccgcagccgcagccgcagccgcagccgcagaagctgatgctgtacacgacagatatgaaatctgcgggatacagcaccaagtgggaggagctgcacngccgagtcgcagaaggccttactccagatcgaggacaagatacggactacnaagacgagtgggggagaggttggaaccagtgcagtcgcctttatgactcctcaatctcnaatgccaattttgagcttttgatgcgagtcgcattgctcagggaaactttggagggacacccactggtaatggaaaaaaaagagaaaggcttccattccagaaantnggatggaatgttgtcaaatgg

SEQ ID NO: 24498 - protein, 125 aa, Zea mays
  misc_feature: Ceres CLONE 1395655-F
  misc_feature (94)..(94): Xaa is any aa, unknown, or other
  misc_feature (111)..(111): Xaa is any aa, unknown, or other
MAFSFASPAASNPFQTPATPNPFQTPAPATSQAPSLSPSPFQFSFQQQPQPQQQVGAGGATSAAAAAAAAAEADAVHDRYEICGIQHQVGGAAXPSRRRPYSRSRTRYGLXRRVGERLEPVQSPL

SEQ ID NO: 24499 - DNA, 706 bp, Zea mays
  misc_feature: Ceres CLONE 1395657-F
  misc_feature: Translation starting site: 178
  misc_feature (330)..(330): n is a, c, t, g, unknown, or other
aaagctggagctccccgcggtggcggccgctctagaactagtggatcccccgggctgcaggaattcgcacgagaccattacctagaacatcctaatcgaaaagaccctcgcttcacttgtcacggactcgcgtccacaaaccacaaccagctcactcaagaacaaagaacccaacccatggcttctcccaagccgctcctcctgctcgccacctcgttcctgagctgcggcctcctggtggccgccgactacgccccaatgaccctgaccgtggtgaacaactgcccctacccggtgtggccgggcatccaggccaactccgggcacacngtcctgggagggcggcggcttcttcctcccgccgctctcccacaagtccttcccggcgccggcccacccctggtccggccgcatctgggcgcgcacggggctgcgcgggcgccggcgcgcagctccactgcgccacgggcgactgcggaggtcggccccaatgcggcggggctccagggggagcgtcgctccacgacgattgggcaaggtgtaccctccaaccaccggcaacgaccagaccatcacacggagtgcacacagagtggacggtattcatctagtcgcctggcacgggaacccggcgaaaagggccagagtccactgaccgcttccctctccgtgccaaaaagaatcattatacaactaaccggacccg

SEQ ID NO: 24500 - DNA, 664 bp, Zea mays
  misc_feature: Ceres CLONE 1395660-F
  misc_feature (239)..(239): n is a, c, t, g, unknown, or other
  misc_feature (309)..(309): n is a, c, t, g, unknown, or other
aaagctggagctccccgcggtggcggccgctctagaactagtggatcccccgggctgcaggaattcgcacgagaccattacctagaacatcctaatcgaaaaacttccaccccggaccgacaaagcagagcacgcgctggcagccaagtgcacacagacacgtctctctgttcgttctcagcttgctatagcaacctctagtaggtagccatggagatggtcctggactggcgctcgcntgggctccctgctggcgaccgtcgtggtgttccgcaccgcgctgcgtaacttccctgccgccgggagggnccaaaaatgggttcttgggggcccgggttttttccccggggggggggggcccccccccccggtttttccccccccccccccaaaaaaaaacccctcctctctccttctagagaaaaaggggggggggccccccgccgggggggggaccccccaccaagagggggggggtttttttctgggggggggggcccccccccccccccccgggggggggaaaaaaaaaaaacgccccccccccgccggggggtggtgtttttttaaaaaaaaaaaaaaaaaaaaaatttttggggggggggggggggggggaggggcccccccccccccccccccccccggccgcccccggggggggggg

SEQ ID NO: 24501 - DNA, 750 bp, Zea mays
  misc_feature: Ceres CLONE 1395662-F
  misc_feature: Encodes the peptide sequence at SEQ ID NO. 24502
  misc_feature (37)..(37): n is a, c, t, g, unknown, or other
  misc_feature (750)..(750): n is a, c, t, g, unknown, or other
gggggaggggtagtggggagaggagggggagatgtgngggaagaagaaacccaaactgggactccccgcggtggcggccgctctagaactagtggatcccccgggctgcaggaattcgcacgagaccattacctagaacatcctaatcgaaaaaatccaacaagcaaacctgcagtcatctcctccatcaccaccaaactcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgaggtcaccaagggcctgcagcgtcacctgcgcccaaggaggaagaacccgcgccctcagcgaaaaaacggcaaagagggccctgcacccccctccctccattctttgaaagcccccttggaaaatgaaatggaaccattggcatgggcgcctgaagcggaggtcttatan

SEQ ID NO: 24502 - protein, 174 aa, Zea mays
  misc_feature: Ceres CLONE 1395662-F
MKSRSMASSAALLVLALALVAATAPQVAEAKKKRAAESGEAAEAKKIQDDFCSTLCEGKKGTDLVVCKESCALSQQSNLVLYGRIQCKGKCTEQKGITAPAMKVCQEECDKAYVVKAAEVTKGLQRHLRPRRKNPRPQRKNGKEGPAPPSLHSLKAPLENEMEPLAWAPEAEVL

SEQ ID NO: 24503 - DNA, 696 bp, Zea mays
  misc_feature: Ceres CLONE 1395663-F
  misc_feature: Encodes the peptide sequence at SEQ ID NO. 24504
  misc_feature (673)..(673): n is a, c, t, g, unknown, or other
aagctggagctcaccgcggtggcggccgctctagaactagtggatcccccgggctgcaggaattcgcacgagaccattacctagaacatcctaatcgaaaaattacaaccgaccaacgcgctttgcaacgcctccgctgcaatcagcccccgcggcgagattgccctgcccctgagtgctagttctcgccgttacgtaaggcttcttggccttgcgtcctccgtctttcgttgctgatacatcgaggtattaaagaagctgcctggttccgggcagcagaggtcgccgccgcctgcagcaatggccgacttctcctggctcacggtgcttggcttcctattcctcaccttcaactcaggcatggcgatttatcggtccaacggtgacgccggctccgtcgctttcgtcgtggtatcttatctcgacctggtggccctgttcgcctgcttgcgctactacgagcagttggatcagcagcactcccaaaagcgcgcgagggtcaaggctgggggttggagcctcacgaccctccttactatcatgttcagttacaaggtggctgagattatgcccctgccagtcaaacttgttgtctggtcgatgccaaccgctaccacctgtggcgggttctacgttttcttcgccacagcgagaaacctgtcatggcaggggngcgccacggcccgcggggccaga

SEQ ID NO: 24504 - protein, 132 aa, Zea mays
  misc_feature: Ceres CLONE 1395663-F
  misc_feature (125)..(125): Xaa is any aa, unknown, or other
MADFSWLTVLGFLFLTFNSGMAIYRSNGDAGSVAFVVVSYLDLVALFACLRYYEQLDQQHSQKRARVKAGGWSLTTLLTIMFSYKVAEIMPLPVKLVVWSMPTATTCGGFYVFFATARNLSWQGXATARGAR

SEQ ID NO: 24505 - DNA, 654 bp, Zea mays
  misc_feature: Ceres CLONE 1395666-F
  misc_feature: Encodes the peptide sequence at SEQ ID NO. 24506
  misc_feature (419)..(419): n is a, c, t, g, unknown, or other
  misc_feature (420)..(420): n is a, c, t, g, unknown, or other
  misc_feature (426)..(426): n is a, c, t, g, unknown, or other
  misc_feature (487)..(487): n is a, c, t, g, unknown, or other
ggagctccccgcggtggcggccgctctagaactagtggatcccccgggctgcaggaattcgcacgagaccattacctagaacatcctaatcgaaaaaggaagctgtccggcaacgagccgctcggcactgggcggtggacgtgcaagagcgatcggaaccgcatcgctcgtctgctcctccaggcctccgcctccctcatcatcactgcagcggcgagaagaacaagggacggtccggcggtggtctccactgacatcgcctaccatggctaccatgctgcgccggtgcatgcggaatctgcgcccgctgcggtctctcgcgagggtccccagaccgatcttcagcgagagtccacatctcttagatgtacaagcaactcagcaaaggcgtctcccaagatgtctacacagaatgctgnncccagntctcaaggacaacttctcagtcgggaagaatgtttcaaagcttgctcttggactcttgtgntcggtgcagcagctatgggtgcactcaacttcggtatatggatcttcgatttaagacagacgttgcctttaacttaaagaagagatgtcgaaagcgggaaataaaatctgaaatccttcggacagaaggtgacaaaacaaacatggagagcaaccctgagtgggcaa

SEQ ID NO: 24506 - protein, 187 aa, Zea mays
  misc_feature: Ceres CLONE 1395666-F
  misc_feature (140)..(140): Xaa is any aa, unknown, or other
  misc_feature (142)..(142): Xaa is any aa, unknown, or other
  misc_feature (163)..(163): Xaa is any aa, unknown, or other
GAPRGGGRSRTSGSPGLQEFARDHYLEHPNRKRKLSGNEPLGTGRWTCKSDRNRIARLLLQASASLIITAAARRTRDGPAVVSTDIAYHGYHAAPVHAESAPAAVSREGPQTDLQRESTSLRCTSNSAKASPKMSTQNAXPXSQGQLLSREECFKACSWTLVXGAAAMGALNFGIWIFDLRQTLPLT

SEQ ID NO: 24507 - DNA, 665 bp, Zea mays
  misc_feature: Ceres CLONE 1395670-F
  misc_feature: Encodes the peptide sequence at SEQ ID NO. 24508
  misc_feature (311)..(311): n is a, c, t, g, unknown, or other
tacccgcggtggcggccgctctagaactagtggatcccccgggctgcaggaattcgcacgagaccattacctagaacatcctaatcgaaaaaacgatcggtcgggactccggactcgggagtcggcactcgggtctcgacgtctcgtctcgtctcgtctcgcctgcccgcagccccttggcttcgttccatccggcttctcggcggcggcggagaggagggggatggcgcaccggctgctgcgggacgcgcaggcggacgggtgggagcggtcggacttccccatcatctgcgagtcatgcctcggcgacnacccctacgtccggatgttaagagctgaatatgacaaagaatgcaaaatttgtgcacgtccttttactgtattccggtggcgtcctgcgcgagatgcaaggtacaagaagactgagatctgccagacatgttgcaagctaaagaatggctggccagtcctgcctgctggatcttgaatatgggctggctggtccggcccaaaaaacagcacctctccatcatttccatggtggcattcccaaggagggtggccaaccccgaaaatttttgcaaaaaaaacttgatagggaggccccaaactgtggaataaccaattgattccccccaagggggaaaggtcccccccaaaaggaa

SEQ ID NO: 24508 - protein, 87 aa, Zea mays
  misc_feature: Ceres CLONE 1395670-F
  misc_feature (30)..(30): Xaa is any aa, unknown, or other
MAHRLLRDAQADGWERSDFPIICESCLGDXPYVRMLRAEYDKECKICARPFTVFRWRPARDARYKKTEICQTCCKLKNGWPVLPAGS

SEQ ID NO: 24509 - DNA, 765 bp, Zea mays
  misc_feature: Ceres CLONE 1395671-F
  misc_feature: Encodes the peptide sequence at SEQ ID NO. 24510
  misc_feature (327)..(327): n is a, c, t, g, unknown, or other
  misc_feature (485)..(485): n is a, c, t, g, unknown, or other
  misc_feature (509)..(509): n is a, c, t, g, unknown, or other
ccagctggagctcaccgcggtggcggccgctctattactagtggatcccccgggctgcaggaattcgcacgagaccattacctagaacatcctaatcaaaaccagatccctcttccctctccgctcccccacgtcatctagtcgccgcccccgctcaccgattgtcctctgctgtggagcgagcaagcagcggcgaagcgatggaggaggagattagaaaggagttccagagtaacggcttctccatcggaggatccggccccgagaaccccgtccagatcctctccacggtgctgacctagggcctcatctacaacatcgaggccngcggcttctgcctcatcctgggtgctctggcccgccgatatgcattttgttgcccataaggatggaaccgtcgtcccattgttggtttttggggcccccctattacgcacacccgcacggatcccccgcgctgttaccacaaatcccacacgcccaanccatctgcgactaacgtctcctcncttcatgcctgaggacaaagccgcagcgcgcgggacggacccgcatcgccgaccccccccacacgttcccacgtcaacgttatctcctgcccctccaagcgctcccgcacgctcgcttacgaacgcttcctgtctcgtgaccacgcgatagaggtagtactgcccgggcgttgcgcacccgccgccacaccgcgcgtacgctgaggttgtttcgtagtcacacgaactcttccctcacgaccctggacgcagaggg

SEQ ID NO: 24510 - protein, 33 aa, Zea mays
  misc_feature: Ceres CLONE 1395671-F
MEEEIRKEFQSNGFSIGGSGPENPVQILSTVLT

SEQ ID NO: 24511 - DNA, 654 bp, Zea mays
  misc_feature: Ceres CLONE 1395672-F
  misc_feature: Encodes the peptide sequence at SEQ ID NO. 24512
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (22)..(22): n is a, c, t, g, unknown, or other
  misc_feature (36)..(36): n is a, c, t, g, unknown, or other
  misc_feature (40)..(40): n is a, c, t, g, unknown, or other
  misc_feature (41)..(41): n is a, c, t, g, unknown, or other
  misc_feature (141)..(141): n is a, c, t, g, unknown, or other
  misc_feature (147)..(147): n is a, c, t, g, unknown, or other
  misc_feature (290)..(290): n is a, c, t, g, unknown, or other
  misc_feature (322)..(322): n is a, c, t, g, unknown, or other
  misc_feature (369)..(369): n is a, c, t, g, unknown, or other
nnnnnnnnnnnnnnnnnaaaancccccccaaacccnaaannaaaaagcgaggcaatttcaaagtgggctccccgcggtggcggccgctctagaatagtggatcccccgggctgcaggaattcgcacgagaccattacctangaacantcctaatcgaaaaaagcaactcgcacgcagcagtacgacgtctctcctctgggtctggggccgagacaccgagcacgtactaccagcaagatggtggcgtctcccagattcaagcccatcgaggagtgctgctcggaggggcnggtcggagcagacggtgggccgccgacctggnacggcacgcctgctcatctcccaggaggcgcggttcccctactaccntcctcggggctctcgagggcgggagggtcctccgcgccgggctgctgctccttgcccgggcggtcggttaagtaacctaagccttcttttccaaggggctggccatcaggaagctggggggacaacccccggggggggggccaagggggcggcaaaaatcaaaaagggggggggggcctcccggggccccccccagggtttttaaccggggggggaaaagggggccaccccccggaaaaaatttgggagaggggggtgttcaaaacctcccctctttccgggggt

SEQ ID NO: 24512 - protein, 68 aa, Zea mays
  misc_feature: Ceres CLONE 1395672-F
  misc_feature (18)..(18): Xaa is any aa, unknown, or other
  misc_feature (29)..(29): Xaa is any aa, unknown, or other
MVASPRFKPIEECCSEGXVGADGGPPTWXGTPAHLPGGAVPLLPSSGLSRAGGSSAPGCCSLPGRSVK

SEQ ID NO: 24513 - DNA, 823 bp, Zea mays
  misc_feature: Ceres CLONE 1395673-F
  misc_feature: Encodes the peptide sequence at SEQ ID NO. 24514
  misc_feature (254)..(254): n is a, c, t, g, unknown, or other
  misc_feature (539)..(539): n is a, c, t, g, unknown, or other
  misc_feature (720)..(720): n is a, c, t, g, unknown, or other
  misc_feature (725)..(725): n is a, c, t, g, unknown, or other
  misc_feature (726)..(726): n is a, c, t, g, unknown, or other
  misc_feature (776)..(776): n is a, c, t, g, unknown, or other
  misc_feature (783)..(783): n is a, c, t, g, unknown, or other
  misc_feature (784)..(784): n is a, c, t, g, unknown, or other
aaagctggagctccccgcggtggcggccgctctagaactagtggatcccccgggctgcaggaattcgcacgagaccattacctagaacatcctaatcgaaaaaaaaaggcactggtcatcgatccgccactacgccacaaaatcctctcctactccggcagttctgctcgccgccgcctccacgatgacggaagacgtgcagatgaacgactcggagccccagcctgcggcctcagctcccgccgtcggggcgncggcgctctccacactacaccatctgaaggagatcgcgtccgtgatcgaggccggttctctgtccaaggaggtccggcggatctcccgcgccttccgcctcaccgtccccgctccggacgccggcggcggggggcggggacgtcttccgccttcctcgccgttccgggtaacccgcggtctcccgaaggcttacggaaggcctgcctgggccccggggcgcccatgcgcggagtgtagctcgagaactggggggggggctgggtgggacgctcgcgggcgatctnatcccccgccgtcccgaacgccccggccgccccgccgggaccccggacattctgggcggcgggtgcgggcttcgcgaggccgtccttcccggccggcggcggcacgagaggcgctcgcccgctaacccgcccgcgcccgcgaccgcgccgccgactgctcccgctgccgtcgcgcgccacnagtannaacccgcgctcggccggcgcggtggggcgggcgccgcccggatccggatnggtcggnngattttctccgggcgtgctttttagacggcgcggaccgg

SEQ ID NO: 24514 - protein, 159 aa, Zea mays
  misc_feature: Ceres CLONE 1395673-F
  misc_feature (24)..(24): Xaa is any aa, unknown, or other
  misc_feature (119)..(119): Xaa is any aa, unknown, or other
MTEDVQMNDSEPQPAASAPAVGAXALSTLHHLKEIASVIEAGSLSKEVRRISRAFRLTVPAPDAGGGGRGRLPPSSPFRVTRGLPKAYGRPAWAPGRPCAECSSRTGGGAGWDARGRSXPPPSRTPRPPRRDPGHSGRRVRASRGRPSRPAAAREALAR

SEQ ID NO: 24515 - DNA, 704 bp, Zea mays
  misc_feature: Ceres CLONE 1395674-F
  misc_feature: Pfam Name: HMG_CoA_synt_C Pfam Description: Hydroxymethylglutaryl-coenzyme A synthase C terminal
  misc_feature: SWISSPROT Homolog: EC 2.3.3.10 Hydroxymethylglutaryl-CoA synthase
  misc_feature (704)..(704): n is a, c, t, g, unknown, or other
aaagctggagctccccgcggtggcggccgctctagaactagtggatcccccgggctgcaggaattctcacgagcaccattacctataacatcctaatctaaaaagaatgacatgactgcacagcggcccaacttttaacatctcagcattagcaggaacgacgaacgtctaactacttcgacaaccacaccagtggagagaaatgaagcaacacgccggggacccctcctaacaaatactccgataacagcgacaacgcctacgaacagctgcctctgtgatctgactagtggcggctccggacagaacacggatcagcgtgcggtggacattgcagtagtgtggacaccgtcacctttcacgtgatagaaccttcggtacttgcagtcaacgcgtgagagataataggtggctagagacagacaacttgtggcttgactggccacgaaatctttcgccccataccggtgctcgatcagctccaggacctcaatagatatctttggcggcaccacatgacttgacttcaatgtctgggaaacatccattatgtttgcaatgattagcaagctgataggtggatgtgcttcattactcgttgaagagaccattgttgatgtcgacccactcttgaggcccgatatgaacagttgagcaactgcaggaggtaggtggaggattcagtttcgatatacacgtctgcn

SEQ ID NO: 24516 - DNA, 750 bp, Zea mays
  misc_feature: Ceres CLONE 1395675-F
  misc_feature: Encodes the peptide sequence at SEQ ID NO. 24517
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (613)..(613): n is a, c, t, g, unknown, or other
  misc_feature (614)..(614): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (625)..(625): n is a, c, t, g, unknown, or other
  misc_feature (627)..(627): n is a, c, t, g, unknown, or other
  misc_feature (630)..(630): n is a, c, t, g, unknown, or other
  misc_feature (632)..(632): n is a, c, t, g, unknown, or other
  misc_feature (638)..(638): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (645)..(645): n is a, c, t, g, unknown, or other
  misc_feature (649)..(649): n is a, c, t, g, unknown, or other
aaagctggagctccccgcggtggcggccgctctagaactagtggatcccccgggctgcaggaattcgcacgagaccattacctagaacatcctaatcgaaaaatccgactaaaaagggccagggccagggccttcgcttgcttactactcctgcttaccacactctaccttgtctcttcacgtgcacacgacgcctcccccaatggctgcggtggcggaggaggaggtgatcgtcgtcggcgcggggcagtcggggctagcgggggcggcgtgcctggccctgcgcggcgtgcgggggctgttcctggtgcgcgacctctgcgtggggcccctgcgccgcgggcgcggcctcgaccgcttcccctccccttccccgggatagtgggtcgttgccttttgggccctccccgcccgaggcccggggacccctgcccagttaaacatttggagaatcgggatggtgaagcccccccttaaaagcctccaccttctgctccctcgatgccccctctatattggcgctaaggcacatttcagctaagacctccctcgggaatctcccgcgctaaggactctggacctgccggtcctttcccccagttagnnnnnnngnncnnnnnnccgncncgngngcgcgngnnnttngggngggggtgggggtgtgggcgcggggggccgccccccccccggccccgcgccgcggcccgccgggggcgcgcccttcgggttgcgcccgtctgtcctgttccg

SEQ ID NO: 24517 - protein, 59 aa, Zea mays
  misc_feature: Ceres CLONE 1395675-F
MAAVAEEEVIVVGAGQSGLAGAACLALRGVRGLFLVRDLCVGPLRRGRGLDRFPSPSPG

SEQ ID NO: 24518 - DNA, 703 bp, Zea mays
  misc_feature: Ceres CLONE 1395676-F
  misc_feature: Encodes the peptide sequence at SEQ ID NO. 24519
  misc_feature (479)..(479): n is a, c, t, g, unknown, or other
  misc_feature (493)..(493): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
caaaagctggagctccccgcggtggcggccgctctagaactagtggatcccccgggctgcaggaattcgcacgagaccattacctagaacatcctaatcgaaaactcccccctgttcccctcgtctcgtcgccgcctacgaaaatggctgcgctcgcgacactcctccgccacagccgccgcagccatgcccacgtcctccccatctcccgtgcgctctccaccaccaccccgaccaccggcggcaccgatcccgttgccatcacgttgtcgtacgccaagagacaactcctccgcgagcgcgatccggaccgcgtggtctccatcctcgacgccatcgacacggcgtccatctccgctgcttccacccggcacgcgctctccctcgccgcgcgccgcctttctcgctcccgccgcttcgctgacgcggaggccctcctctcctccatctcaccgcgtccaccaccgaggccacctcgncgccgtcctgtggntctacgcnnntcgcaactccccgagaaggcatcgacgcgttccgctccgctggcgcgtccttccaacccccaacttcccggttccctttaaggccctcttctccacttcatacgatgtcgccgttacgagggggccctgccccttcggtgagtttcccagggaagttctccttcacccccaagcccattccaatgggatccttggcaggg

SEQ ID NO: 24519 - protein, 146 aa, Zea mays
  misc_feature: Ceres CLONE 1395676-F
  misc_feature (117)..(117): Xaa is any aa, unknown, or other
  misc_feature (120)..(120): Xaa is any aa, unknown, or other
MAALATLLRHSRRSHAHVLPISRALSTTTPTTGGTDPVAITLSYAKRQLLRERDPDRVVSILDAIDTASISAASTRHALSLAARRLSRSRRFADAEALLSSISPRPPPRPPRRRPVXLRXSQLPEKASTRSAPLARPSNPQLPGSL

SEQ ID NO: 24520 - DNA, 675 bp, Zea mays
  misc_feature: Ceres CLONE 1395681-F
  misc_feature: Translation starting site: 469
aagctggagctccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaaccgccccggctcagcctcatcccagccacacccatgcccgtgccaacagccgcatccaagcccgtgccagctgcaggaaacctgcggcgttggcagcaccccgatcctgggccagtgcgtcgagttcctgaggcatcagtgcagcccgacggcgacgccctactgctcgcctcagtgccagtcgttgccggagcagggttgccaacaactcaggcagtgggacccccacaacggtaccag

SEQ ID NO: 24521 - DNA, 762 bp, Zea mays
  misc_feature: Ceres CLONE 1395682-F
  misc_feature: Encodes the peptide sequence at SEQ ID NO. 24522
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
tgagagtccccannnggggaagaagggggaaaaaaaaaggggggtgggcaacaaaaaaaataaaactccaccgcggtggcggccgctctagaatagtggatcccccgggctgcaggaattcgcacgagaccattacctagaacatcctaatcgaaaaatcaccaccactgggtcttcagaccgttagctttatctactccagagcgcagaagaacccgatcgacaccatgagggtgttgctcgttgccctcgctctcctggctctcgctgcgagcgccacctccacgcatacaagcggcggctgcggctgccagccgcgcgacgccggttcatctaccgccgccggagcatctgccacctccggttcagctgccacctccggtgcatatcccaccaccggtccacctggcgccaacggtgcgcctgccaccgccgggccatgtgccgccggcggttcatctgccgccgcccccatgccactaccctactcagccgccccgggctcagccacggtcgcggggccacacccatgcccgtgccaacagccgcatccgaaacccggaacaaaatgggggggaacccggcgaggtatggcaaaaaaccccaaccctggggccaaggcaaaacggggtgcgtgggggaaaacagggggagacaaaaacaaagggggggcataaaggggtggacagcagggggcgaaaatcattccccccccgggggggggggtggacacacaaaacgttagaacaagggggggggggg

SEQ ID NO: 24522 - protein, 149 aa, Zea mays
  misc_feature: Ceres CLONE 1395682-F
MRVLLVALALLALAASATSTHTSGGCGCQPRDAGSSTAAGASATSGSAATSGAYPTTGPPGANGAPATAGPCAAGGSSAAAPMPLPYSAAPGSATVAGPHPCPCQQPHPKPGTKWGGTRRGMAKNPNPGAKAKRGAWGKTGGDKNKGGA

SEQ ID NO: 24523 - DNA, 701 bp, Zea mays
  misc_feature: Ceres CLONE 1395683-F
  misc_feature: SWISSPROT Homolog: EC 3.5.1.14 Aminoacylase
  misc_feature (578)..(578): n is a, c, t, g, unknown, or other
  misc_feature (684)..(684): n is a, c, t, g, unknown, or other
ggagctccccgcggtggcggccgctctagaactagtggatcccccgggctgcaggaattcgcacgagaccattacctagaacatcctaaaaaaaaaaataggacaagccccagcagtttgccactcccacgcgaaacagaagccccagcagggcggcactcccgacgcgacgcccctgcttgccggccgggaggctcactcgactctgcctccacttcctcgtctgtccgttggagcacggcgccgatggcggcggcgccagcgctcgcgcgggagctgctggacgcggcgcgggagccggagttcgcgtagtgacagcgcgacgtgcggcgccggatccaccagcatccggagctggacttccaggagcaccgcaccagcgcgctcgtgcgcgccgagctcgacgcgatcggcgtcccgtacgcctgagccgtcgcgcagacgggcgtcgtgtccaccatcaccggcccccgcgcgggccccgtggtcgcgctccgcgccgacatggacgcgctccccatccagaaaagggagaatgggagctcaagagcaggtaagacgggaagatgcatgcgtgncgtcatgaccccaacgtggcgatgcttctcgagcagctaggtggctcagtctcggaggacgattaaaggactgatagtttttttggctggcttttttgcagagaanttcagtatccgctcacc

SEQ ID NO: 24524 - DNA, 733 bp, Zea mays
  misc_feature: Ceres CLONE 1395687-F
  misc_feature: Encodes the peptide sequence at SEQ ID NO. 24525
  misc_feature (450)..(450): n is a, c, t, g, unknown, or other
ggagctccccgcggtggcggccgctctagaactagtggatcccccgggctgcaggaattcgcacgagaccattacctagaacactcccccgatctccgccactccaaaatgtggcgccgccaccacctcctccggctacttccacctccggccaccgccgccaccgccgcggccccttctcatttcctgcgccacctctctacctcaagcaccccgaccccggccgcctccctggcctcgtccctcgcgtcggcgctcaccgcgctctccacgaccccgccccccgccaccaccccggacgcttacttctccctccacttctccgacgtgcggcctaccaacgcgctcctcgctgaggcgctcgcgctctccccgcccgccacctcccgcgccgctgccgatctcttccgcttcctcgtccgccgccgctcgctccacccctccgacggngcgctcgcgcccatcgttcgccacctcgcccgccgccgcgacttccccgccgtgcgcgcgctcatccaggagtttccaaccgctctcgggcccgccacgctcgacgcctatctccagcagctcaccagagccgggcgcccaacggacgctgtcaaggtgttcgacgaattgccggagcagctccgtaaccgcgaggctctcactttgctgggctcctcgctttcttccgaggtatcccctcgcacgcagaggagctgccaagaaggtcgccagtgagatcttc

SEQ ID NO: 24525 - protein, 205 aa, Zea mays
  misc_feature: Ceres CLONE 1395687-F
MWRRHHLLRLLPPPATAATAAAPSHFLRHLSTSSTPTPAASLASSLASALTALSTTPPPATTPDAYFSLHFSDVRPTNALLAEALALSPPATSRAAADLFRFLVRRRSLHPSDGALAPIVRHLARRRDFPAVRALIQEFPTALGPATLDAYLQQLTRAGRPTDAVKVFDELPEQLRNREALTLLGSSLSSEVSPRTQRSCQEGRQ

SEQ ID NO: 24526 - DNA, 721 bp, Zea mays
  misc_feature: Ceres CLONE 1395689-F
  misc_feature (337)..(337): n is a, c, t, g, unknown, or other
  misc_feature (367)..(367): n is a, c, t, g, unknown, or other
  misc_feature (425)..(425): n is a, c, t, g, unknown, or other
  misc_feature (555)..(555): n is a, c, t, g, unknown, or other
  misc_feature (577)..(577): n is a, c, t, g, unknown, or other
  misc_feature (578)..(578): n is a, c, t, g, unknown, or other
  misc_feature (587)..(587): n is a, c, t, g, unknown, or other
  misc_feature (601)..(601): n is a, c, t, g, unknown, or other
  misc_feature (602)..(602): n is a, c, t, g, unknown, or other
aaagctggagctccccgcggtggcggccgctctagaactagtggatcccccgggctgcaggaattcgcacgagaccattacctagaacatcctaatcgaaaaacttccccatcccgcttgctccgtgccgtggtctccgaggtcggggttcctttccgatttgatccgcccagctggaaaacgaaaatcgctgatgggttttggaaggaaagtcgtcatttcttggtgaggtttccgtttctggatcgactggctgatcgatcgtactagccgccatggcgtcgtcgtgcatcccggccggcggcatccggctgccggacctggagatggtcaaggncgcgccgccgccgccgccgccccgcccggngcactcagcggcgtcctccacgcttctcggaggcgtccaactcgtcccagcctcctcngtcgtcgttggggcgtcgctgtcgctcaagcgcccgcgcacgcccgcggaagcggcccagccagacgtacaacgaggcgggcggcgctgctcgcgtccatgtacccctccgtattcccgtcgcagggggncttgggggggccccgagggggnnggcaccccngctctcgggctcgnnctcggggttggcgacgacccgtcctgggctcgactcctccctcgttccccggttccggaggcacgggcgcttcctcctcgggactggccgccgcgcgaaaagcccccgcggcgtcgcaa

SEQ ID NO: 24527 - DNA, 721 bp, Zea mays
  misc_feature: Ceres CLONE 1395691-F
  misc_feature: Encodes the peptide sequence at SEQ ID NO. 24528
  misc_feature (410)..(410): n is a, c, t, g, unknown, or other
  misc_feature (419)..(419): n is a, c, t, g, unknown, or other
  misc_feature (423)..(423): n is a, c, t, g, unknown, or other
  misc_feature (424)..(424): n is a, c, t, g, unknown, or other
  misc_feature (511)..(511): n is a, c, t, g, unknown, or other
  misc_feature (554)..(554): n is a, c, t, g, unknown, or other
aagctggagctccccgcggtggcggccgctctagaactagtggatcccccgggctgcaggaattcgcacgagaccattacctagaacatcctaatcgaaaaatcgagctgtcccctccctgtgctcttgcgccttgctagcttgcttgcttccctgctccctccctcctcttcctcgtcgcctcttctctggttcttcctggtgtttgccggagcgaggctaggcgcaaggggagggagctgcggtcagccagagctcatcggcgctacgcaagcgcgctgcctggtgtgctgcactgccgaactatcaggggaaaacactgaaataatggaaatcagcttattgcataatgaatctgatgcaggaagcaccagtttgctaccgctgccattgttgtcatatggtccaangatcatggntccnnatacagtaccaccatcatcagactttgagagtatcctgtcaccagagccaatctacagtgatcttcagttgaaagagatgaactacnatgcagcagcattggatgaaagcactgagttccttcccttganttctagggggaatgatggaaggtacaatagcacaactgaaattccaggtttggatggtgtggacttcattgctcaaaaaaattttccggtcccaaaatggagaggtggaggggtttaacaaggagttagacctcccaaaaagggtggtgaatttagtgaaaaggaag

SEQ ID NO: 24528 - protein, 114 aa, Zea mays
  misc_feature: Ceres CLONE 1395691-F
  misc_feature (28)..(28): Xaa is any aa, unknown, or other
  misc_feature (31)..(31): Xaa is any aa, unknown, or other
  misc_feature (33)..(33): Xaa is any aa, unknown, or other
  misc_feature (62)..(62): Xaa is any aa, unknown, or other
  misc_feature (76)..(76): Xaa is any aa, unknown, or other
MEISLLHNESDAGSTSLLPLPLLSYGPXIMXPXTVPPSSDFESILSPEPIYSDLQLKEMNYXAAALDESTEFLPLXSRGNDGRYNSTTEIPGLDGVDFIAQKNFPVPKWRGGGV

SEQ ID NO: 24529 - DNA, 651 bp, Zea mays
  misc_feature: Ceres CLONE 1395692-F
  misc_feature: Encodes the peptide sequence at SEQ ID NO. 24530
  misc_feature (651)..(651): n is a, c, t, g, unknown, or other
tccccgcggtggcggccgctctagaactagtggatcccccgggctgcaggaattcgcacgagaccattacctagaacatcctaatcgaaaaatttttaccgcacatctctccttcctcggcgtctcgcacaccccagcaccttcgtctcccctcccctcccctcccctcccccaacaatcggaaccggatagaaagttcggcttcctcccggacgactcggcgcaaggtcgcagcttttctctcgatttttcgcgcttccccgttttgacgcttgcttcgcatggggattctggagatctttggggcggttcgctgctgagatgtttcgcctcatcacgcgctgctgtgactcccaacagttcttccgacccgaggagcccctgttatgaacggcatgccgatctctgcgtcctctgcggcaagcgtcgacagtggcgcggtggcggccggcacacccatgaagaatgcaacggcggcggacgctctcgccgagatggcgagacatcttaccgtcgacacggaagacaccttcgcgggcctgctggagctcgccgctgacgacgacgcagaggggctgcgcctcgcgctggagcgcgcgccacctgccgccgcggacgaggctggcctctggtacggccgccggaaggtcn

SEQ ID NO: 24530 - protein, 88 aa, Zea mays
  misc_feature: Ceres CLONE 1395692-F
MNGMPISASSAASVDSGAVAAGTPMKNATAADALAEMARHLTVDTEDTFAGLLELAADDDAEGLRLALERAPPAAADEAGLWYGRRKV

SEQ ID NO: 24531 - DNA, 667 bp, Zea mays
  misc_feature: Ceres CLONE 1395692-R
caattgggtaccgggccccccctcgaggtcgacggtatcgataagcttttttttttttttttttgacatcaagaagcagccgtactgggccgatgataaggatagctcaggccagaaccgtcgccattgttcatgccgggaggcattagtggtgagggtccaacggaactaattgattcagccgtagtaacttgcttctccggtggagattccttgaccagtgtatgcacccaagagagatcagggtcgtcaccaccagacctcagctcgaaggacgatgagcgccggagcttacccaattcttcaccatttatgccccaatctggtgtccccgaaggagatccccacttagaccatgatgagcttagaggggagccaagagccgaagctcgcgccgcactaggcccaaggtcacgagagctgagacttctcattgtctgctgctgcttctcccgctggacaagagcagcggctaggtgggagctcattggggagcccgattcgacacatcgtggagacatccggccaagggagggcatcccgagtgatgcttgcagcagcgatgagtgtgaaggtaactgctggttgtccacgccctttggagagtaaactcctgtgttgattggagacagcagtgcttgctgctgctgctggaactgattcagga

SEQ ID NO: 24532 - DNA, 746 bp, Zea mays
  misc_feature: Ceres CLONE 1395694-F
aaagctggagctccccgcggtggcggccgctctataactagtggatcccccgggctgcaggaattcgcacgagaccattacctagaacatcctaaacaaaaaataggacaagccccaggagtttgcgactcccacgcgaaacacaagccccagcagggcggcactcccgacgcgacgcccctgcttgccgcccgggaggttcactcgactctgcctccacttcctcgtctgtccgtatggagcacggcaccgatggcggcggcgccagcgctcgcgcgtgagctgctggacgcgacgcggtagtcggatatcgcgaagtggcagcgcggcgtgcggctccggatccaccagcacccggagctggacttgcaggagcaccgcaccagcgcgctcgtgcgcgtcgagctcgacgcgatcgtcgtcccggacgtctgggccgtcgcgcagacgggggtcatggccaccatcacgggccccgccggggtgccccgtgttcccgctgcgcgacgacatggacgccctcccccatcacggaaatggtacaatgggaggtcaacaccaaagaaagaacgggaaaatgcatgctctgcgtccatgaacccccacttgggggaggctttcttggagaaacttagaggtggtttcctcccccgaagggaacaattttaaagggacctggaaaggttttttttggcgtgggctttttttgggcccgagaaaattttcacaaaaacccctttcttata

SEQ ID NO: 24533 - DNA, 777 bp, Zea mays
  misc_feature: Ceres CLONE 1395695-F
  misc_feature (20)..(20): n is a, c, t, g, unknown, or other
  misc_feature (679)..(679): n is a, c, t, g, unknown, or other
  misc_feature (712)..(712): n is a, c, t, g, unknown, or other
cgggctggagctcaccgcgntggcggccgctctacactagtggatcccccgggctgcaggaattcgcacgagaccattacctagaacatcctaatcgaaaaagcctgcgctccccttctttcccgttcggctcacagcgaagaaggaagccggttagggtttccacctcctttcccctcctctccttcagcgacgaccgcgggccacaccctcgatatccttcccctcggacccggaggtgagcagcagcctccagcgtctgccatgcctgcccgtctcgttattgggaggattccccctgctgacctggagtctttcccgcttctattgccctcggcaggtcttgcccccccgggttcctggggccttgccgggttcggggcccccatcccttctttatgggcctcccttttcccccctttcgtccccccatttcgcctttttcggaacctttccgcccgtgccctcctcgtccgccctttttttcccctttgcgctgatatcttcagttcttttgcgcgatcttatcccgcggcccccccccgccttttattactcccccttttagccccgcgcgccccccatccttcctgattcgtcccccccttcctatgttctcccccatcaccctggcttgtcttttcttacgggattgtcgcgttcgccgcccgtgtcgggncgggggcggggtaattgtctactcgttctgttnaatccccgcgccccccgaatccgttattcgctcgccgcttctcgcggccccgccttctccatcgg

SEQ ID NO: 24534 - DNA, 676 bp, Zea mays
  misc_feature: Ceres CLONE 1395701-F
  misc_feature: Encodes the peptide sequence at SEQ ID NO. 24535
  misc_feature (676)..(676): n is a, c, t, g, unknown, or other
aaagctggagctccccgcggtggcggccgctctagaactagtggatcccccgggctgcaggaattcgcacgagaccattacctagaacatcctaatcgaacaatcgcacatattattgacaccaactaacaacatagaaagccgaatagggaaccaacaatggcatccaaaatcattttgcctccttatgctccttggacttactgcaagtgctgctacggcgaccattttcccgaaaagctcacaagctcctataccttcccttcttccccacgtacctctcatcaccggcgtctactacatgcgaaaacccaatccttcaaccctacaggatccaacagggaatcgcagctggcatcttacctttatcacccttgttcctccaacaatcatcagccctattacaacagttacctttggtgcatttattggcacaaaacatcagggcacaacaactacgacaacttgtgctatcaaaccttgctgcctactctcagcaacagcagtttcttccattcaaccaactaggttcattgaactctgcttcttatttgcaacaacaacaactaccattcatgcagctacctgctgcctacccccagaaatttcttccattcaaccaactggcagcattgaactctcctgcttatttacaacagcaagcactactagcatn

SEQ ID NO: 24535 - protein, 33 aa, Zea mays
  misc_feature: Ceres CLONE 1395701-F
MQLPAAYPQKFLPFNQLAALNSPAYLQQQALLA

SEQ ID NO: 24536 - DNA, 670 bp, Zea mays
  misc_feature: Ceres CLONE 1395704-F
  misc_feature: Encodes the peptide sequence at SEQ ID NO. 24537
  misc_feature (619)..(619): n is a, c, t, g, unknown, or other
aaagctggagctccccgcggtggcggccgctctagaactagtggatcccccgggctgcaggaattcgcacgagaccattacctagaacatcctaatcgaaaatccaagaagagcacgcccactcctccggctcttcttctccaccggcaccagtccaccacctcctgccaccgcgcggccccaaccaaccacaccgcagcgcagcaatggcgggcaacggcgccatcgtggagagcgacccgctgaactggggcgcggcggcggcggagctggccgggagccacctggacgaggtgaagcgcatggtggcgcaggcccggcagcccgtggtgaagatcgagggctccaccctccgcgtcggccaggtggccgccgtcgcctccgccaaggacgcgtccggcgtcgctgtcgagctcgacgaggaggcccgcccccgcgtcaaggccagcagcgagtggatcctcgactgcatcgcccacggcggcgacatctacggcgtcaccaccggcttcggcggcacctcccaccgccgcaccaaggacgggcccgcgctccaggtcgagctgctcaggcatctcaacgccggaatcttcggcaccggcagcgacgggaccctgtnccccgtcggagtcacccccgcgggggaaatgcttggtgcgcatcaaaaccc

SEQ ID NO: 24537 - protein, 154 aa, Zea mays
  misc_feature: Ceres CLONE 1395704-F
  misc_feature: SWISSPROT Homolog: EC 4.3.1.5 Phenylalanine ammonia-lyase
  misc_feature (138)..(138): Xaa is any aa, unknown, or other
MAGNGAIVESDPLNWGAAAAELAGSHLDEVKRMVAQARQPVVKIEGSTLRVGQVAAVASAKDASGVAVELDEEARPRVKASSEWILDCIAHGGDIYGVTTGFGGTSHRRTKDGPALQVELLRHLNAGIFGTGSDGTLXPVGVTPAGEMLGAHQN

SEQ ID NO: 24538 - DNA, 715 bp, Zea mays
  misc_feature: Ceres CLONE 1395705-F
  misc_feature: Encodes the peptide sequence at SEQ ID NO. 24539
  misc_feature (474)..(474): n is a, c, t, g, unknown, or other
  misc_feature (627)..(627): n is a, c, t, g, unknown, or other
  misc_feature (638)..(638): n is a, c, t, g, unknown, or other
tggagctccccgcggtggcggccgctctagaactagtggatcccccgggctgcaggaattcgcacgagaccattacctagaacatcctaatcgaaaagcgattttaccgtggacgactggagagggcgacggggacgaacgagacgaccgtacattcgttatcggactgggaagcagcggcggtacaaagtgtgggagagaaaggagaagagacttgatgtcctcgcagtttgtccaatagatctcctcgccgcctcacccgtctcctcctccgcagcttccccgcgatcccgaccatggagggcgacggtaccaaccttgatgcggcgatagagtcgctcctgaatgtcgagaagcagatgaggctggccggagatgtcgccggcactcggaaggccgtcatcgacatcgtcgagctctgctacaaggccggcgcgtggaagacgctaaacgaccagatcgttctcctatctnagaggagaggccagcttaagcaggctattactgctatggttcagagagcagtggagtatattaatttgacaccaggcattgacacaagcatcgagctaataaaacactgagcagtgtctctgctggcaaaatctatgttgagatagagagagncagattgatcnaaaggcttgcaaaatttaaagaggagcagggacagatttacgaggctgctgatttgatgcaagaaagtgctggtgaa

SEQ ID NO: 24539 - protein, 95 aa, Zea mays
  misc_feature: Ceres CLONE 1395705-F
  misc_feature (60)..(60): Xaa is any aa, unknown, or other
MEGDGTNLDAAIESLLNVEKQMRLAGDVAGTRKAVIDIVELCYKAGAWKTLNDQIVLLSXRRGQLKQAITAMVQRAVEYINLTPGIDTSIELIKH

SEQ ID NO: 24540 - DNA, 682 bp, Zea mays
  misc_feature: Ceres CLONE 1395706-F
  misc_feature: Encodes the peptide sequence at SEQ ID NO. 24541
tggagctccccgcggtggcggccgctctagaactagtggatcccccgggctgcaggaattcgcacgagaccattacctagaacatcctaaaaaaaaaaataggacaagccccagcagtttgccactcccacgcgaaacagaagccccagcagggcggcactcccgacgcgacgcccctgcttgccggccgggaggctcactcgactctgcctccacttcctcgtctgtccgttggagcacggcgccgatggcggcggcgccagcgctcgcgcgggagctgctggacgcggcgcgggagccggagttcgcggagtggcagcgcggcgtgcggcgccggatccaccagcacccggagctggccttccaggagcaccgcaccagcgcgctcgtgcgcgccgagctcgacgcgatcggcgtcccgtacgcctggcccgtcgcgcagacgggcgtcgtggccaccatcaccggccccgccgcgggccccgtgttcgcgctccgcgccgacatggacgcgctccccatccaggaaatggtagaatgggagttcaagagcaaggaagacgggaagatgcatgcgtgcggccatgacgcccacgtggcgatgcttcttggagcagctaggttgcttcagtctcggagggacgatttaaggtactggatagtttttttgggctggcttttt

SEQ ID NO: 24541 - protein, 145 aa, Zea mays
  misc_feature: Ceres CLONE 1395706-F
  misc_feature: SWISSPROT Homolog: EC 3.5.1.14 Aminoacylase
MAAAPALARELLDAAREPEFAEWQRGVRRRIHQHPELAFQEHRTSALVRAELDAIGVPYAWPVAQTGVVATITGPAAGPVFALRADMDALPIQEMVEWEFKSKEDGKMHACGHDAHVAMLLGAARLLQSRRDDLRYWIVFLGWLF

SEQ ID NO: 24542 - DNA, 699 bp, Zea mays
  misc_feature: Ceres CLONE 1395710-F
  misc_feature: Translation starting site: 181
  misc_feature (487)..(487): n is a, c, t, g, unknown, or other
aaagctggagctccccgcggtggcggccgctctagaactagtggatcccccgggctgcaggaattcgcacgagaccattacctagaacatcctaatcgaaaaacggatcacaatcgaatccaacgctactgcctagggtttcctctgtatttcgcctactgcatactgggccgaccacccatggacgccgcagacgcgaccgccgagaccgccgccatcgcgcgatgcctggactcctggaacaccggcacccgggagagtgcgatccgctatctcctctccgaatttctgccggcctccgcgccgggcctgtccgccaccgaccacctcaagctctggaagggcatcttcttctggttctggcacgccgacaagccgctctaccagagctccgtcgcctcgcctccgccgtctccagtcctgcgtaacccgtcgatggtgccgtcttcctcgacgactacctcaccacgctccgccgcgagtgacnccacatcgacgtccaccgcctcgagaagttctacctcctcaactggcggttcttccaccacgccttcctgcttctccatggtaactcctacgcctccgacgacacctcccaggatcgtgacccgtcctgacagacaaggtcctgactccctgaagccgacaacgtcgccgctgccacctcccggaggctcgcataccacggtcgctgaggag

SEQ ID NO: 24543 - DNA, 670 bp, Zea mays
  misc_feature: Ceres CLONE 1395712-F
  misc_feature: Encodes the peptide sequence at SEQ ID NO. 24544
  misc_feature (417)..(417): n is a, c, t, g, unknown, or other
  misc_feature (501)..(501): n is a, c, t, g, unknown, or other
  misc_feature (536)..(536): n is a, c, t, g, unknown, or other
ggagctccccgcggtggcggccgctctagaactagtggatcccccgggctgcaggaattcgcacgagaccattacctagaacatcctaatcgaaaaacctcaggcctcgctcagatctctccgcccgggtccatcttcccaccccaaaccttctcccgcctctctcgtcaacgccgcccgacgagagggatggcggccttgcgggctccggccgcaacgctcctcgtcctcctcgccctagcggcggccggcggcgtggcggccgacggctccgatcaccggtacaagattcgcgagcccgtcccgctctacgccaacaaggtcggcccatttcacaatcccagtgaaacatatcgatatttcgacctgcctttctgctctcctgacaaagtgaaggagaagagcgaggcccttggngaggttctcaatggggatcggttagttgatgcgccttacaagcttgatttccgtgacgaaagtgagtccaagggcagttgctcnaagaagctttactacagagatgtagtgaagttccnggatgcagtggctaaggactactacttccagaggactatgatgatctcccactgtggggcttcatccgtaaagttgaaagggcggcaaggatgatccgagcgagggaaaaaacaatttggacaggacatcatct

SEQ ID NO: 24544 - protein, 146 aa, Zea mays
  misc_feature: Ceres CLONE 1395712-F
  misc_feature (116)..(116): Xaa is any aa, unknown, or other
MAALRAPAATLLVLLALAAAGGVAADGSDHRYKIREPVPLYANKVGPFHNPSETYRYFDLPFCSPDKVKEKSEALGEVLNGDRLVDAPYKLDFRDESESKGSCSKKLYYRDVVKFXDAVAKDYYFQRTMMISHCGASSVKLKGRQG

SEQ ID NO: 24545 - DNA, 672 bp, Zea mays
  misc_feature: Ceres CLONE 1395713-F
  misc_feature: Encodes the peptide sequence at SEQ ID NO. 24546
  misc_feature (466)..(466): n is a, c, t, g, unknown, or other
  misc_feature (467)..(467): n is a, c, t, g, unknown, or other
atagctggagctccccgcggtggcggccgctctagaactagtggatcccccgggctgcaggaattcgcacgagaccattacctagaacatcctaatcgaaaagggagtcggtggtcgggtctcgactcctcggctcgactcggctcgcctgtccgcaatcccttgagatcggtccatcaggcttctctccggcgggggacaggagggagatggggcaccggctgctgcttcacgtcattgtgaactcgtggtatggggcgctacttccctatcatctgcgagtcatgtctcctcgactgcccctacactcggatgccaagagctgaatatgactaacaatgcacaatctgtgcacacccttttactgtattcaggaggccgcctgtgcgatatggcttgcacctcaacactgagatctgacagacatgatgcaagctaaagaatgactgacatgcctggctgtgcnnctttggcatatggtctgcctgttcaggtccgagatacagcactctctatcaattccaatgatgcaattccaaggagtgatgtcaatcgcgaatattttgcagaagagcatgataggagggccagagctggcatagactatgattcatcctatgggaaggctcgcccaaatgataccattctgaagcttcaaaggacagcaccata

SEQ ID NO: 24546 - protein, 76 aa, Zea mays
  misc_feature: Ceres CLONE 1395713-F
  misc_feature (9)..(9): Xaa is any aa, unknown, or other
MTDMPGCAXLAYGLPVQVRDTALSINSNDAIPRSDVNREYFAEEHDRRARAGIDYDSSYGKARPNDTILKLQRTAP

SEQ ID NO: 24547 - DNA, 829 bp, Zea mays
  misc_feature: Ceres CLONE 1395722-F
  misc_feature: Pfam Name: Bindin Pfam Description: Bindin
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (43)..(43): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (207)..(207): n is a, c, t, g, unknown, or other
  misc_feature (208)..(208): n is a, c, t, g, unknown, or other
  misc_feature (217)..(217): n is a, c, t, g, unknown, or other
  misc_feature (221)..(221): n is a, c, t, g, unknown, or other
gggggggggggtggggggnnnttgttttattattatgaatttnttttnnnnnnaaattggagctccccgcggtggcggccgctctagaactagtggatcccccgggctgcaggaattcgcacgagaccattacctagaacatcctaatcgaaaaaaatcacagaacaaacgttcctctcctcttccatcgtcgtcctcgctcccggnnccggctggntagnctagtcccctcttctcgagagcaacccctgtactgtacgtgctaggcacacagctagctgcagctacagcagggcagcaaatggtttctggtgcgggtcatggtgggtacggcggcggcgacgacgggcaggccgtcgacttcgggggcaaccgcggggaacaagtcgaggaacgggaggttggctgcgcgccgggtctgattcctgggcacggaaactggaggaaacgccgtggtccctaatgggccatctcccctgaacccgggggggacgtaccctccggccggggaagtttgaaccctcctcccaatctcccaaggcctcggcccaccggggggagggaccccaaactttccaatggggagaacggcttccaaacctggcttcgccccctccggtggggggggggtttccctccggcccgaaaacccaaacgcttcgggcccggtttaacctcccccctatttgggcaaattcttccggccaaaaaaatggcgcgggccccgagaggcgggggagagctttggctggccccgggggggaaacgcgcggcgcgggcccagaagacaatgcgtctcccgcccacggagggggcctgggaaaccccc

SEQ ID NO: 24548 - DNA, 654 bp, Zea mays
  misc_feature: Ceres CLONE 1395726-F
cgcggtggcggccgctctagaactagtggatcccccgggctgcaggaattcgcacgagaccattacctagaacatcctaatcgaaaagcattctccaatatccacctcctcctcgcccccctctctctctctaaaagaactgaaaagataagggggaaatcctcaagtgctcgttacataaaccctaacctcgttggattcgcagcaaaagcccaccaattggaagccctccgatgttccagctgcatgctggagctgagccgtgctcggtttgacgaaattttgcatcccttctgtgcttggaccacccgattgaggctgtttctccgagggggcgtgccagcggtttcgcggcccaggtcctcacctgtgctatccggcgccgggaatccgggtttgttcccgggtgagaggtcgggctttttgggtggggtcctgtacaggcttggagcttcaatttgccgggcctggagtttggagtcgcgactggccggtgggcggtggaatttgaaggaagtcgccgtcgattttggcaacgcgtttccctggccattttggggggagccaagcctttcctggaatctttggggggggggggttccctccttggtgcggggggaaaaaaaggggggggaccctttgggggccgggcga

SEQ ID NO: 24549 - DNA, 624 bp, Zea mays
  misc_feature: Ceres CLONE 1395731-F
  misc_feature: Encodes the peptide sequence at SEQ ID NO. 24550
  misc_feature (557)..(557): n is a, c, t, g, unknown, or other
  misc_feature (558)..(558): n is a, c, t, g, unknown, or other
tccccgcggtggcggccgctctagaactagtggatcccccgggctgcaggaattcgcacgagaccattacctagaacatcctaatcaaaaactctgttctcgattctcccgcctcgtgctcgccgttccgcgcttcttccctacccagtcctacatcacctccccgtccgtctttggcccgcaaccggcggccctcgccgctgatggactcccactcctccccctcggcggcaccgccggcagctgctgaaaatgcgcggtacacatacagcccgaggctgcggtggcagccggaagttgaggagtacttcaacacggcgtacggccgcgaccactttgcccgcatctctgaggccctggcgcatccgtcttgttattcttgtatccgtgtcaatactctgaagtcttccactgatgctgtcatgcataaactgctggatttagtatgcaaaaatgagctctctgctgaatcatgggattgggaggttgttgagctgaatgggtggagacatcccccaagaagggtgctctctgggtccacaagtgcccctatgggnnctttggaaaaatgggttttgttttggttccagggatcaggggaccaaattgggcctggcatttaag

SEQ ID NO: 24550 - protein, 139 aa, Zea mays
  misc_feature: Ceres CLONE 1395731-F
  misc_feature (119)..(119): Xaa is any aa, unknown, or other
MDSHSSPSAAPPAAAENARYTYSPRLRWQPEVEEYFNTAYGRDHFARISEALAHPSCYSCIRVNTLKSSTDAVMHKLLDLVCKNELSAESWDWEVVELNGWRHPPRRVLSGSTSAPMGXLEKWVLFWFQGSGDQIGPGI

SEQ ID NO: 24551 - DNA, 652 bp, Zea mays
  misc_feature: Ceres CLONE 1395732-F
  misc_feature: Encodes the peptide sequence at SEQ ID NO. 24552
  misc_feature (470)..(470): n is a, c, t, g, unknown, or other
tggagctccccgcggtggcggccgctctagaactagtggatcccccgggctgcaggaattcgcacgagaccattacctagaacatcctaatcgaaaaagtcgtccctgtccctccactcctcccgtcgagcacttggcactgccaatggcggctcccgcccacaccccttcgatgcgcgcaagccaccttctttccccgtgagatcgacgcacctccccctctcgtgcttcattcccgctcgtcgttcgtttcttcggccccgagccgtcgcgcggacgcctccacatctcgtcgtgctttaaggtctttggcctccgccgttcttggacaggggcacaccactgtccaccggtgcccactacgcgaaatacgagtccctcgtgcggctccgtagggtggaagagatccatcaggcggtgagtgtgaggggcgtcgaccacacaaccggaggggagggggtcaatggcgnccgtgccacgcccactctgcacgtggctcgtcgccgcgtgcttatctgcggcatgcgacgctgaaaagcacaagcagaagcatttctgcgcacgcggaacccgcgcttgggggcggtgtcatgctcggccagcgacgccgcctcggggcgcggcgtcgcggcttggcgcgctccgcaaggac

SEQ ID NO: 24552 - protein, 63 aa, Zea mays
  misc_feature: Ceres CLONE 1395732-F
  misc_feature (3)..(3): Xaa is any aa, unknown, or other
MAXVPRPLCTWLVAACLSAACDAEKHKQKHFCARGTRAWGRCHARPATPPRGAASRLGALRKD

SEQ ID NO: 24553 - DNA, 717 bp, Zea mays
  misc_feature: Ceres CLONE 1395738-F
  misc_feature (379)..(379): n is a, c, t, g, unknown, or other
  misc_feature (385)..(385): n is a, c, t, g, unknown, or other
  misc_feature (389)..(389): n is a, c, t, g, unknown, or other
tccccgcggtggcggccgctctagaactagtggatcccccgggctgcaggaattcgcacgagaccattacctagaacatcctaatcaaaagcccttctgtctcctatctccccggagtccccgctgcccagcccggtctcactttccagtctccgagactccgagtctcgctcgcaccccgtcccctgcagcctgtgctctgggttggagggaggtgagctgcgagggagcgcggagggggcgaggagatggaggcagattcggcgaggaagagacttgcattgctggccctgcttctcctggcggcgcccgtccgcccggcctcggcggctccgggtgggaggatggcctgctcagcaatggtgactttgagaagagncaaagngggntggtttttgtaaaaatctgcttctgttggctgaggggtgcatcgtcattcccctgggttggacgatcaacggggcacggtttgaactcccatttcagcaggccaaccaccaggggtggcatggaaaccctgattggtccccacaggggggacccatgcagtaaggggttagggaatgattgctagcgtttggccaagggtggtgacccttttaaaaaaaaggttcccgaaatatgcttattccatttctcaggggttcccccggactggggcacaaactgggagggaccctaattggttcccccggcttaagggggggtggcctcaaa

SEQ ID NO: 24554 - DNA, 688 bp, Zea mays
  misc_feature: Ceres CLONE 1395739-F
  misc_feature: Encodes the peptide sequence at SEQ ID NO. 24555
  misc_feature (511)..(511): n is a, c, t, g, unknown, or other
  misc_feature (512)..(512): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
tggagctccccgcggtggcggccgctctagaactagtggatcccccgggctgcaggaattcgcacgagaccattacctagaacatcctaatcgaaaagagttctcctcaaccaaattcaaagtcacagcggcgaaactctcggcgatgtctggccgcggcaagggcgggaagggtctgggcaagggcggcgccaagcgccaccgcaaggtgctgcgtgacaacatccagggcatcaccaagccggcgatccgcaggttggcgaggaggggcggcgtcaagcgcatctccgggctcatctacgaggagacccgcggcgtgctcaagatcttcctcgagaacgtcatcccgcgacgccgtcacctacaccgagcacgcccgccgcaagactgtgaccggccaattggaccgttgtctacgctctcaagcgccagggcgcaccctctagggtttccggggggggttaggtcgcccctctcccggggcgaattacctgggggggggggggggggnnccgggggtggggtttttggccaannnagaggcgtggctggcttttatgggggggggtgttttggggggggggggtggccctggcctccttcctattttcacagccccgggggctgaaatatcccgccggctggaaaccaagggaaagggcctccgtttcaagcccaaaaaaaaaaa

SEQ ID NO: 24555 - protein, 160 aa, Zea mays
  misc_feature: Ceres CLONE 1395739-F
  misc_feature (123)..(123): Xaa is any aa, unknown, or other
  misc_feature (131)..(131): Xaa is any aa, unknown, or other
MSGRGKGGKGLGKGGAKRHRKVLRDNIQGITKPAIRRLARRGGVKRISGLIYEETRGVLKIFLENVIPRRRHLHRARPPQDCDRPIGPLSTLSSARAHPLGFPGGVRSPLSRGELPGGGGGGXGGGVFGQXRGVAGFYGGGCFGGGGWPWPPSYFHSPGG

SEQ ID NO: 24556 - DNA, 637 bp, Zea mays
  misc_feature: Ceres CLONE 1395740-F
  misc_feature (95)..(95): n is a, c, t, g, unknown, or other
  misc_feature (175)..(175): n is a, c, t, g, unknown, or other
  misc_feature (247)..(247): n is a, c, t, g, unknown, or other
ggagctcaccgcggtggcggccgctctagaactagtggatcccccgggctgcaggaattcgcacgagaccattacctagaacatcctaatcgaanagtgttgccaaagttatcgttgtcttctctagcgacggcgaggcttgagcgctcacgtccaggcgttccccgtgccgtgnccaagccagcagccgacgagatggactacctcaagacggtgggttccgtcaccactcttggcagagcgcggnttcaatcttgtcgtcatcaacccaggatcgggaaaatgggccaaagggggtttccaaaccaggatgggccatttaaaaatacccacttggtttggcccaaaccttccttcccccaaaagggggaaaaaaacaaaaatttcttgggggggaaaaaaaaagggccaaaggggcggggtttttttttcccaaaaaagggaaaggggggggaggggggctttttattattttttgcccccccgtggaaaaaaaccccttttttttgggagaagagaaaaaaaaagttttttacaaaagaaaaccccctttccccaaaaagggaggggggggggggggggggggttctccccccccccccaaaagggggggggcgttaaatatattcttggcggg

SEQ ID NO: 24557 - DNA, 664 bp, Zea mays
  misc_feature: Ceres CLONE 1395743-F
  misc_feature: Encodes the peptide sequence at SEQ ID NO. 24558
  misc_feature (308)..(308): n is a, c, t, g, unknown, or other
  misc_feature (309)..(309): n is a, c, t, g, unknown, or other
  misc_feature (343)..(343): n is a, c, t, g, unknown, or other
  misc_feature (391)..(391): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
cgcggtggcggccgctctagaactagtggatcccccgggctgcaggaattcgcacgagaccattacctagaacatcctaatcgaaaaaggcaacacagcaatcagcagaaaaacatctccttggccttccatccatatgatccatccctccaggctccagctaactccaaactaccctctggttcgactcgcgttcgcatcgcaagcagcagcgtaccatcgaggcaatggcggtgatggccgaagtagtgtcgaccaccggcgcggcgctccggagcccggccacgcagcagcccggcggcggcggnncgcggcgaaaggcaccgacgctgagaagctccgnttcatcgaggacatgacctccaacgtggacgccgtgcaagagcgcggnctttggggggaagatcctcgccccgcacgcggacacgagtacctctcccgggagggggggcgccctccgcgggggtacggaccggccactccccgggcaggggggccaaagtgggaaaaacaacagagacactggaaccgaaaatccggggtatttccgcgagaagggccgttcgcccctttcgttgtggggggggaaccgggggtctcccgggttcctcaccgatttccagacaaattcctgggagatagcagaagggcgcnnnnnngcnnn

SEQ ID NO: 24558 - protein, 43 aa, Zea mays
  misc_feature: Ceres CLONE 1395743-F
  misc_feature (28)..(28): Xaa is any aa, unknown, or other
  misc_feature (39)..(39): Xaa is any aa, unknown, or other
MAVMAEVVSTTGAALRSPATQQPGGGGXRRKAPTLRSSXSSRT

SEQ ID NO: 24559 - DNA, 578 bp, Zea mays
  misc_feature: Ceres CLONE 1395747-F
  misc_feature (216)..(216): n is a, c, t, g, unknown, or other
  misc_feature (283)..(283): n is a, c, t, g, unknown, or other
  misc_feature (323)..(323): n is a, c, t, g, unknown, or other
  misc_feature (465)..(465): n is a, c, t, g, unknown, or other
  misc_feature (466)..(466): n is a, c, t, g, unknown, or other
  misc_feature (485)..(485): n is a, c, t, g, unknown, or other
  misc_feature (489)..(489): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
tccccgcggtggcggccgctctagaactagtggatcccccgggctgcaggaattcgcacgagaccattacctagaacatcctaatcgaaaaacacaatacgcacacttcgcaaagcgtcttcctccgaccccatcgcctctgtggcttcctggctgtctgactgcgtctgcctggtcgtacgcgagcgcgtgcgtcccttcaccgtcacgagcggngcacaccgtcaccgccacgctccgtcgccttccagaaaatctaaaccccagcggagccggccacggncagtcagccctcacacggactccgacgcgctgcccgctcngctgccaacccccaccccctcgcccgcgatgctgccgcgtcgctttagaaccacccgggttcctctccaccctccggttcctcgtcggtctgcggctgctcctcggctgggggccgaaattttcccccgggcgcgggccgcnnaggagcccttggccccggngggngggggnnnncgggctttgtcccaaaagggccccccgggggaaaaaccccggggggctccagggggggaaaggggaaaggcccccggcat

SEQ ID NO: 24560 - DNA, 630 bp, Zea mays
  misc_feature: Ceres CLONE 1395749-F
  misc_feature: Encodes the peptide sequence at SEQ ID NO. 24561
  misc_feature (237)..(237): n is a, c, t, g, unknown, or other
  misc_feature (300)..(300): n is a, c, t, g, unknown, or other
  misc_feature (601)..(601): n is a, c, t, g, unknown, or other
ggagctccccgcggtggcggccgctctagaactagtggatcccccgggctgcaggaattcgcacgagaccattacctaagaacatcctaatcgaaaaaggctggatttgagcctgtttagcagcgctatccgcttggcccaattcgtctactgctcctccagctcctccgctgcgccgccggtcgccgcccgacaccgccgaagaagagcagacgccgagtccaggacgtcgccgcngggctcggggaacgcggtgttgccatcgcgaggaaggtcggaagttcgctggtcgcccgccgnatcggcaccgtcgccaccgcccatggcaaccgtcgcccccgtcgtctccgaactcgtcgacttcctcaacgcgtcgcccaccgcctttcacgccgttgacgaggcaaaacgcgcctgaagcggcgggttcctgcaactgtcgaacggaaagaagggccggttctccacccggggggaagtattttttcaacgaaccacctcccaattggcgttttggcccgggggaaaaaacgttgggggaaagggcctcccccaatcggggaacccgggggaggcccttggcgggaagtaaacgctggtnacaaaggagcccagagagggcccctgggg

SEQ ID NO: 24561 - protein, 31 aa, Zea mays
  misc_feature: Ceres CLONE 1395749-F
MATVAPVVSELVDFLNASPTAFHAVDEAKRA

SEQ ID NO: 24562 - DNA, 654 bp, Zea mays
  misc_feature: Ceres CLONE 1395754-F
  misc_feature: Translation starting site: 150
tccccgcggtggcggccgctctagaactagtggatcccccgggctgcaggaattcgcacgagaccattacctagaacatcctaatcgaaaaaatctgaagcaaaatgtaccggtaatgttgaagagcggcactcttatccagtactgagatgcggcggtggtggtcgccggcgttggcgcctgtggagccgcggtccgtgcagctcctgctcctgggcgtcgctctcgtcgcagcttctttctacgccggcaccctcttcggctcctccgcgtcccctgcgctcgtactgcccccttcgcgcccccgatcgcccgattccttcagggccaaaagttacagatgttccagtgtttaccaacagagtttctcgtacgtgccgggcaaaatcagtgacagttccagatcacggaggttgatgtgtgtcctttggaaacaaatgagtatgtcccctgccatgatggagcctatataagcagcttgaagagcctggatactctagggcatgaggatcttggaaagtatttgtcctcctgggaagaagggggtggttttgtttggcgccccctccaatgactacagataccaataagatggcccacagccgagactacttatgggggtaggaatggcacccttcccatcttggtgggggg

SEQ ID NO: 24563 - DNA, 626 bp, Zea mays
  misc_feature: Ceres CLONE 1395755-F
  misc_feature: Encodes the peptide sequence at SEQ ID NO. 24564
  misc_feature (215)..(215): n is a, c, t, g, unknown, or other
tggagctccccgcggtggcggccgctctagaactagtggatcccccgggctgcaggaattcgcacgagaccattacctagaacatcctaatcgaaaaaagagcgtgcagagcgagacgcgtcgcctcctcccttcccccaccccgccgccgccctcgcgtccgtccgtccgtccgttattttagggtcggtcgccgccatggcgatcctctcggncgctcgccacgaggtgctcatcccccgtcgcgccgtcatcggatcgccttcgccgtcgtggaagggggtgggctggtcccgcgggaaactctccccggcgcggcccggggggggggggggaaaaggcgggttacccgactccccatcgggggggggggggggggttaaagaaccaaaaggtggtgttaggggggcccaaaacaaaaaagccttcccggggggaaaaaatttttttttttccccggaaacaaaagggggggaactcttgggggaaatctcgggggggggagccccccctcccctgggggggggggggggggggttcccaaagaaagagcccccccgggtttttattggggggaaatttgggggcccgcgcgggtaaaacaccccctttaaaaagggggggcg

SEQ ID NO: 24564 - protein, 133 aa, Zea mays
  misc_feature: Ceres CLONE 1395755-F
  misc_feature (6)..(6): Xaa is any aa, unknown, or other
MAILSXARHEVLIPRRAVIGSPSPSWKGVGWSRGKLSPARPGGGGGKGGLPDSPSGGGGGVKEPKGGVRGAQNKKAFPGGKNFFFSPETKGGELLGEISGGGAPPPLGGGGGGFPKKEPPRVFIGGKFGGPRG

SEQ ID NO: 24565 - DNA, 650 bp, Zea mays
  misc_feature: Ceres CLONE 1395756-F
  misc_feature: Encodes the peptide sequence at SEQ ID NO. 24566
  misc_feature (563)..(563): n is a, c, t, g, unknown, or other
  misc_feature (567)..(567): n is a, c, t, g, unknown, or other
tccccgcggtggcggccgctctagaactagtggatcccccgggctgcaggaattcgcacgagaccattacctagaacatcctaatagaaaaactgccaactcgcacgcagcagtacgacgtctctcctctgggtctggggccgagacaccgagcacgtactaccagcaagatggtggcgtctcccagattcaagcccatcgaggagtgctgctcggaggggcggtcggagcagacggtggccgccgacctggacggcacgctgctcatctccaggagcgcgttcccctactacctcctcgtggctctcgaggccggcagcgtcctccgcgccgcgctgctgctcctgtccgtgccgttcgtctacgtcacctacgccttcttctccgagtcgctggccatcagcacgctggtgtacatctccgtggcggggctcaaggtgcgcagcatctagatggtggcgcgctccgtgctccccaggttctacgcgggcgacgtgcacccgagagagtttggagggtgttcagctccttcggcaggcgctacgtcgtcacgccagccccangggntcatggtcgagcccttcgccaggccttctagcgcccgaaaaaggtcgcgggacccaaaaatttgtggggggccacaagggaac

SEQ ID NO: 24566 - protein, 93 aa, Zea mays
  misc_feature: Ceres CLONE 1395756-F
  misc_feature: SWISSPROT Homolog: EC 2.3.1.15 Glycerol-3-phosphate O-acyltransferase
MVASPRFKPIEECCSEGRSEQTVAADLDGTLLISRSAFPYYLLVALEAGSVLRAALLLLSVPFVYVTYAFFSESLAISTLVYISVAGLKVRSI

SEQ ID NO: 24567 - DNA, 652 bp, Zea mays
  misc_feature: Ceres CLONE 1395758-F
  misc_feature: Encodes the peptide sequence at SEQ ID NO. 24568
  misc_feature (590)..(590): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (610)..(610): n is a, c, t, g, unknown, or other
tccccgcggtggcggccgctctagaactagtggatcccccgggctgcaggaattcgcacgagaccattacctagaacatcctaatcaaaataattttgaattttgacaagttagttatagcttagcagaaaacttctatggttctttgtttgtcaacttttcaggatgataagctaacatatgtcacaaacttcatggaccatcttgtctcttggcatactgtcactctacgcatgatgcgtgcagagtcttttgtgaaccttggtgagccaaatatcctagaggcttgagctatagatacaccctagttatcatcatgaggtaataattcagtactttgatgcattgcacctagcacatatatatcttaatcacgtacttcaatgcaagaaacagggacactgtttagtttctttgtgcttttttcccagctatcgagtaacctttaatagtagaaattaatggaaattcaattcatatttcataaggtttgtagtgctcctctcatggtacaacaaaactttttcttggaaaattagtacatgggaaacataatactagatttggaaaattgatgttctgcacatganattcggnnnacatgggaggntttttttaaaaaagagggtttcttttttcaatttactaaggg

SEQ ID NO: 24568 - protein, 50 aa, Zea mays
  misc_feature: Ceres CLONE 1395758-F
MVLCLSTFQDDKLTYVTNFMDHLVSWHTVTLRMMRAESFVNLGEPNILEA

SEQ ID NO: 24569 - DNA, 655 bp, Zea mays
  misc_feature: Ceres CLONE 1395764-F
  misc_feature: Encodes the peptide sequence at SEQ ID NO. 24570
  misc_feature (459)..(459): n is a, c, t, g, unknown, or other
  misc_feature (644)..(644): n is a, c, t, g, unknown, or other
  misc_feature (646)..(646): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
cggtggcggccgctctagaactagtggatcccccgggctgcaggaattcgcacgagaccattacctagaacatcctaatcgaaaaaaaccctaaccccatcccgcactccccccctcccccaacacgcgcgtgctttcttagccgctaagcatatccctccccgccacgatctcgatggtggagatgtctgtggtggagctcaggacgctgccgctcggcttccgcttccaccccaccgacgaggagctcgtcacccactacctcaagggcaagatcaccggcaggatcaactccgagtccgaggtcatccccgagatcgacgtctgcaagtgcgagccgtgggacctcccagataagtccctgatccggtccgacgaatcctgagtggttcttcttcgcccccaaggaccgcaagtacccccaacggtagcaggtcgaacagggccaccgaggcgggnatactggaaggctactggcaaggacaggataatcaaatccaagggcgacaagcgcaagcagcataccatccgggtatgaagaagaccctcgtctttccaccgtggtcgtgcccccaaggggagcgccacggggggtggatttatgcacgagtaccgcaccaccgagccttgagttcgatccgggnancaannnnnn

SEQ ID NO: 24570 - protein, 69 aa, Zea mays
  misc_feature: Ceres CLONE 1395764-F
  misc_feature (12)..(68): Pfam Name: NAM Pfam Description: No apical meristem (NAM) protein
  misc_feature: The sequence is a functional homolog of SEQ ID NO 1438 in the 10/666,642 US patent application
  misc_feature: The sequence is a functional homolog of SEQ ID NO 208 in the 10/666,642 US patent application
  misc_feature: The sequence is a functional homolog of SEQ ID NO 2100 in the 10/374,780 US patent application
  misc_feature: The sequence is a functional homolog of SEQ ID NO 270 in the 10/714,887 US patent application
  misc_feature: The sequence is a functional homolog of SEQ ID NO 270 in the 11/435,388 US patent application
  misc_feature: The sequence is a functional homolog of SEQ ID NO 2022 in the 10/374,780 US patent application
  misc_feature: The sequence is a functional homolog of SEQ ID NO 24 in the 10/714,887 US patent application
  misc_feature: The sequence is a functional homolog of SEQ ID NO 24 in the 11/435,388 US patent application
  misc_feature: The sequence is a functional homolog of SEQ ID NO 2694 in the 10/374,780 US patent application
  misc_feature: The sequence is a functional homolog of SEQ ID NO 662 in the 10/225,066 US patent application
MVEMSVVELRTLPLGFRFHPTDEELVTHYLKGKITGRINSESEVIPEIDVCKCEPWDLPDKSLIRSDES

SEQ ID NO: 24571 - DNA, 671 bp, Zea mays
  misc_feature: Ceres CLONE 1395765-F
  misc_feature: Encodes the peptide sequence at SEQ ID NO. 24572
  misc_feature (400)..(400): n is a, c, t, g, unknown, or other
  misc_feature (522)..(522): n is a, c, t, g, unknown, or other
  misc_feature (550)..(550): n is a, c, t, g, unknown, or other
  misc_feature (596)..(596): n is a, c, t, g, unknown, or other
  misc_feature (668)..(668): n is a, c, t, g, unknown, or other
  misc_feature (671)..(671): n is a, c, t, g, unknown, or other
tccccgcggtggcggccgctctagaactagtggatcccccgggctgcaggaattcgcacgagaccattacctagaacatcctaaaaaaaaagcagtccaaacacgcaacgcaacactcgccttcccctcccaaccctccgaaccgaagcagcaaagctagacgatgacgctgacgatcccggacgaggtgcgcgccaaggcggaggtgtacgtgggcgacgcggcggggcaggagaagacgcggctgctcctccaggagacgggcctcccgagcgggctgctcccgctgcgggacatcatcgagtgcggctacgtggaggagacgggcttcgtgtggctccggcagcgccgcaaggtggaccactacttcgccaaggccggccgccacgtgtcctacggncgccgaggtggtcggcgggggccgaacaagggccggctcaagaagaatcacggggcgtcaaggccaaggaggatgcttgctgtgggtcacccctccacgagatccttgcgtcgacgacccgncccacgggtaagctccactgcagggggncattcggcggccctgtcccgcagcttttccccgtcgagggccttcnaaagccccgaggaagccggcgccgccgcgaaaaccccggggggggtcgttcccagggggggggccggggganaan

SEQ ID NO: 24572 - protein, 168 aa, Zea mays
  misc_feature: Ceres CLONE 1395765-F
  misc_feature (2)..(155): Pfam Name: DUF538 Pfam Description: Protein of unknown function, DUF538
  misc_feature (120)..(120): Xaa is any aa, unknown, or other
  misc_feature (145)..(145): Xaa is any aa, unknown, or other
MTLTIPDEVRAKAEVYVGDAAGQEKTRLLLQETGLPSGLLPLRDIIECGYVEETGFVWLRQRRKVDHYFAKAGRHVSYGRRGGRRGPNKGRLKKNHGASRPRRMLAVGHPSTRSLRRRPXPRVSSTAGGHSAALSRSFSPSRAFXSPEEAGAAAKTPGGVVPRGGAGG

SEQ ID NO: 24573 - DNA, 645 bp, Zea mays
  misc_feature: Ceres CLONE 1395767-F
  misc_feature: Encodes the peptide sequence at SEQ ID NO. 24574
  misc_feature (388)..(388): n is a, c, t, g, unknown, or other
  misc_feature (482)..(482): n is a, c, t, g, unknown, or other
cgcggtggcggccgctctagaactagtggatcccccgggctgcaggaattcgcacgagaccattacctagaacatcctaatcgaaaaacgcacctcccgacttctccggttctcccttcttcatagcagccacccacgcatctcagcgccgaggcgagcgaggacctcgtggttcgtgccctgctcacctcgtgaggatgtggatcgcgagccggctcttcctcgcggcggcggcgctgctgatggctgtgcttctgctcgtcgcggggccggtggcggcgcaggacgcggcggtggagggcgtggccccgcctgcggaggagatcgcggcgaacgcgagggccaagggaggcggtggttctggccgccgagctagtgcagctcaggncgaagatctccgcgttagagtctcgcatttgcagagcagaaacctggagttcaagaccaagaatgatgcaatcgaaacactggaatatgattgntcaaggaaaagtcacagaagattgctactatgcagaatgaagcccaaagggtctttagctgccagaggagcaagcaagcaagggcaatgcactggctatttgagctcagaagcagaccgagaagctcaagaaggatattacagaacaaaaaataaaaaagcag

SEQ ID NO: 24574 - protein, 149 aa, Zea mays
  misc_feature: Ceres CLONE 1395767-F
  misc_feature (64)..(64): Xaa is any aa, unknown, or other
  misc_feature (95)..(95): Xaa is any aa, unknown, or other
MWIASRLFLAAAALLMAVLLLVAGPVAAQDAAVEGVAPPAEEIAANARAKGGGGSGRRASAAQXEDLRVRVSHLQSRNLEFKTKNDAIETLEYDXSRKSHRRLLLCRMKPKGSLAARGASKQGQCTGYLSSEADREAQEGYYRTKNKKA

SEQ ID NO: 24575 - DNA, 682 bp, Zea mays
  misc_feature: Ceres CLONE 1395769-F
  misc_feature: Encodes the peptide sequence at SEQ ID NO. 24576
  misc_feature (441)..(441): n is a, c, t, g, unknown, or other
aaagctggagctccccgcggtggcggccgctctagaactagtggatcccccgggctgcaggaattcgcacgagaccattacctagaacatcctaatcgaaaaaaactcacagcacaaacgttcctctcctcttccatcgtcgtcctcgctcccggccccgcctgtctagtctagtcccctcttctcgcgtgcaacccctgtactgtacgtgctaggcacacagctagctgcagctacagcagggcagcaaatggtttctggtgcgggtcatggtgggtacggcggcggcgacgacgggcaggccgtcgacttccggggcaacccggcggacaagtcgaggaccggaggctggctgggcgccgggctgatcctgggcacggagctggcgaagcgcgtgtgcgtgatgggcatctccatgaacctggtgacgtacctcgtcgncgagctgcacctctcccactcccagtccgccaccgtggtgacccacttcatggggacgctcaacctgctcgccctcgttcggggtttcttcgcgacgccaagctcggcgctacctcacattcgcatcttcgcaaaatcgccgcacggggggggacttgttgacgggggaaccaacgtggcccaaatggctcccccgggtggcttgaacccccgggggccgccggccaccaatggttgccgg

SEQ ID NO: 24576 - protein, 144 aa, Zea mays
  misc_feature: Ceres CLONE 1395769-F
  misc_feature (64)..(64): Xaa is any aa, unknown, or other
MVSGAGHGGYGGGDDGQAVDFRGNPADKSRTGGWLGAGLILGTELAKRVCVMGISMNLVTYLVXELHLSHSQSATVVTHFMGTLNLLALVRGFFATPSSALPHIRIFAKSPHGGGLVDGGTNVAQMAPPGGLNPRGPPATNGCR

SEQ ID NO: 24577 - DNA, 695 bp, Zea mays
  misc_feature: Ceres CLONE 1395771-F
  misc_feature: Encodes the peptide sequence at SEQ ID NO. 24578
aagctggagctccccgcggtggcggccgctctagaactagtggatcccccgggctgcaggaattcgcacgagaccattacctagaacatcctaatcgaaaaagtgctcgcgtggtccgcgttctctctctctctaagccaatggcagctacctctgagaccggtgcgaccactcggcaagaccattttcttccggccacttgactaggcctcgacctcggtctcggagccgcctccgtccaccggacgcggcagccatggcgccagcggtgggacttacgcgctccgccgcgcataccagcactctgccgccgcccgacatgcggagtggtgcgcacgatgacatgcgctccatgatcccgtcacagcccgccgtggagccggtccctacggagagacagaccactcgccgcggagatgcaggtcttcctgtgcctgcaagagtaggacgacaggctcttgatctacgtggtggacatcggtcgacgctaagggtagcagcacgggcgtctacgtcccaggtgaggctgcagtatgtccgtgccgctgcactccaccatctccctggcgaagaaatatgtgattcgaatatcatatacggcgtctgaagctaacagacactggtactcgttccatggaccttacatgactggaggtctctaaaaaattcttgggatgacaaagaaatttaaactc

SEQ ID NO: 24578 - protein, 116 aa, Zea mays
  misc_feature: Ceres CLONE 1395771-F
MAPAVGLTRSAAHTSTLPPPDMRSGAHDDMRSMIPSQPAVEPVPTERQTTRRGDAGLPVPARVGRQALDLRGGHRSTLRVAARASTSQVRLQYVRAAALHHLPGEEICDSNIIYGV

SEQ ID NO: 24579 - DNA, 719 bp, Zea mays
  misc_feature: Ceres CLONE 1395775-F
  misc_feature: Encodes the peptide sequence at SEQ ID NO. 24580
  misc_feature (697)..(697): n is a, c, t, g, unknown, or other
aaagctggagctccccgcggtggcggccgctctagaactagtggatcccccgggctgcaggaattcgcacgagaccattacctagaacatcctaatcgaaaaggacgcaccggccatggcatctgcacgggctgctgctgcctgctgatagagtggacaatgcatgagctgctgcagatagaatagaacgctgccggcagggtctgctgctgatagatgcatgtatagatagagacgctgctgctagctgccggccggtgcagactgcagaccacgggaggcgcgggcgcgcgctataaaagccgagccagtgggcgcggccagtgtcacaactcacatcgaggtctcagcttcaggaaagggaaggaagcatgttcgggcaccaccacggccacggcgggcaccaccaggccccgccgccgcacgagcagacgctgttcaggatcttctgccgcgccgacgaggcgtactgcctcaccgtgcgtcacgacgccgtcgtcctcgcgcccaccaacccccgcgacgagtaccagcactggtacaaggacatgaggcacagcacgaaggtgaaggacgcggagggccagccagcgttcgcgctcatcaacagggccaccggcctcgccatcaagcactcgctcggccagtcccatcccgtgaagctggtgccctacaacgcggagtacctggacgagtncgtgctgtggacggagagccac

SEQ ID NO: 24580 - protein, 116 aa, Zea mays
  misc_feature: Ceres CLONE 1395775-F
  misc_feature (109)..(109): Xaa is any aa, unknown, or other
MFGHHHGHGGHHQAPPPHEQTLFRIFCRADEAYCLTVRHDAVVLAPTNPRDEYQHWYKDMRHSTKVKDAEGQPAFALINRATGLAIKHSLGQSHPVKLVPYNAEYLDEXVLWTESH

SEQ ID NO: 24581 - DNA, 697 bp, Zea mays
  misc_feature: Ceres CLONE 1395779-F
  misc_feature: Encodes the peptide sequence at SEQ ID NO. 24582
  misc_feature (433)..(433): n is a, c, t, g, unknown, or other
  misc_feature (457)..(457): n is a, c, t, g, unknown, or other
  misc_feature (519)..(519): n is a, c, t, g, unknown, or other
  misc_feature (586)..(586): n is a, c, t, g, unknown, or other
  misc_feature (590)..(590): n is a, c, t, g, unknown, or other
  misc_feature (593)..(593): n is a, c, t, g, unknown, or other
  misc_feature (623)..(623): n is a, c, t, g, unknown, or other
  misc_feature (641)..(641): n is a, c, t, g, unknown, or other
  misc_feature (642)..(642): n is a, c, t, g, unknown, or other
aagctggagctccccgcggtggcggccgctctagaactagtggatcccccgggctgcaggaattcgcacgagaccattacctagaacatcctaatcaaaaagtttcctcctccactccctcccccccgcctccactaccccactcccaggcgccgcacaggtacgtcgccggcggcgatgacgacgcgcttcaagaagaaccgcaagaagcgcggccacgtgtccgccgggcacggccgcatcggcaagcacaggaagcatcccggaggtcgcggtaacgccggtggcatgcaccaccaccgcatcctcttcgacaagtaccatcccggctacttcggtaaggtcggcatgcgctacttccacaagctccgcaacaagttctactgccccgcggtcaacatcgagcgcctctggtcgatggtgcccgccgaanaggcggcggaagccggcggcgacnaggccccgcagatcgacgtcacgcagttcggctactttcaggtgctcgggaagggggtgctngcgcccaagcccatcgtcgtcaaggccagctcatctccaaggtcgccgagaagaagatcaagggcgnccgncgncgccgtcgtgctcaccggctagtttccagnccttaatcgccctctggnntttgaggactatatctgaactagcaggggtttcctggcccccccaaattggggaa

SEQ ID NO: 24582 - protein, 145 aa, Zea mays
  misc_feature: Ceres CLONE 1395779-F
  misc_feature (86)..(86): Xaa is any aa, unknown, or other
  misc_feature (94)..(94): Xaa is any aa, unknown, or other
  misc_feature (137)..(137): Xaa is any aa, unknown, or other
  misc_feature (138)..(138): Xaa is any aa, unknown, or other
  misc_feature (139)..(139): Xaa is any aa, unknown, or other
MTTRFKKNRKKRGHVSAGHGRIGKHRKHPGGRGNAGGMHHHRILFDKYHPGYFGKVGMRYFHKLRNKFYCPAVNIERLWSMVPAEXAAEAGGDXAPQIDVTQFGYFQVLGKGVLAPKPIVVKASSSPRSPRRRSRAXXXAVVLTG

SEQ ID NO: 24583 - DNA, 701 bp, Zea mays
  misc_feature: Ceres CLONE 1395783-F
  misc_feature: Encodes the peptide sequence at SEQ ID NO. 24584
  misc_feature (677)..(677): n is a, c, t, g, unknown, or other
aagctggagctccccgcggtggcggccgctctattactagtggatcccccgggctgcaggaattcgcacgagaccattacctagaacatcctaatcgaaaaacggtccaccgacgactcttcttcctcacctcctcccgctccagctccagctcgtctctctcctcgcctcgcgtagggtttcgcttcccgtctcgccgccgtcagcatgggggacaactacgatgacgaaggcgagccgatcgtgaacctcgacgaacgggaaccctcccctgagcatcagccgtacgaagacctcgatgacgacctcgacggcggcggcgattggacccgcgaccgctctccgacccccgtccacggcgacgacggcggggcagggtcctcctccaagccccgaaagcgccttctcaagaagggcggcggtggaggcatgcccggcgatgacgggctggatgactttgggttggaggacgaggacgcggacccttcggctgaggcgaggaagaggaagggctcgtcgtcgctgagggacctcgcgaggggcggggcgggcagggagaagaaggtaagaaaagcggtggaaagaacgaccggaagggggaggacactgggatggtgagggaatagcggggatcaggaggaagggactcaggcggtagggagccccaggatgatggncgagagggagatccaggagctctg

SEQ ID NO: 24584 - protein, 136 aa, Zea mays
  misc_feature: Ceres CLONE 1395783-F
MGDNYDDEGEPIVNLDEREPSPEHQPYEDLDDDLDGGGDWTRDRSPTPVHGDDGGAGSSSKPRKRLLKKGGGGGMPGDDGLDDFGLEDEDADPSAEARKRKGSSSLRDLARGGAGREKKVRKAVERTTGRGRTLGW

SEQ ID NO: 24585 - DNA, 745 bp, Zea mays
  misc_feature: Ceres CLONE 1395784-F
  misc_feature: Encodes the peptide sequence at SEQ ID NO. 24586
  misc_feature (342)..(342): n is a, c, t, g, unknown, or other
  misc_feature (482)..(482): n is a, c, t, g, unknown, or other
ggagctccccgcggtggcggccgctctagaactagtggatcccccgggctgcaggaattcgcacgagaccattacctagaacatcctaatcgaaaagacgggggcgtttctcgatctgacgctcgcctgggcctgcctctgcctcgccgcgctcgccgccgccgccgcgcgcctcctcgcgctcctcggcctcccgctcccctgcacctgtgcgcgcccgcacctgccctgcctcctcgccttcctggtgcgctaccctccccgcgccgtcggatcccttcacgccgccctccgcgcccgcttccccttcgccggccccaccgacgacgaggcacgcctcanaaaaagtgtgccaggaagagggccgaggaggagtcatcgcatgtgcgcgaggaggaaaggggattttccgtcgcctgcgtgtaagtcccatcgccgagctgcagaatgcacgctctagaaaagagcgcaccgcccgcggnggttcgggggcccggaggaggccatggtcccatgcaccctggcgccttgcagaaaggaaaaagccggcagcttgaaaattgagggggggaaagggaatggcccaaaccgcttgagggagggggtggcccctttctaaaagggaccaagggcaagggaagcctcgcgggaaatcgtggcccctgtggggaacggaaaaaggccccccgttttccacaaagggggtggaagccctaaccggcccttggtccctattaaagggcaa

SEQ ID NO: 24586 - protein, 37 aa, Zea mays
  misc_feature: Ceres CLONE 1395784-F
MVPCTLAPCRKEKAGSLKIEGGKGNGPNRLREGVAPF

SEQ ID NO: 24587 - DNA, 677 bp, Zea mays
  misc_feature: Ceres CLONE 1395787-F
  misc_feature (327)..(327): n is a, c, t, g, unknown, or other
  misc_feature (404)..(404): n is a, c, t, g, unknown, or other
  misc_feature (421)..(421): n is a, c, t, g, unknown, or other
  misc_feature (425)..(425): n is a, c, t, g, unknown, or other
  misc_feature (426)..(426): n is a, c, t, g, unknown, or other
  misc_feature (431)..(431): n is a, c, t, g, unknown, or other
  misc_feature (432)..(432): n is a, c, t, g, unknown, or other
  misc_feature (452)..(452): n is a, c, t, g, unknown, or other
  misc_feature (453)..(453): n is a, c, t, g, unknown, or other
cgctctagaactagtggatcccccgggctgcaggaattcgcacgagaccattacctagaacatcctaatcgaaaactgctagtgctcagtcctcgccctctcgctttccgagggagcctttgcctttcccctccgcccgccagccattaatggcggcggcatctccatccactcccccctcgcccccctcccactgctgctacttctagaagcgctggtggcagggcaggcgttatcccggccgctggcgctggcgcgagagttggttggtggtggtgttcagcccccctccctcttcaggtttagggtggagcgatccgtgcaggncaacgcggggtgcgtgacccagaaagggaacccgcgccttttttctcttctgccgccccgcttttcaatcccctccntcatctcatcgccccgnccgnnacatnnacaaaaaggtccccgccttnnctctccctctctcctctgcccctggttggcggtggctcgggctcccccacccctttctgatcagccaggttccttccggggggcggggcgtcccctgggcacttgctggggggccagataagtccaaagcccctccggggggccccctccccgtagggacgggtccaatttgcaaacaaaaacggggcgggaaaccctaaaggggggaaaaacccaggtcttcc

SEQ ID NO: 24588 - DNA, 704 bp, Zea mays
  misc_feature: Ceres CLONE 1395789-F
  misc_feature: Encodes the peptide sequence at SEQ ID NO. 24589
  misc_feature (577)..(577): n is a, c, t, g, unknown, or other
  misc_feature (701)..(701): n is a, c, t, g, unknown, or other
aaagctggagctccccgcggtggcggccgctctagaactagtggatcccccgggctgcaggaattcgcacgagaccattacctagaacatcctaatcgaaaaaaccgaagcaatccgacctgagaccaagacccgcaccacgcggctcgccgccgatggcgaacgccgacgccgacgaagcgccgctgctctctgtggaacacctccgtccaggatcctgcagccgcgagctcgagctgcgggagttccgcgaccgctacgtgatccgttcgctcgacggcgccgccgctttcgccgtccttcgctccggcggctccatccgccctctctccccagaggaagccgtagctgagagcgactgcaaggtttccagaatatacggggtggtaggcaccataagattgctcgctggaagctatgtactcgttatcacttctcagaaagatgctggctcttatctgggctcccctgtgtaccaagtgaactcaatgaaattcttatgctgcaacgaggctatcaagcactcgactccacaggaaagaagggatgaggcatacttcatgtctctcctgagaantgcagaaactacttgtggattgtattattcatacgacagggatttgacactagacttgcagagggcatcccagttggctgcagggagggtacatagaccactatggaagcaggctgatccacgnttg

SEQ ID NO: 24589 - protein, 183 aa, Zea mays
  misc_feature: Ceres CLONE 1395789-F
  misc_feature (141)..(141): Xaa is any aa, unknown, or other
MANADADEAPLLSVEHLRPGSCSRELELREFRDRYVIRSLDGAAAFAVLRSGGSIRPLSPEEAVAESDCKVSRIYGVVGTIRLLAGSYVLVITSQKDAGSYLGSPVYQVNSMKFLCCNEAIKHSTPQERRDEAYFMSLLRXAETTCGLYYSYDRDLTLDLQRASQLAAGRVHRPLWKQADPRL

SEQ ID NO: 24590 - DNA, 706 bp, Zea mays
  misc_feature: Ceres CLONE 1395790-F
  misc_feature (495)..(495): n is a, c, t, g, unknown, or other
  misc_feature (573)..(573): n is a, c, t, g, unknown, or other
  misc_feature (685)..(685): n is a, c, t, g, unknown, or other
aaagctggagctccccgcggtggcggccgctctagaactagtggatcccccgggctgcaggaattcgcacgagaccattacctagaacatcctaatcgaaaaaagaagagccgccctacctattccttctccccgacgacgagatgcccaacccagagaaccagaagccctcacctgcttcctctcggccggcccttccaacgagcccggaggaactaggagtcgccgccggtcgcgaactggatcaacgagcgaggagatctgcatttgctgcatgctctaatggagacgaaaggtggcaacaagtctagtaggagaaatagtaatttcgtggacgaagctccccttgactacgagaacgacgacgatcggccagccgaaggaatcgagaagtaccagactgctgcttattccgactgcgttcgccagccatcctgatagcgtctcacatgcaactcgcaggagagcaggagcttagatcagttgtccgcttgnggcgctacatctccgatggctctggctgccatcctcagcatctgagataccatgttgacttaagcatctcagctattncctcgcgcatcctgactgtcatggcaagcgacagccgcatggcgatgtcttcagaagataccagagggtcttctcctggactcccccattggtcgttgacggctaagagacntgccttcgagatcacgatctc

SEQ ID NO: 24591 - DNA, 874 bp, Zea mays
  misc_feature: Ceres CLONE 1395790-R
  misc_feature: SWISSPROT Homolog: EC 4.1.1.50 Adenosylmethionine decarboxylase
  misc_feature (87)..(87): n is a, c, t, g, unknown, or other
cgattgggtaccgggccccccctcgaggtcgacggtatcgatattttttttttttttttttactaaccaaaatttccaatatattgncgggaataggcaagtctgttacaagatcattctccccacaagggcatcggcagcagaaacaatatgactaaacaataatatcgcagctcactatggcagacgcagcaagccatccagagtacttattgaacaggaaaaatattaagcaaacaaattgccggtagcccagctaactgcttaactgaaaccaaaagaacagagagacagaggtctcagacttcttcgtaacttaggtgaagaaccacctaagttatccaaatctttaagcatccaaatctttcttcaccaccttcttcaccgcattccagcagccaatacacatctcgtcatttgaggccatctccattccatcgctgctccagccatccgtctgcaatgtcgacctcggcgatacagagccagaaggaacaccagtaaagctctgggacatcagcagaccgccaccaggaagctcttgctctacaggatcaccgcacatgtaggaatcaaagtctgcccccttcgcccatgatttggcgaaaccacggtccaccaaaaatgggaattggcgaccgagaaatcccgaaggagagaaacctgcccaggaccctccctgatcacatcccctgtagaaccattgagcctgggggtcgaaagttcataaactttcataaacttggcgaaaactgaaaacccctcccccccgggggtcacaatgggaaggggtgggaaggaaagctgggaccccacaaaaaacaccactgcactgcgggatttacccccacggggggggtggcgaaaactcaaa

SEQ ID NO: 24592 - DNA, 694 bp, Zea mays
  misc_feature: Ceres CLONE 1395796-F
  misc_feature: Encodes the peptide sequence at SEQ ID NO. 24593
  misc_feature (664)..(664): n is a, c, t, g, unknown, or other
aaagctggagctccccgcggtggcggccgctctagaactagtggatcccccgggctgcaggaattcgcacgagaccattacctagaacatcctaatcgaaaaaaaaaattcgattccacgaagcagcaatcgcaagttcgaagctctaaaataatctcttcccgacgtctctggaaggtcagcatctgaacccaggtagcctccagcgctggagacgtgccgtactcaaaccctagccaccaatggcagccggcggcggggctccgtgggcggagcgcgcgcgggtggtggggacgcagatccgcaacaggttccgcgtggcgcccgtggaccaccggtcgctgtggctgcgggcggacggtcgtgtcgccactgaggcggtccggcggtggtcggatcgcgttcgggccctgctgcagaggggccggagcgcggatcggaactccacatcgacggagacatcacctgaggcggtggcaaagccttcgtccagcgttttgagattctacagaaagagagtgggcaaagaagttaatgggattgaagactctgttattttccgttcgcttacagcattggctgttcctcttattgccatgcatgctatgtttttatgcatgggcttaactcagttcagggttatggtgtagagaagcttcatcangcattacatggggagactaaagggcaggct

SEQ ID NO: 24593 - protein, 135 aa, Zea mays
  misc_feature: Ceres CLONE 1395796-F
MAAGGGAPWAERARVVGTQIRNRFRVAPVDHRSLWLRADGRVATEAVRRWSDRVRALLQRGRSADRNSTSTETSPEAVAKPSSSVLRFYRKRVGKEVNGIEDSVIFRSLTALAVPLIAMHAMFLCMGLTQFRVMV

SEQ ID NO: 24594 - DNA, 732 bp, Zea mays
  misc_feature: Ceres CLONE 1395799-F
  misc_feature: Encodes the peptide sequence at SEQ ID NO. 24595
aaagctggagctccccgcggtggcggccgctctagaactagtggatcccccgggctgcaggaattcgcacgagaccattacctagaacatcctaatcgaaaagaatacaccacccctcgtctccccacggaggccgtcctctcctctcctctgcgtccgccactgcccaccgctcgcccgcgcgcgctccattacctcggcgggcgatggccgacctatccaacaccggctccacctaacacgagcagcgcccccgcctaggcggcagctggctggtcggtcgtcgagcagctagcggaggcagcgcccggagggaggccgtctcactctcctcgtcggcgcggcaggagatggaggccatcgtgggcgtccgcgcgccgccgcgtgaccgtgcctgtgccggactcgagaagccgccgcgcgtcgcttgccgggacagagtcccgacgtcgagtttcgcgttccggacgaacaggcccgcgaaggctggtgctgctgggcgcccattacgggaggccggggaatcctgccttcggtgggccgcgcaatctgcaagtggaaaaggaagggcccactaaccggctgaggacgttccataccaccgggtaaggaaaaattgccccccccccccccccccccaaagggacctgaaaaaatttttattttttttttaaggggagaaaagatcccaaacgggttttggtatttttaggggggccattaaataaaaaa

SEQ ID NO: 24595 - protein, 75 aa, Zea mays
  misc_feature: Ceres CLONE 1395799-F
MEAIVGVRAPPRDRACAGLEKPPRVACRDRVPTSSFAFRTNRPAKAGAAGRPLREAGESCLRWAAQSASGKGRAH

SEQ ID NO: 24596 - DNA, 712 bp, Zea mays
  misc_feature: Ceres CLONE 1395805-F
  misc_feature: Encodes the peptide sequence at SEQ ID NO. 24597
  misc_feature (712)..(712): n is a, c, t, g, unknown, or other
aaagctggagctccccgcggtggcggccgctctagaactagtggatcccccgggctgcaggaattcgcacgagaccattacctagaacatcctaatcgaaaaagcaaatcactacacacaccttgtctctaatcagatatcaaagaagtagccattaagttaacgatggcttccgccgacctcgcagaggccatcgagcccagcaggaagaagaagagcaacgtcaagtatgcctccatctgcgccatcctcgcctccatggcctccgtcatccttggctacgatattggggtgatgagcggagcggccatgtacatcaagaaggacctgaagatcacggacgtgcagctggagatcctgatagggatcctcagcctctactcgctcatcgggtccttcgcgggcgcgcggacgtccgacaggatcggccgccgcctgactgtcgtcttcgccgccgtcatcttcttcgcgggcgcgctgctcatgggtttcgccgtcaactactccatgctcatggtgggccgcttcgtggccggagttggcgtgggctacgggggcatgatcgcgcccgtgtacacggccgagatctcgccggcggcgtcccgcggcttcctcacgtccttcccggaagtgtcatcaacgtcggcatcctgctcggctacctgtcgaactttgcggttgcgcgcctaccgctccgcctcggctggcgcgn

SEQ ID NO: 24597 - protein, 182 aa, Zea mays
  misc_feature: Ceres CLONE 1395805-F
MASADLAEAIEPSRKKKSNVKYASICAILASMASVILGYDIGVMSGAAMYIKKDLKITDVQLEILIGILSLYSLIGSFAGARTSDRIGRRLTVVFAAVIFFAGALLMGFAVNYSMLMVGRFVAGVGVGYGGMIAPVYTAEISPAASRGFLTSFPEVSSTSASCSATCRTLRLRAYRSASAGA

SEQ ID NO: 24598 - DNA, 677 bp, Zea mays
  misc_feature: Ceres CLONE 1395812-F
  misc_feature: Encodes the peptide sequence at SEQ ID NO. 24599
  misc_feature (630)..(630): n is a, c, t, g, unknown, or other
tggagctccccgcggtggcggccgctctagaactagtggatcccccgggctgcaggaattcgcacgagaccattacctagaacatcctattgaaaaaaaccctaacaacgcatttcgctccccacagcggctcggccacaacccacagccagacggtctcgagctggatctctaccgttcgtccgttccagcagacagcagtgcgcgctctctctctccctcgtggcgacgactgggcgaccgctgccgctgcccttgtgccccggtctccgtcggtccgttcgccaggtctcctgcgggctctttgtcgtcgacaagctccgccaggttgctgtgtgaagtccaaggttgtcacatggattcagcacaagatttccaacccaggacattctctataaagttgtggccaccaactgaaagcacacggatcatgcttgttgacaggatgacaaacaatctgtccacagagtccattttctctcgcaaatatcgccttttgggaaaagcagaggctcatgaaaatgcaaaaacgattgaagaactttgctttgccttggctgatgagcatttcagagaggagccagatggtgatggggagtctgctgtccagctatttgcaaaggaacgagncagatggatgttgaagttctgaaaaaaggccccaggactactgcaag

SEQ ID NO: 24599 - protein, 98 aa, Zea mays
  misc_feature: Ceres CLONE 1395812-F
  misc_feature (92)..(92): Xaa is any aa, unknown, or other
MDSAQDFQPRTFSIKLWPPTESTRIMLVDRMTNNLSTESIFSRKYRLLGKAEAHENAKTIEELCFALADEHFREEPDGDGESAVQLFAKERXRWMLKF

SEQ ID NO: 24600 - DNA, 720 bp, Zea mays
  misc_feature: Ceres CLONE 1395813-F
  misc_feature: Translation starting site: 158
  misc_feature (710)..(710): n is a, c, t, g, unknown, or other
  misc_feature (720)..(720): n is a, c, t, g, unknown, or other
aaagctggagctccccgcggtggcggccgctctagaactagtggatcccccgggctgcaggaattcgcacgagaccattacctagaacatcctaatcgaaaaacgaattactgtacctttgatactcgttcaacggagttcgagacctcgtccggtaatgtccgccgcggcggcgcttttaccacggccaccaccgccaaatcctgccgccaccgtccattcactcttcgcctacctatccgacccggccgccctccaccacctacccgccccgctccttgccttctcccaactccgccacctgctgccgcccgccgccgccacccaactcctctttcgccccatcgcctcgctcctccaactccaccgctccgacctccgcataggcctccagcttcacgggctctccctgtccctcggcctctcctgctactcgcacttactgccccgcctcctctccttctactcacttaccccaaagtgctccgtgcctgtgccgagaccgggaacctcgctctcgggcgggcggtgcacgtgcgcgccgtggacgccggcatggacgggcacctgtttttccagaacgcactggtgtccatgtacgccaagtgttgggaccttgcggctgcgcgcacggtgttcgacggaatggacatagggatgtggtgtcgtggaactcgatgatctctggctacgctgcatctggacagtgnagaaaagcan

SEQ ID NO: 24601 - DNA, 705 bp, Zea mays
  misc_feature: Ceres CLONE 1395814-F
  misc_feature (571)..(571): n is a, c, t, g, unknown, or other
  misc_feature (585)..(585): n is a, c, t, g, unknown, or other
  misc_feature (633)..(633): n is a, c, t, g, unknown, or other
aaagctggagctccccgcggtggcggccgctctagaactagtggatcccccgggctgcaggaattcgcacgagaccattacctagaacatcctaatcgaaaacgggatcgctctctctttgggctaccggctccgccgccgctccgccgccctaagccaggtgctgaaggccttcgtcggtcttttcaccggcgacgacgacccactaggaaaagaattttcctggcatatttttgtttccagaaatattcgtgacaagttggtatgtcagggatcacagcaatttggcgtcggtcatgtccattagctgctagtcagattctaatggagacatattttggcccatctgtatcttctggtgttctgaggtggttcagcagcggcactaagcactcaagaaaacctgaattttctgttgctaaccatatcagggtggtggatttgcattctgcttctgcagttaattatgtgtcaacgatcagaaggttgcccctttcatgccgtatggacactaattggttgattacttcaaagtccagacatggcgcattgccaggattcttaggcgttncaagcttctatcgngaatactcttcagatactgggagtcagccagaagcttcgcagagggcngtctctaatcttccttctacagaaagctctgaggttggcactgcacgagctggtggcgggtcatggaatgaa

SEQ ID NO: 24602 - DNA, 561 bp, Zea mays
  misc_feature: Ceres CLONE 1395821-F
  misc_feature (241)..(241): n is a, c, t, g, unknown, or other
  misc_feature (246)..(246): n is a, c, t, g, unknown, or other
  misc_feature (250)..(250): n is a, c, t, g, unknown, or other
  misc_feature (251)..(251): n is a, c, t, g, unknown, or other
tgagctccccgcggtggcggccgctctagaactagtggggatcccccgggctgcaggaattcgcacgagactcattacctagaacatcctaatcgaaaaattacggctgaagggagtcgctcgccgccgcgttcgaggcgttctctcgtcgcgctcgcgccgtcgaccttcaccgctcgctgtcaggtctgcccgccacgacctcgccggccacactcgcagttcgtcctcgcatctacgnctcgncggnngagggcttctgccttttcgcgccctctatctgctgcgatctttggagcatacgttcccttcctcttacttgggaaaaccccaaccccctaaaacccctaaaagtttcgcccggtttttccggttagggttttggctccccgggggtgggggggggcccccctttggggggccacccgggaaaattttaaaaaaaaaggggggccaaatattttttgtgggggaggggggggttccccccccccccaagagattttgggcccccccgggaggggagggggaaaattgtgtttttcaccccccctccgcgaa

SEQ ID NO: 24603 - DNA, 718 bp, Zea mays
  misc_feature: Ceres CLONE 1395824-F
  misc_feature: Encodes the peptide sequence at SEQ ID NO. 24604
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (651)..(651): n is a, c, t, g, unknown, or other
  misc_feature (653)..(653): n is a, c, t, g, unknown, or other
  misc_feature (654)..(654): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (676)..(676): n is a, c, t, g, unknown, or other
  misc_feature (678)..(678): n is a, c, t, g, unknown, or other
  misc_feature (680)..(680): n is a, c, t, g, unknown, or other
  misc_feature (682)..(682): n is a, c, t, g, unknown, or other
  misc_feature (683)..(683): n is a, c, t, g, unknown, or other
  misc_feature (686)..(686): n is a, c, t, g, unknown, or other
  misc_feature (704)..(704): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (716)..(716): n is a, c, t, g, unknown, or other
caaagctggagctccccgcggtggcggccgctctagaactagtggatcccccgggctgcaggaattcgcacgagaccattacctagaacatcctaatcgaaaaccatccatccatccagttagttagttagtaagttagttgagggagaagaagcaggggaggggaagcgatgagcaacatgctgcgggctcgccgccgcctggacctcctgcaggtggtgctcttcgccgctgtgctcctcgtcgtcgtcgccgacgccggcgtgacgagccagtaccggcggaagctggaggcgacggtggagatgccactggacgccgacgtcttccgcgtcccgccggggtacaatgccccgcagcaggtgcacatcacgctgggtgaccaggagggcacggcgatgatcgtgtcgtgggtgacggccaatgagctgggcagcagcaccgtcatgtacagcgaggcgtcgccggacccggagaagatggagctccgggcggagggcacccacacgcgctacgactacttcaactacacctccggcttcatccaccactgcaccctcacaaacctcaagcatagcacccagtactacctacggcccttgggggggggttcccgcgggcccccccaccggcgnnncgcggcggaaaaanannannnnnnnnnnnnccccnnncncncnannacnccccacccccacggaccnggcannnccggnag

SEQ ID NO: 24604 - protein, 182 aa, Zea mays
  misc_feature: Ceres CLONE 1395824-F
  misc_feature: SWISSPROT Homolog: EC 3.1.3.2 Acid phosphatase
  misc_feature (156)..(156): Xaa is any aa, unknown, or other
  misc_feature (161)..(161): Xaa is any aa, unknown, or other
  misc_feature (162)..(162): Xaa is any aa, unknown, or other
  misc_feature (163)..(163): Xaa is any aa, unknown, or other
  misc_feature (164)..(164): Xaa is any aa, unknown, or other
  misc_feature (165)..(165): Xaa is any aa, unknown, or other
  misc_feature (166)..(166): Xaa is any aa, unknown, or other
  misc_feature (168)..(168): Xaa is any aa, unknown, or other
  misc_feature (169)..(169): Xaa is any aa, unknown, or other
  misc_feature (170)..(170): Xaa is any aa, unknown, or other
  misc_feature (171)..(171): Xaa is any aa, unknown, or other
  misc_feature (180)..(180): Xaa is any aa, unknown, or other
  misc_feature (181)..(181): Xaa is any aa, unknown, or other
MSNMLRARRRLDLLQVVLFAAVLLVVVADAGVTSQYRRKLEATVEMPLDADVFRVPPGYNAPQQVHITLGDQEGTAMIVSWVTANELGSSTVMYSEASPDPEKMELRAEGTHTRYDYFNYTSGFIHHCTLTNLKHSTQYYLRPLGGGSRGPPHRRXAAEKXXXXXXPXXXXTPHPHGPGXXG

SEQ ID NO: 24605 - DNA, 765 bp, Zea mays
  misc_feature: Ceres CLONE 1395825-F
  misc_feature: Encodes the peptide sequence at SEQ ID NO. 24606
  misc_feature (368)..(368): n is a, c, t, g, unknown, or other
  misc_feature (369)..(369): n is a, c, t, g, unknown, or other
aagctggagctccccgcggtggcggccgctctagaactagtggatcccccgggctgcaggaattcgcacgagaccattacctagaacatcctaatcgaaaaactcccaccgtatcctcccctgcgtagggtttaaccactcgcagcagccgccgtgactcgagaatcatgtcagcgccgccgtcgctcaagaccccggcaaccgccgtagcggtctctcggcgctcggtcgccaccccgagagccaccgggcttcgcggcgcctgtgctcccccgactcggcgcctccggtgctcagcctccgccgccgtggccggggcttccaccgagatgggtgatgctccgctggactgggcagagagtcgctgnnagagttacgcagcttgccgaaccacgacacgtttctgcttggatgccgctctcgccgctggacgggcggtacgatcgcttcgtcaaggagctgatgcccttttttcaggagtccggctaatcaaaataccgcgttctcatcgagaacaagtggctactgaaactttctcaaattccctgagatcactgaggtgcctcaagtcaaaaaggaagcgcagcctttgttgattgccattattggaaattttggcataaatggtgccaaaaaaagtaaaaaaaatcgagaaaggaacccaccttgacgtgagaagccggggaagtacttttctgaagcaaaggtgccactccatatccaaaaatttgaaaagggggccgaaatcctcccaattgtgggggg

SEQ ID NO: 24606 - protein, 50 aa, Zea mays
  misc_feature: Ceres CLONE 1395825-F
  misc_feature (11)..(11): Xaa is any aa, unknown, or other
MLRWTGQRVAXRVTQLAEPRHVSAWMPLSPLDGRYDRFVKELMPFFQESG

SEQ ID NO: 24607 - DNA, 721 bp, Zea mays
  misc_feature: Ceres CLONE 1395828-F
  misc_feature: Encodes the peptide sequence at SEQ ID NO. 24608
aagctggagctccccgcggtggcggccgctctagaactagtggatcccccgggctgcaggaattcgcacgagaccattacctagaacatcctaatcgaaaaatctccccttccttcctttcctactcccacactcccccaccctccactagtactagtactagtaccacaaccaccccaccgggaaaaaacccaacaaggggtagggccgccgccgccgccagcgccgccgtgcagatcgcggacggatctacggcgctggggcacgggggtccccggatcgacgacgcctccgccgagggttcggatgactatgcgaaaagaaaaccctgtgcttaatgcttgtcaagcatccaatggccggatcacgcgagctcaagctgctgcaaatcgacgaagctttggagctttcccttctgttccattgcctgcaaaaaccgaacgaaacagactgcactagggaaggtcaaacgagtttcttcatatgatcacaccagtgcaagcgttgcactttcaggcccccagcctacaaggcgcacagtactcagggatgtgaccaatttgagcaatgctaactctaacaaaagttttgctgctgcaccgaagcttcaaacaaagccctctctaaggactgggagaacggtgagccaaagcaaggcctgcgcgaaaaagattcctaaaaacccactacagctggtatggaagtgcattgactactgttt

SEQ ID NO: 24608 - protein, 50 aa, Zea mays
  misc_feature: Ceres CLONE 1395828-F
MTMRKENPVLNACQASNGRITRAQAAANRRSFGAFPSVPLPAKTERNRLH

SEQ ID NO: 24609 - DNA, 663 bp, Zea mays
  misc_feature: Ceres CLONE 1395830-F
  misc_feature: Encodes the peptide sequence at SEQ ID NO. 24610
tggagctccccgcggtggcggccgctcttcactagtggatcccccgggctgcaggaattcgcacgagaccattacctagaacatcctaatcgaaaagcaagaggtaacactcgcgtctcattctcccgttcttgaggggcaatcgcgaatcgcgctcctcgcggtagcggtcgattacccggctccgcccagatccgccgcggctgcgctccagttccctgtcgcgtgcgtagggctcctcgtccctccctctatccccggctgtgtacggactggggatcggggatccctccggaccgggataggattttcgttttgctggcgaggaagggagcttcccccgatagatgtctcacctccgataccctggatttcgtccgtggcgagtggctaccgcttctgctccttttgtgacagctgaatctttgtggttcgaaggcgattgacttgggttcactgacgcggtgacgcccaatgagctcccacgtctccacatcgcggggtcttcatcccccaggcaagcttgggacgttggactcacccggtgcgtggcagccgccagcacctatggctcagcccgaagcaggccgcggtgatgaccaggaggtcaggctgttgtcggttgcttggaatcaggactgtggatgcttcgctgccggtaca

SEQ ID NO: 24610 - protein, 32 aa, Zea mays
  misc_feature: Ceres CLONE 1395830-F
MAQPEAGRGDDQEVRLLSVAWNQDCGCFAAGT

SEQ ID NO: 24611 - DNA, 689 bp, Zea mays
  misc_feature: Ceres CLONE 1395833-F
  misc_feature: Encodes the peptide sequence at SEQ ID NO. 24612
  misc_feature (633)..(633): n is a, c, t, g, unknown, or other
  misc_feature (634)..(634): n is a, c, t, g, unknown, or other
caaagctggagctccccgcggtggcggccgctctagaactagtggatcccccgggctgcaggaattcgcacgagaccattacctaaaacatcctaatcgaaaaatccaattcacaggctcaccacaccaaccaacaagcaaaaattccccaatcctctcgtctccgcggcgaagatgtcggggcgcggcaagggcggcaagggcctgggcaagggcggcgcgaagcgtcaccggaaggtgctgcgcgacaacatccaggggatcacgaagccggcgatccggaggctggcgcggcggggcggcgtgaagcgcatctcggggctcatctacgaggagacccgcggcgtgctcaagatcttcctggagaacgtcatccgcgacgccgccccaccacgcccgatggccgccgtaaggtcgctgctccgctcgtcggcctcccttcttcgcgccgcccccgccctcgcgagatcctcggctaccacgcgtccgtctcttcggcgcgcattggctgctcctcctcgcctcctcaggtcgcccgtcgagtcgagcttctgcgtggagtcgcttctgcctctgcacaccgccaccgccggtgcacgcatgacgtccatgctcgccgctcctggccaaggnnctcgctggctcaccaagctgaaactgacggagatacgcccctgtgggtaaaaaaa

SEQ ID NO: 24612 - protein, 169 aa, Zea mays
  misc_feature: Ceres CLONE 1395833-F
  misc_feature (154)..(154): Xaa is any aa, unknown, or other
MSGRGKGGKGLGKGGAKRHRKVLRDNIQGITKPAIRRLARRGGVKRISGLIYEETRGVLKIFLENVIRDAAPPRPMAAVRSLLRSSASLLRAAPALARSSATTRPSLRRALAAPPRLLRSPVESSFCVESLLPLHTATAGARMTSMLAAPGQGXRWLTKLKLTEIRPCG

SEQ ID NO: 24613 - DNA, 752 bp, Zea mays
  misc_feature: Ceres CLONE 1395838-F
  misc_feature: Encodes the peptide sequence at SEQ ID NO. 24614
  misc_feature (485)..(485): n is a, c, t, g, unknown, or other
  misc_feature (588)..(588): n is a, c, t, g, unknown, or other
  misc_feature (709)..(709): n is a, c, t, g, unknown, or other
aagctggagctccccgcggtggcggccgctctagaactagtggatcccccgggctgcaggaattcgcacgagaccattacctagaacatcctaatcaaaaacaccgcggcccacgctgcgtaggactccccgactccgacggcgtccgcccgcgtcgcgtggcacgcccacgccacgccggccgccgcgaggaaagacaccgggtacttccccttcccttacgctccagtttcacaagtcgcgagccgtgcgtcgcgtcgacgcgagttccgcgtgagggagcaggcagttgcagttggagggcgtgacgaaaccctaggacttgagttccagcgcacggctcgggtcctcctcaccgttcccggcgatggaacggcggcaggagctttgcaggaacttccagcgcggcagctgcaagtacggatcgcactgcaggtttgtgcacgcctcctctcagcagcagcagcaggcgaagcccaacccgntttgggttcggcttagggagtaggcagcagcaacagcagcagtcttcgttttcgtgggcagtccagcagcagcagcagcagaagcccaacccgtttggatttngagtgaagggagtgcggctgcacagtccaaaaacgctcctgggcaggcaaagccatttcaaataaatgggtaagggacccctcagcccccacgaggcacagggaaggggacagccaccagnaggagcccacacctcctgtacagatcctgagtcctgaggcaaa

SEQ ID NO: 24614 - protein, 46 aa, Zea mays
  misc_feature: Ceres CLONE 1395838-F
  misc_feature (3)..(28): Pfam Name: zf-CCCH Pfam Description: Zinc finger C-x8-C-x5-C-x3-H type (and similar)
  misc_feature (40)..(40): Xaa is any aa, unknown, or other
MERRQELCRNFQRGSCKYGSHCRFVHASSQQQQQAKPNPXWVRLRE

SEQ ID NO: 24615 - DNA, 723 bp, Zea mays
  misc_feature: Ceres CLONE 1395840-F
  misc_feature: Encodes the peptide sequence at SEQ ID NO. 24616
caaagctggagctccccgcggtggcggccgctctagaactagtggatcccccgggctgcaggaattcgcacgagaccattacctagaacatcctaatcgaaaacccactagtaccgccacacgaattcccgaccccgatggcgacatcgccaccgcagaaccctagctccggcgagccctccgatgcgtcgagcctcgcagccgcggcgctcgaggcgcccgtgcgcgtatggagatccctcgtcgcgcgcttccctcccctcccggactcctccagcttccttgctggcgtctccgacctccagctccgctacttcggcaacagccggccccgccgccgcaggggctccgctctacctctccctctccgcccggtggccgcgcactctgctcggattgctggtgagatgcccaaagcctttgtgatcttagatgatgttgtgcaacacaccctgactaatttgcacagtattcacaaaagcttactattttggcaggccaagggctgaggaacaaattctcagaaagtgtactttatgatatttgagagaggtcaagggccttttgtgatgcacatatcaaacactcactagactcgggagcaatggacgccctgtccatacattttgcattctgcatctgatatggtgtcacaaaactcgctgccctgacagtatgcacactgcttggccgcttttctgcaaagttccatctgaagtgata

SEQ ID NO: 24616 - protein, 123 aa, Zea mays
  misc_feature: Ceres CLONE 1395840-F
MATSPPQNPSSGEPSDASSLAAAALEAPVRVWRSLVARFPPLPDSSSFLAGVSDLQLRYFGNSRPRRRRGSALPLPLRPVAAHSARIAGEMPKAFVILDDVVQHTLTNLHSIHKSLLFWQAKG

SEQ ID NO: 24617 - DNA, 682 bp, Zea mays
  misc_feature: Ceres CLONE 1395841-F
  misc_feature: Encodes the peptide sequence at SEQ ID NO. 24618
  misc_feature (332)..(332): n is a, c, t, g, unknown, or other
  misc_feature (503)..(503): n is a, c, t, g, unknown, or other
  misc_feature (569)..(569): n is a, c, t, g, unknown, or other
  misc_feature (585)..(585): n is a, c, t, g, unknown, or other
  misc_feature (619)..(619): n is a, c, t, g, unknown, or other
ggagctccccgcggtggcggccgctctagaactagtggatcccccgggctgcaggaattcgcacgagaccattacctagaacatcctaatcgaaaaaaggcttcgttctgctctccggctctcccgcatccaccccgtctcatccccaatccgaccacctcatccctcgcctccatggccctacccctcgcgtcaccggcgggggcatgagccggtgactgctcacgcggcctcgtctgtctgcgcacgcgcgcggggtcggcgagtgagcattgcggcggtccgcgatcgcccgtgggggagcatggcgtcggcggcggggtcggccggcngggccggcgcggggtctggcgggctgaagacctacttcaagaccccgaggggcggcacaagctgcagtatgagaagacgcactcccccgccgtcgtgcactacagccacagcggcaagaccgtctcccagatgacagtggcatatttgaaggagaaagcagcaggccaggnttccacggcttcaacaccaagtgctggtagtggggatgcggtctgcagctgcaagactttctcgcnactggaatgggagccnggcacttagcttcgggagcaatgttacagcaggnctgcctcaggaaacaacccgatgggtggaggaattggggtgtcaataagggaaagggatccca

SEQ ID NO: 24618 - protein, 43 aa, Zea mays
  misc_feature: Ceres CLONE 1395841-F
  misc_feature (14)..(14): Xaa is any aa, unknown, or other
  misc_feature (36)..(36): Xaa is any aa, unknown, or other
MTVAYLKEKAAGQXSTASTPSAGSGDAVCSCKTFSXLEWEPGT

SEQ ID NO: 24619 - DNA, 728 bp, Zea mays
  misc_feature: Ceres CLONE 1395842-F
  misc_feature: Encodes the peptide sequence at SEQ ID NO. 24620
  misc_feature (457)..(457): n is a, c, t, g, unknown, or other
  misc_feature (458)..(458): n is a, c, t, g, unknown, or other
  misc_feature (525)..(525): n is a, c, t, g, unknown, or other
  misc_feature (532)..(532): n is a, c, t, g, unknown, or other
  misc_feature (588)..(588): n is a, c, t, g, unknown, or other
  misc_feature (639)..(639): n is a, c, t, g, unknown, or other
  misc_feature (672)..(672): n is a, c, t, g, unknown, or other
  misc_feature (683)..(683): n is a, c, t, g, unknown, or other
aaagctggagctccccgcggtggcggccgctctagaactagtggatcccccgggctgcaggaattcgcacgagaccattacctagaacatcctaatcgaaaaacttgcgcatcggatcgcatcagctgctgcttttgtccaccaagcaacgattccctttccttccgccgcccaaatgccagtggccaccttcctcctcgtcgcgcttctctcgtgcggcgcacgagccatccggacgcacggcggctatgtctccgcggtcggggaccccggcatgcggcgcgacggcctccgcgtggcatgggaggcgtggaacttctgcaacgaggtcggccaggaggcccccggcatgggcagcccccgcggtgccgattgcttcgatcttctcggtccgtccattccatctctttctctcctctttcgccggggtggttgagtgggttgccaccaaagatanngtttttgagaagcgtggatctctgttcccgtccgcagagacgagctcccgacgagagggggcggcgntgtactncgtggcgcacctggtgagcgacgccgacaccgcctgggcgcgggcgacccgtcccngggtcccggccgggcgcgcccgcgtcacggacgccgactctacgcgccggncaggagctgtacctcggcgacccgctgcagtgncgacaccccgncgccgtggaagtctggatgtcatgctcagaacgcaacttcaacca

SEQ ID NO: 24620 - protein, 86 aa, Zea mays
  misc_feature: Ceres CLONE 1395842-F
MPVATFLLVALLSCGARAIRTHGGYVSAVGDPGMRRDGLRVAWEAWNFCNEVGQEAPGMGSPRGADCFDLLGPSIPSLSLLFRRGG

SEQ ID NO: 24621 - DNA, 667 bp, Zea mays
  misc_feature: Ceres CLONE 1395844-F
  misc_feature: Translation starting site: 326
  misc_feature: Pfam Name: Lyase_1 Pfam Description: Lyase
  misc_feature: SWISSPROT Homolog: EC 4.3.2.2 Adenylosuccinate lyase
tggagctccccgcggtggcggccgctctagaactagtggatcccccgggctgcaggaattcgcacgagaccattacctagaacatcctaatcgaaaaactcccaccgtatcctcccctgcgtagggtttaaccactcgcagcagccgccgtgactcgagaatcatgtcagcgccgccgtcgctcaagaccccggcaaccgccgtagcggtctctcggcgctcggtcgccaccccgagagccaccgggattcgcggtgcctgtgctcccccgactcggtgcctccggtgctcagcctccgccgccgtggccggggcttccaccgagatggctgatgctccgctggactgggcagagaggtcgctggaggagttacgcagcttgccggaccacgacacgttctgcttgatggcgctctcgccgctggacgggcggtacgatcgcttcgtcaaggagctgatgccctttttcagcgagttcgagctaatcagataccgcgttctcatcgagatcaagtggctactgaaactctctcaaattcctgagatcactgacgtgcctcagtccagcaggaagcgcagtccttgttgcatgccattattgagaattctggcatagatgatgcaaaagtagttaagaatatcgagaaagtaaccgatcatgacgtga

SEQ ID NO: 24622 - DNA, 775 bp, Zea mays
  misc_feature: Ceres CLONE 1395847-F
  misc_feature: Encodes the peptide sequence at SEQ ID NO. 24623
  misc_feature (354)..(354): n is a, c, t, g, unknown, or other
  misc_feature (775)..(775): n is a, c, t, g, unknown, or other
aagctggagctccccgcggtggcggccgctctataactagtggatcccccgggctgcaggaattcgcacgagaccattacctagaacatcctaatcgaaaaagtcctctctgtcgcggagccgccgcaacccagcgtcccccgaagtctaaccctagatccggaccggccatggcgtcccgccgggtcgtctcctcgctcctccgctccgcgtcccgcctgcgggccgcctcgcccgctgcgccacgcccgcgcgcgccaccgcaccgcccgtccccggtcgggtacctcttcaaccgcgctgccgcctacgcctcttccgccgtggcccaggtcggacctggcaccccgccgncggccaccggtaagaccgggggccgaaagatcaccgacgaggtcaccggcgctgtcgccatcgcgcaggtgtggcaggtgatctggcgcgtcgtggacgtggcctacgatgagggcttccggacatcctccacggggtcgagcggtcgaacacacatccggcctggggtcaagggggggaacaccctgggggaaacatgggggggccccatcgttttaggaaggagggggggggtttccccggggaaaaggggggtctaaaaacggggctcccccaataacggtgcctgggggggggggtgaccactgtgaaagcacaaaaaaaggtttttggcccacccctttgggagagagggggggtaaaaaaaaaaaaacaacttctcccctttattttggggaaccccccgtgcttgtggggagan

SEQ ID NO: 24623 - protein, 147 aa, Zea mays
  misc_feature: Ceres CLONE 1395847-F
  misc_feature: SWISSPROT Homolog: EC 3.6.3.14 H(+)-transporting two-sector ATPase
  misc_feature (62)..(62): Xaa is any aa, unknown, or other
MASRRVVSSLLRSASRLRAASPAAPRPRAPPHRPSPVGYLFNRAAAYASSAVAQVGPGTPPXATGKTGGRKITDEVTGAVAIAQVWQVIWRVVDVAYDEGFRTSSTGSSGRTHIRPGVKGGNTLGETWGGPIVLGRRGGVSPGKRGV

SEQ ID NO: 24624 - DNA, 670 bp, Zea mays
  misc_feature: Ceres CLONE 1395852-F
  misc_feature: Translation starting site: 221
  misc_feature: SWISSPROT Homolog: EC 1.4.1.2 Glutamate dehydrogenase
aaagctggagctccccgcggtggcggccgctctagaactagtggatcccccgggctgcaggaattcgcacgagaccattacctagaacatcctaatcgaaaaaaccatcattgcaaaagcgaagcaaagcaatcggaattctctgcgatttctctagatctcgactaccccccactagttttggttcctcctttcgttcgagagagcgattctggtggcaatggcgaagagcgagggtccggcgatcgggatcgacctcggcaccacctactcgtgcgtcggcgtgtggcagcacgaccgggtggagattatcgccaacgaccaggggaaccgcaccacgccgtcctatgtcggcttcaccgacaccgagcggctcatcggcgacgctgccaagaaccaggtcgccatgaaccccaccaacaccgtcttcgatgccaagcggttgatcggcaggaggttctctgatccgtcagtgcagagtgacatgaagctatggccgttcaaggtcatcccagggcctggtgacaagcccatgattgtagtgaactacaagggcgaggagaagcagtttgctgctgaggagatctcctccatggtcctcatcaagatgaaggagattgctgaagcctaccttgggttccaccatcagaacgcagtggtgacagtgccg

SEQ ID NO: 24625 - DNA, 687 bp, Zea mays
  misc_feature: Ceres CLONE 1395858-F
  misc_feature (414)..(414): n is a, c, t, g, unknown, or other
  misc_feature (428)..(428): n is a, c, t, g, unknown, or other
  misc_feature (459)..(459): n is a, c, t, g, unknown, or other
  misc_feature (620)..(620): n is a, c, t, g, unknown, or other
aaagctggagctccccgcggtggcggccgctctagaactagtggatcccccgggctgcaggaattcgcacgagaccattacctagaacatcctaatcgaaaaaaaatgttcctcgcaaagtttggctgacggcacccaccgcccacagaagcgcacctctgttctttggtgtgtggccgtgtggattcaaaaccgctgaccggccgcttatttaagcccttgccccgccggttttctcttctcccgtcggcgctggtccacgcggctccaacacctgcctgcctgcctgattcttacaccaaccaaccacgcgcgccaagccgaattcgtcttccaccgatccgccccgcccgtttcccattgcttagcttgctatggcgcagcagcagccggtgcggcggattctgaagtggncaccgccggggaangggggacggggaaatctttcccacggtgcangcggcggtcgacgcggtgccgctgggcaaaccgggcgcgcgtcgtcatccgcctcgcgcccggggtctacagggagcctgtctacgtcgccaagacaagaacttcatcaccgtcgcggggggctcgccccgagccaccgtcctgtcatgggaacacaccgncacgcgcatcaggcactcgcagtcatccaggggtataggaactggaacattccggtgtggtacgttt

SEQ ID NO: 24626 - DNA, 683 bp, Zea mays
  misc_feature: Ceres CLONE 1395862-F
  misc_feature: Encodes the peptide sequence at SEQ ID NO. 24627
  misc_feature (351)..(351): n is a, c, t, g, unknown, or other
  misc_feature (376)..(376): n is a, c, t, g, unknown, or other
  misc_feature (683)..(683): n is a, c, t, g, unknown, or other
caaagctggagctccccgcggtggcggccgctctagaactagtggatcccccgggctgcaggaattcgcacgagaccattacctagaacatcctaatcaaaaaatctcctcgcgagcaccgctggcctcgcttaacgggctgatctcccaggcgccgcttccggctcacgtcccaccggcctccatctacatgcagccgcgctcgccaccgccgtcggaggcgcctgggccctccgacgccatcatgatgcccggcgcgggcggcgtggagccgggcgtcacgttggctcaggtgccgcgctggagtgaccccgaccagcgcatcttcctcgcctccacgtccgaagaggngtccgcgcaggacgacggatccggnacgacctctgcgtgtggattcgtgtctttctccgacccgctcacggccgacgactgccccgtcgggggtggccacgctcggggtgcctcgcgcttccccgtcgaccaagagatcaaatctaggatctatctctgccgaaggcagccatggaacgtcgaggccgacgaggcctgaagttctaccaacgaaagctcggacaaggcgcccagaagcccgggattgcaagatgctgccgggtcagggctcgccaacggaatgccccccccttggaaaggttgcccaaactgcgcatggacaacaatgaccn

SEQ ID NO: 24627 - protein, 119 aa, Zea mays
  misc_feature: Ceres CLONE 1395862-F
  misc_feature (54)..(54): Xaa is any aa, unknown, or other
MQPRSPPPSEAPGPSDAIMMPGAGGVEPGVTLAQVPRWSDPDQRIFLASTSEEXSAQDDGSGTTSACGFVSFSDPLTADDCPVGGGHARGASRFPVDQEIKSRIYLCRRQPWNVEADEA

SEQ ID NO: 24628 - DNA, 734 bp, Zea mays
  misc_feature: Ceres CLONE 1395864-F
  misc_feature: Translation starting site: 181
  misc_feature (620)..(620): n is a, c, t, g, unknown, or other
  misc_feature (666)..(666): n is a, c, t, g, unknown, or other
  misc_feature (667)..(667): n is a, c, t, g, unknown, or other
aaagctggagctccccgcggtggcggccgctctagaactagtggatcccccgggctgcaggaattcgcacgagaccattacctagaacatcctaatcgaaaaacggatcaaaatcgaatccaacgctactgcctagggtttcctctgcatttcccctaccacaccccgcgccgcccacccatggccgccgcagacgcgtccgccgagaccgccgccatcgcgcggcgcctggcctcctgcaacaccggcacccgggagcgcgcgctccgctacctcctctccgaatttctgccggcctccgcgccgcgcctctccgccaccgacctcctcaagctctggaagggcatcttcttctgcttctggcacgccgacaagccgctctaccagagctccgtcgcctcgcctccgccgtctccgtcccgccgtcccccgccgatggtgccgccttcctcgccgcctacctcaccacgctccgccgcgagtgggcccacatcgacgtccaccgcctcgacaagttctacctcctcaaccgccggttcctccaccacgccttcctgcttctccatgctaactccttcgcccccgacgtcacctcccaggtcgtgtccgtcctgtcagancaggccctgctcccggaagccgacacgtcgccgctgccacctcccnngggctcgggtaccacgtcgccgaggcgtccttgacgagctccctgctgtgctccccgtgagcctgaa

SEQ ID NO: 24629 - DNA, 740 bp, Zea mays
  misc_feature: Ceres CLONE 1395869-F
aaagctggagctccccgcggtggcggccgctctagaactagtggatcccccgggctgcaggaattcgcacgagaccattacctagaacatcctaatcaaaaagaggcaaagccgttagccaatctgctgttgcgtgttgcaccgatcaacgtcggttcccagcgcttgctcgtcaagcgtgtcctgctgctgttctctgctcctgcttgccgcgagagctcctctcgctcatctacccaaggtccgacagcaacgacttcgtcgagctgctatgggagaacggccaggcggtggtgcacgggaggaggaagcagcatccccaggccgccttcccgcccttcacctgcggcgcggccagcagcagtagagctcaagaaaaccagccgggtactaccgacccggtctcgctgttcaagacgggaggcctcttcgccgacttctcgtccggcctagacgccgcccgtggcaacggtgaccttgacgacaccgtgccctggatccactgccccatcgtcgaggaagacagcgccgcacccgcacctggcctcgcggagggctacagcccagatttcttctcggagctccatgcagcggcgttagcagcggcggcggcagagacgaactcagccctctgcccacccacggtcagcacacagaggcaccccgggtgccaccacagcagaggaccagaccctcgaaggagccccgcgcatacagtaccagtccaggcagcaggccga

SEQ ID NO: 24630 - DNA, 739 bp, Zea mays
  misc_feature: Ceres CLONE 1395871-F
  misc_feature: Translation starting site: 604
  misc_feature (258)..(258): n is a, c, t, g, unknown, or other
  misc_feature (303)..(303): n is a, c, t, g, unknown, or other
  misc_feature (452)..(452): n is a, c, t, g, unknown, or other
  misc_feature (594)..(594): n is a, c, t, g, unknown, or other
  misc_feature (608)..(608): n is a, c, t, g, unknown, or other
  misc_feature (626)..(626): n is a, c, t, g, unknown, or other
  misc_feature (628)..(628): n is a, c, t, g, unknown, or other
  misc_feature (638)..(638): n is a, c, t, g, unknown, or other
  misc_feature (642)..(642): n is a, c, t, g, unknown, or other
  misc_feature (643)..(643): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (659)..(659): n is a, c, t, g, unknown, or other
  misc_feature (663)..(663): n is a, c, t, g, unknown, or other
  misc_feature (664)..(664): n is a, c, t, g, unknown, or other
  misc_feature (666)..(666): n is a, c, t, g, unknown, or other
  misc_feature (677)..(677): n is a, c, t, g, unknown, or other
  misc_feature (678)..(678): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (703)..(703): n is a, c, t, g, unknown, or other
  misc_feature (706)..(706): n is a, c, t, g, unknown, or other
  misc_feature (707)..(707): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (715)..(715): n is a, c, t, g, unknown, or other
  misc_feature (716)..(716): n is a, c, t, g, unknown, or other
  misc_feature (719)..(719): n is a, c, t, g, unknown, or other
  misc_feature (720)..(720): n is a, c, t, g, unknown, or other
  misc_feature (722)..(722): n is a, c, t, g, unknown, or other
  misc_feature (727)..(727): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
aaagctggagctccccgcggtggcggccgctctagaactagtggatcccccgggctgcaggaattcgcacgagaccattacctagaacatcctaatcgaaaaagagctccgatgggcgccgactctcccgcactcccgcctccacctcccgctccacacgcccagtcccacctcccgtcgccgcccctgcccccgttcccgacgtcgccttccctggcttcgtcggcgcttcgcgcctccagacactcaccgcccggnacccacccggtcctcccgcccccggctccgcccccctccgccgcngctcctcgccgccgagggcgcctccctcgcgccgcgccgagagcaccgcttcccaggctcggtctcctccccaacaagcaccgcctctgcctctaacgaggcggagtacgccgtcctgcttcgcgccctccaggtgcgccgcgccgtcnccggcgagctactcattgccgcgcccccccgcgcgaactccagttcgccgagctcgccccctaggctctcgagcgacacggcgacggctccgaactcgagctctccctgagcccccacggtcgcgccgcaatccactggggncctccgccgatgcncttaaaacccctcccccnantccaaacgcnccgnnannnnnnnttnnnncncccnncnaaggggcctgnncgaannnnnagnnnnaaannnnaanccnngtgnnnannggnngntaaanaaannnnnnnna

SEQ ID NO: 24631 - DNA, 732 bp, Zea mays
  misc_feature: Ceres CLONE 1395878-F
  misc_feature: Encodes the peptide sequence at SEQ ID NO. 24632
  misc_feature (387)..(387): n is a, c, t, g, unknown, or other
  misc_feature (454)..(454): n is a, c, t, g, unknown, or other
  misc_feature (624)..(624): n is a, c, t, g, unknown, or other
  misc_feature (625)..(625): n is a, c, t, g, unknown, or other
  misc_feature (696)..(696): n is a, c, t, g, unknown, or other
caaagctggagctccccgcggtggcggccgctctagaactagtggatcccccgggctgcaggaattcgcacgagaccattacctaaaaacttccttagctaacttcccagccccgacaccttggccgccgctccgtgcgcacccagttgctgaggttgcaacgctgcagccggcgaggatcggatgaaccaccaacccctcctataaatcctaaccgagtcctctgcttctgctctcatccatctgtagagtgcaacatgcagtgccccatggacactgctgctagtggaacctcgccagtgatgcaattccatagcaatgctgatgagtctatcgcccattcatctccattggcaacattaatacaacgttcacagcgccttgccntatggggatggatccccaggcgaattttcccccttgctgtgagcccctccattgttctccatgtgcntctcatcttgtgatctaggtccgaaagatctcgccaatctggaggctacatggcgtatttttcggcaaaccctgcaagttttgcaccagactttgcattgtcactttccggagcttgcgggcatttgatatgtgccagaaaaggaccatgtttaagcagatgaacagaannatcaggagtgtctgaaacccaccggtgtggaggctcttggaagcatgttcttgggtacattctggtaaggnaaaagaatggttttcgggtgattgccgggccagccc

SEQ ID NO: 24632 - protein, 69 aa, Zea mays
  misc_feature: Ceres CLONE 1395878-F
  misc_feature (44)..(44): Xaa is any aa, unknown, or other
  misc_feature (66)..(66): Xaa is any aa, unknown, or other
MQCPMDTAASGTSPVMQFHSNADESIAHSSPLATLIQRSQRLAXWGWIPRRIFPLAVSPSIVLHVXLIL

SEQ ID NO: 24633 - DNA, 733 bp, Zea mays
  misc_feature: Ceres CLONE 1395881-F
  misc_feature: Encodes the peptide sequence at SEQ ID NO. 24634
  misc_feature (449)..(449): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (468)..(468): n is a, c, t, g, unknown, or other
  misc_feature (555)..(555): n is a, c, t, g, unknown, or other
  misc_feature (657)..(657): n is a, c, t, g, unknown, or other
  misc_feature (671)..(671): n is a, c, t, g, unknown, or other
  misc_feature (684)..(684): n is a, c, t, g, unknown, or other
  misc_feature (693)..(693): n is a, c, t, g, unknown, or other
  misc_feature (701)..(701): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (720)..(720): n is a, c, t, g, unknown, or other
  misc_feature (724)..(724): n is a, c, t, g, unknown, or other
aaagctggagctccccgcggtggcggccgctctagaactagtggatcccccgggctgcaggaattcgcacgagaccattacctagaacatcctaatcgaaaactttccctttctggccgcattccctcgtcctccggcagccgtcgccagcttccgatggtccggaaggagacggccatgaggctgcccccgcagcacagtggcctggaggtcaagatccccagcttcttccgctgccccatctcgctggacgtcatgcgctcgcccgttagcctctgcaccggcgtcacctacgaccgcgcctccatccagcagtggctcgactccggcaacaccacgtgcccggccaccatcctcccgctcccctccaccgacctcgtccccaacctcactctccgcagcctcatcgccccactgggccgcctccgccgcctcctgttccccaccgncgccggnnngnnnccggantcgccgactcctcttcggcacgtacttcttctcccgcgagctcgtcccccagggtggcttccggccgggggtggacccctcgccggncctccgcgagctggcagcctatctctcccgaagacggacgtcgacgacttcgaaaagaacgcgttggtggggcgccggccgcgcccccgagaccgggcgggntcaggtccttcggnagaaaagccgagngaacccggncgcggaancggggnnnnncggggcagnaggnggcggtggc

SEQ ID NO: 24634 - protein, 192 aa, Zea mays
  misc_feature: Ceres CLONE 1395881-F
  misc_feature (20)..(94): Pfam Name: U-box Pfam Description: U-box domain
  misc_feature (98)..(98): Xaa is any aa, unknown, or other
  misc_feature (101)..(101): Xaa is any aa, unknown, or other
  misc_feature (102)..(102): Xaa is any aa, unknown, or other
  misc_feature (104)..(104): Xaa is any aa, unknown, or other
  misc_feature (172)..(172): Xaa is any aa, unknown, or other
  misc_feature (176)..(176): Xaa is any aa, unknown, or other
  misc_feature (182)..(182): Xaa is any aa, unknown, or other
  misc_feature (184)..(184): Xaa is any aa, unknown, or other
  misc_feature (185)..(185): Xaa is any aa, unknown, or other
  misc_feature (188)..(188): Xaa is any aa, unknown, or other
  misc_feature (190)..(190): Xaa is any aa, unknown, or other
MVRKETAMRLPPQHSGLEVKIPSFFRCPISLDVMRSPVSLCTGVTYDRASIQQWLDSGNTTCPATILPLPSTDLVPNLTLRSLIAPLGRLRRLLFPTXAGXXPXSPTPLRHVLLLPRARPPGWLPAGGGPLAGPPRAGSLSLPKTDVDDFEKNALVGRRPRPRDRAGSGPSXEKPXEPGRGXGXXRGXRXRW

SEQ ID NO: 24635 - DNA, 780 bp, Zea mays
  misc_feature: Ceres CLONE 1395886-F
  misc_feature: Encodes the peptide sequence at SEQ ID NO. 24636
  misc_feature (327)..(327): n is a, c, t, g, unknown, or other
  misc_feature (328)..(328): n is a, c, t, g, unknown, or other
  misc_feature (432)..(432): n is a, c, t, g, unknown, or other
  misc_feature (442)..(442): n is a, c, t, g, unknown, or other
  misc_feature (506)..(506): n is a, c, t, g, unknown, or other
aaagctggagctccccgcggtggcggccgctctagaactagtggatcccccgggctgcaggaattcgcacgagaccattacctagaacatcctaatcgaaaaatcacacactaatcaacaagcaggaccagctagctagctcctctcactgctatcacccgcccagccatctcgctgaaagagaaaagcgcagccatgaagactactagctcgggcattgcagtcgtcctactggtggccatgctggcagtccattccgcgttggccgacatctcgtgctccgacgtgctcaacgacctgtcggcgtgcctgcccttcctgcagggnnaggcagccaaacccagcgagagcaacaaccagtgctgcgaccggcgtgagggccctgtaccgcggcggcggacacagggcccgacaggcaggcaccgtggcggntgcctcaggncggcctacgttcagggtccacgctgtgctctcccccgggcaagaaatttgcccggggactgggnccttccggttgtcttacaaattcacccccgaattcgaaggggaaaaagaacgatggaggggtatactgttcccttaacaaaatcctaacacgggggggggggggtgggccaggggcccgggtaaaaaaaagggtggcccttggccctggggggcaaaaaaaagaggtttgggggggggttgggccaaataaaggggggcccccccgaaaccggggggggccccccttgtttttttttaaccgggggaaaatcccgggggggggggggtggtgaa

SEQ ID NO: 24636 - protein, 132 aa, Zea mays
  misc_feature: Ceres CLONE 1395886-F
  misc_feature (45)..(45): Xaa is any aa, unknown, or other
  misc_feature (83)..(83): Xaa is any aa, unknown, or other
  misc_feature (104)..(104): Xaa is any aa, unknown, or other
MKTTSSGIAVVLLVAMLAVHSALADISCSDVLNDLSACLPFLQGXAAKPSESNNQCCDRREGPVPRRRTQGPTGRHRGGCLRXAYVQGPRCALPRARNLPGDWXLPVVLQIHPRIRRGKRTMEGYTVPLTKS

SEQ ID NO: 24637 - DNA, 742 bp, Zea mays
  misc_feature: Ceres CLONE 1395887-F
  misc_feature: Translation starting site: 566
  misc_feature: SWISSPROT Homolog: EC 3.6.3.14 H(+)-transporting two-sector ATPase
  misc_feature (638)..(638): n is a, c, t, g, unknown, or other
  misc_feature (742)..(742): n is a, c, t, g, unknown, or other
aaagctggagctccccgcggtggcggccgctctagaactagtggatcccccgggctgcaggaattcgtgcgagatcattacctagaacatcctatgctgaagacaattagtagaatgctcgaccaggtgccccacggtggtgccggcgatggcaacccgctactggatcttctctctccccgtgcagtctcccggagccgccgcgtacctcgctttggtcgcgcctgaaagatgacatctcccgccactccttctacaccccgctggaccggttcaacgtcccggacctccgcgtcggcaccctctactccctcctcgagctcagggatgacctcgtcaagtgaaacgtgttctgtctagggcgtttcgcacaagatccggtagcagatcaaatacctcgagcgcgccggaggagtcgacagcgcatccctcaccgacgatggcgttcccgtcaacacctacctcaccaagttccgtgtggtatgatggcaagtaccccacaatgtagtcgctcaaggagatcgtcgtcagcatccagtcggaggtcgccaagatcgaggatgacatgaaggttcaagcacatcaatatgacaatgtaacgagccatcttactgcaatcaacagaaagcaaagtgggnagcttatcagttcgtgacctttacaatctgacagaccatgaggatatcggtctgctcagagcatctagtaatactttctgctaattggtttcgaagactctcan

SEQ ID NO: 24638 - DNA, 736 bp, Zea mays
  misc_feature: Ceres CLONE 1395888-F
  misc_feature (526)..(526): n is a, c, t, g, unknown, or other
acaagctggagctccccgcggtggcggccgctctagaactagtggatcccccgggctgcaggaattcgcacgagaccattacctagaacatcctaatcaaaaaattccaatcaatcggaccgacaccggctaaccctaacttctgtttgactgttgccttgcgtgtggcggctgctttgctgcgctgcgcaccgcgctccgtccgtccgtctaccggaaggccgtcccctggcccctgctcgacgacttcctcggtcgctcgtcttcctccgaacgcccgcggaccggctacctgcttgttctcctgaaggagcgcgccccgcgcgcaagacacgcagtccagcgccgggttgaagaaaaaggccagcgaccggtggatccccgtccagccgtcccctgctcctcttcactcgggacgaacgctcgtcatccactcttcctccagccctccatctgatccccgtacgagcgacccctgctcctcttcctgatgctccgatgctccagagctcggcccctattgcgntgatgcatcatcgcgacggcagctgctgcagatctctcctacctcgattgctcagctatctgtgaacctgatttcccgcatgcaatgctggactctagaacatactatactacggtgtttttccaagcagctgggcctgttgcctgcacctaagggacaatctacacttctcgtaccccaatactagaagaattccttaggtgggcccaa

SEQ ID NO: 24639 - DNA, 774 bp, Zea mays
  misc_feature: Ceres CLONE 1395889-F
  misc_feature (691)..(691): n is a, c, t, g, unknown, or other
  misc_feature (705)..(705): n is a, c, t, g, unknown, or other
  misc_feature (709)..(709): n is a, c, t, g, unknown, or other
  misc_feature (728)..(728): n is a, c, t, g, unknown, or other
  misc_feature (758)..(758): n is a, c, t, g, unknown, or other
  misc_feature (761)..(761): n is a, c, t, g, unknown, or other
  misc_feature (765)..(765): n is a, c, t, g, unknown, or other
catagctggagcttccccgcggtggcggccgcttcttagaacttagtggatcccccgggctgcaggaattcgcacgagaaccatttaacctaaaacatcctaatcgaaaaaaccaccgcacctatctcggtgatccatccactctcgtccccgtcccgtacttacctgactgagctcacacacacacgtacgatgccgaagccgtggaggccggtgctggcgtcgctcaccaagtgctgcgctggggacgaacgcggcgaggcgagccaagacggcctggagcgctatccgccgcgacacgtcggagttgtgctcgctgctggcactccctccattttgtctccaactctgacatcagactcggtgctgtcgtgctgtgcacgacccctcccctaggatcccaagctcctaactgagaaaacaggagatgggaagagacggggaacagactaggcgccggagccgcaagagatcccgcgacgcctccccctcctcgtcggattccgattccttcgactccccatcctctccgagcagtagccctgagcgacggagccgcagcagtaagcggaatagatcatcctcatcgcaccgccacagccgcaagaaaagcgaacggggtcgcggagatcccgcgacgaggaccgcccggcggcggaaaaaacggggccaggagagaaagcggaccggnggggggatgggggnaggnccccccgactcccaaccgncggagggggaaagggcgggaggaggccggnaanaccncccgaaaat

SEQ ID NO: 24640 - DNA, 662 bp, Zea mays
  misc_feature: Ceres CLONE 1395891-F
  misc_feature (556)..(556): n is a, c, t, g, unknown, or other
  misc_feature (557)..(557): n is a, c, t, g, unknown, or other
  misc_feature (597)..(597): n is a, c, t, g, unknown, or other
aaagctggagctccccgcggtggcggccgctctagaactagtggatcccccgggctgcaggaattcgcacgagaccattacctagaacatcctaatcaaaaaaaatctggaatcctttcacgcgcgttcctctcccctttttcattgtctcttcgtcgatgggagctcctgccttccagcctcggtgaatccagtcgcggagagagacaggacagcgcctactccccataatttcgccattcccatgatcgaaggtccataaaaaaccatcctttttgaatctgattgagcactgactgtgtgcaagataacaatttagtagtactacgaacaaaaagaaccgggagtattttatcagagtcttatgtacgaagaggactgtcttccaggaacccaagattcagaagaaagccgacaaactttagcaccgacaatgaatctagtcatgcctcccgcaggtgacgcgtccacgaaagactgtcagtcaaaccgtggcagccgctgagaatctgtggggcctggcgggtgatgggactgctcatcccaaccccggggnnttcaagaaattgaccaggggccccctttaaagtcctggantaagtaaggttttacgggattgaccccccagggtgtattttagaaaatttggggggggaaaacct

SEQ ID NO: 24641 - DNA, 775 bp, Zea mays
  misc_feature: Ceres CLONE 1395892-F
  misc_feature: Encodes the peptide sequence at SEQ ID NO. 24642
  misc_feature (390)..(390): n is a, c, t, g, unknown, or other
  misc_feature (444)..(444): n is a, c, t, g, unknown, or other
  misc_feature (467)..(467): n is a, c, t, g, unknown, or other
  misc_feature (528)..(528): n is a, c, t, g, unknown, or other
  misc_feature (559)..(559): n is a, c, t, g, unknown, or other
  misc_feature (604)..(604): n is a, c, t, g, unknown, or other
  misc_feature (677)..(677): n is a, c, t, g, unknown, or other
  misc_feature (697)..(697): n is a, c, t, g, unknown, or other
  misc_feature (709)..(709): n is a, c, t, g, unknown, or other
  misc_feature (710)..(710): n is a, c, t, g, unknown, or other
  misc_feature (768)..(768): n is a, c, t, g, unknown, or other
caaagctggagctccccgcggtggcggccgctctagaactagtggatcccccgggctgcaggaattcgcacgagaccattacctagaacatcctaatcgaaaactcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacnaccgtctttgatgccaagcgtctcatccggcagggaggttcagtggatgcgtcntgtccagagtgatatccaagttngtggcccttcaagggtcatttctgggggcctggtgagaaggccaaatggattgttgtccangcacaagggtgaagggagaagcagtttgcangctgaagagatcctcctcctatggttcttatcaagatggcgtgangattgctgaagcttaccttggtagcacgatcagaaaatgctggtggtcacagtccctgcctacttcaatgacncacagaggcagccaccaggnatgtctttgggnntgatgcttggcctttaatgtgctgcgtatcatcaacgagccacagctgcagctatcgncctatgt

SEQ ID NO: 24642 - protein, 71 aa, Zea mays
  misc_feature: Ceres CLONE 1395892-F
  misc_feature (69)..(69): Xaa is any aa, unknown, or other
MAGKGDGPAIGIDLGTTYSCVGVWQHDRVEIIANDQGNRTTPSYVAFTDSERLIGDAAKNQVAMNPINXRL

SEQ ID NO: 24643 - DNA, 800 bp, Zea mays
  misc_feature: Ceres CLONE 1395895-F
  misc_feature: Encodes the peptide sequence at SEQ ID NO. 24644
  misc_feature (768)..(768): n is a, c, t, g, unknown, or other
  misc_feature (794)..(794): n is a, c, t, g, unknown, or other
aaagctggagcttccccgcggtggcggccgctctaaaactaagtggaatcccccgggcttgcaagaaattcgcaacgagaaccattccctagaaaacaccctaatccgaaaaacaattagaatgttcctgcttctcgaaacgaatcagtctgaaaatgcattggcatctgtacggattccgatcttaacagcatagcagcttgcatgtgcatggaacagatcattgcgaccttaacactccgtcgcccaaagccattgggacaaccgaacaacgaaacgtgcgtgtgagccttagacgaccgccttccccgctcgctcgctgaacggttggcgcacaagcgcatctcacggacgcacgaccatcgctgatgcaataacgaagctcgatcatcgctctatcgacgagtacgtgcttcaagaacgtggcgccagcgtcacggattacatgacccagctcccgacataccctcaatcctctccaagacaactccccagtattcagtcctcaagcatgatatcctcgatccacaccacaccgtcactcaaaagattgttgttcctaacaccagagtacgccgcacctacttcaggcgtgccgcgccactgcagcgtgagtacttactacccgatcacgataatcccgctcttgtcacctgcggaaggcctctgtccgcaattgaacacgcttatactacagcttgtatgacggcttgcattatatgaaatgtgccctcccggcgtggagggaataatggagggataccaagntttcttattctaaaaatactggtgcncctccc

SEQ ID NO: 24644 - protein, 64 aa, Zea mays
  misc_feature: Ceres CLONE 1395895-F
KLELPRGGGRSKTKWNPPGLQEIRNENHSLENTLIRKTIRMFLLLETNQSENALASVRIPILTA

SEQ ID NO: 24645 - DNA, 731 bp, Zea mays
  misc_feature: Ceres CLONE 1395897-F
  misc_feature: Encodes the peptide sequence at SEQ ID NO. 24646
  misc_feature (439)..(439): n is a, c, t, g, unknown, or other
  misc_feature (511)..(511): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (589)..(589): n is a, c, t, g, unknown, or other
  misc_feature (603)..(603): n is a, c, t, g, unknown, or other
  misc_feature (615)..(615): n is a, c, t, g, unknown, or other
  misc_feature (626)..(626): n is a, c, t, g, unknown, or other
  misc_feature (704)..(704): n is a, c, t, g, unknown, or other
aaagctggagctccccgcggtggcggccgctctagaattagtggatcccccgggctgcaggaattcgcacgagaccatttacctagaacatcctaatcgaaaaaggctccaattggcatctcgtctcgcgctcgctttccccagtccacttcgcgcttctcgtttcccggagcttcgcgatgcagcgccttctcgcgctggtggcagccctgctggtgctgctggcgtcgcgtccagcgctggccaccgacccctacgccttcttcgactgggacgtctcctacgtcactgcggcgccgctcggcgtcaagcagcaggtgataggcatcaacggcaagttccagggcccgtcgtgaacgtcagcaccaactggaacgtcgtcgtcaacgtgctcacggacctcgacgagcccctcctcatcacctgggaacgggatccngcaccggaaaactgcttgcaagggacggggtgctcggcaccaactgccccatcccgcccggtgggaactggnacgtacgagttcccaggtgaaggaccagatcggcagcttcttctacttcccctccccggcctannngcgggcgcccgnggggcttcgggggnttcgtcgtcacnaaccggacggncttcgccgtgcccttcccccgccccgacggcgacatcaccatcttcatcggcgactggtacaacaagaaccacacggnatctgaggaagatgctgaaaccagggt

SEQ ID NO: 24646 - protein, 58 aa, Zea mays
  misc_feature: Ceres CLONE 1395897-F
MQRLLALVAALLVLLASRPALATDPYAFFDWDVSYVTAAPLGVKQQVIGINGKFQGPS

SEQ ID NO: 24647 - DNA, 729 bp, Zea mays
  misc_feature: Ceres CLONE 1395898-F
  misc_feature: Encodes the peptide sequence at SEQ ID NO. 24648
  misc_feature (374)..(374): n is a, c, t, g, unknown, or other
  misc_feature (391)..(391): n is a, c, t, g, unknown, or other
  misc_feature (466)..(466): n is a, c, t, g, unknown, or other
  misc_feature (547)..(547): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (600)..(600): n is a, c, t, g, unknown, or other
  misc_feature (663)..(663): n is a, c, t, g, unknown, or other
aaagctggagctccccgcggtggcggccgctctagaacaagtggatcccccgggctgcaggaattcgcacgagaccattacctagaacatcctaatcgaaaaacgctccaccgacgactcttcttcctcacctcctcccgctcacgctcccgctcgtctctcttcctcctcccatgtagggtttccgcttcccgtctcgcccccctcaccatggggcgacaactacgatcaccaacgctagccgatcgtgaacctcgacgaacgggaaccctcccctgaccatcagccgtactaagacctcgatgacaacctcaacggcagcggcgattgcacccgtaaccgctctccgacccccgtccacgggacatgggctncgcagggtcctcctccnagccccgaaagcgcttctcaaaagggcgccgggtggaggatgcccggcgatgcgggctggatgaacttgggttgnaggacgaggaccggacccttcggctgggcaggaataggaaggctcgtcgtcgctgaggacccgcgaggggcggagcggcanggaagaaaaggtaaaaaatgcgagggagacgacgnnnaggggaggaacctggnatggtgagggataggcgtgatacaggaggaaggactctagcggtaatatgaccagatgatggnaaaaagggataccaggagctctgagaacccattggtagtggtgaatctgaagattaccctcaaggt

SEQ ID NO: 24648 - protein, 58 aa, Zea mays
  misc_feature: Ceres CLONE 1395898-F
  misc_feature (12)..(12): Xaa is any aa, unknown, or other
  misc_feature (39)..(39): Xaa is any aa, unknown, or other
  misc_feature (51)..(51): Xaa is any aa, unknown, or other
  misc_feature (52)..(52): Xaa is any aa, unknown, or other
  misc_feature (57)..(57): Xaa is any aa, unknown, or other
MPGDAGWMNLGXRTRTGPFGWAGIGRLVVAEDPRGAERXGRKGKKCEGDDXXGRNLXW

SEQ ID NO: 24649 - DNA, 724 bp, Zea mays
  misc_feature: Ceres CLONE 1395899-F
  misc_feature: Encodes the peptide sequence at SEQ ID NO. 24650
  misc_feature (502)..(502): n is a, c, t, g, unknown, or other
  misc_feature (552)..(552): n is a, c, t, g, unknown, or other
  misc_feature (686)..(686): n is a, c, t, g, unknown, or other
ctggagctccccgcggtggcggccgctctagaactagtggatcccccgggctgcaggaattcgcacgagaccattacctagaacatcctaatcgaaaagattgattcacaagacgtcgatcccaaaccctaaccctttcaacggttccactccaccaccaacctcatgtgtcggcgcccgccgccgcacccaacccctccctcctccgtctgctcccggtcctcgcgtagccgcaacctccctcgttgccccacactacccacgtccctagcgtcatgcagatcaaaaccaaggggcaggcggcgacagtggttcagagtccgccgctgacggccctgcgaggaacgggtagattcgcttggtgtccgggcggctccgcgtcgccgaatccgatagcattgtggatctggaggtaggaaaagggcttggtggtagacgtggagggacgaatggcgttcatgggtcctagaagtaagcgcgatggtctcctcaggcatcggcnttcgtggaacggctggttcttcccatcatagatcagaagaagactcagtncataaaaaagttcatcattgttgcttgaatcccacaaaatggccgctggtcttcttcatttcgttgagcatgccagatctggggaaaatggtttgtttccttcgcttcgcttgaatcccacagtaagctgctgntatctagtttcattactacaaaagcttttttgggggaa

SEQ ID NO: 24650 - protein, 54 aa, Zea mays
  misc_feature: Ceres CLONE 1395899-F
MCRRPPPHPTPPSSVCSRSSRSRNLPRCPTLPTSLASCRSKPRGRRRQWFRVRR

SEQ ID NO: 24651 - DNA, 753 bp, Zea mays
  misc_feature: Ceres CLONE 1395900-F
  misc_feature: Encodes the peptide sequence at SEQ ID NO. 24652
  misc_feature (270)..(270): n is a, c, t, g, unknown, or other
  misc_feature (292)..(292): n is a, c, t, g, unknown, or other
  misc_feature (481)..(481): n is a, c, t, g, unknown, or other
  misc_feature (482)..(482): n is a, c, t, g, unknown, or other
caaagctggagctccccgcggtggcggccgctctagaactagtggatcccccgggctgcaggaattcgcacgagaccattacctagaacatcctaatcgaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgcngggcccggacgccggctcgcgngccttcttcggtgcgcgtgcgccgccgcctgccggacttcctgcagtcggtgaacctcaagtacgtgcgcctcgggtaccactacctcatcagccacggcgtgtacctggccaccatccccgtcatccgtgctggtgtgcggcgccgagctgggcagcctcagccgcgacgagctgtggcgcaaggtgnngggggggaggccacctacgacctcgccaccgtgctcgccttcctcgccgtcctcgccttcaccatctccgtctacatcatgtccaggcccaggcccgtgtacctcatcgacttcgcatgctacaagccggccgacgaagctcaaggtgtcccaagggcggagttcatcgacctggcgcgcaagtccggcaagttcgacgaggacagccctggcgttccagtcgcgtctgctggccaagtccggcatcggcgacgagtcgtacatggcgcgc

SEQ ID NO: 24652 - protein, 64 aa, Zea mays
  misc_feature: Ceres CLONE 1395900-F
  misc_feature: SWISSPROT Homolog: EC 2.3.1.119 Icosanoyl-CoA synthase
MSRPRPVYLIDFACYKPADEAQGVPRAEFIDLARKSGKFDEDSPGVPVASAGQVRHRRRVVHGA

SEQ ID NO: 24653 - DNA, 781 bp, Zea mays
  misc_feature: Ceres CLONE 1395901-F
  misc_feature: Translation starting site: 375
  misc_feature (312)..(312): n is a, c, t, g, unknown, or other
  misc_feature (337)..(337): n is a, c, t, g, unknown, or other
  misc_feature (404)..(404): n is a, c, t, g, unknown, or other
  misc_feature (405)..(405): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (466)..(466): n is a, c, t, g, unknown, or other
  misc_feature (467)..(467): n is a, c, t, g, unknown, or other
  misc_feature (511)..(511): n is a, c, t, g, unknown, or other
  misc_feature (512)..(512): n is a, c, t, g, unknown, or other
  misc_feature (522)..(522): n is a, c, t, g, unknown, or other
  misc_feature (535)..(535): n is a, c, t, g, unknown, or other
  misc_feature (594)..(594): n is a, c, t, g, unknown, or other
  misc_feature (595)..(595): n is a, c, t, g, unknown, or other
  misc_feature (608)..(608): n is a, c, t, g, unknown, or other
  misc_feature (609)..(609): n is a, c, t, g, unknown, or other
  misc_feature (614)..(614): n is a, c, t, g, unknown, or other
  misc_feature (615)..(615): n is a, c, t, g, unknown, or other
  misc_feature (636)..(636): n is a, c, t, g, unknown, or other
  misc_feature (647)..(647): n is a, c, t, g, unknown, or other
  misc_feature (649)..(649): n is a, c, t, g, unknown, or other
  misc_feature (656)..(656): n is a, c, t, g, unknown, or other
  misc_feature (682)..(682): n is a, c, t, g, unknown, or other
  misc_feature (692)..(692): n is a, c, t, g, unknown, or other
  misc_feature (706)..(706): n is a, c, t, g, unknown, or other
  misc_feature (748)..(748): n is a, c, t, g, unknown, or other
  misc_feature (757)..(757): n is a, c, t, g, unknown, or other
  misc_feature (758)..(758): n is a, c, t, g, unknown, or other
  misc_feature (764)..(764): n is a, c, t, g, unknown, or other
caaagctggagctcaccgcggtggcggccgctctagaacaagtggatcccccgggctgcaggaattcgcaacgagaccatttacctagaacatcctaatcgaaaaagtcgtaagctccttcttcctaacacagaaaagccgtcgcctactcgcctccggccaaaaaactgactccacacacgacccaaatcttttcctctccacaggcgactcccaacgcaacagcagcttcgtcgagcgagtcgtcgccggccggccggtatatacgcaagaaagccaagaaaaacacttctgcctcttcctccatatccnagaaccaaaggtagctagctagccncgactcgttggctagacgattcaagcagcagcgcaggatggtggcgccgggtggtgattgcgtccgnnccgggttgggcatgctttggcgnnnggtggcgattggccaaccggtcccctcgggaacggnnctcccggcggccctccaaaggtgggaacgcgcgcccgcgctgcnngcaacgtgcnggcggctcccggncccgcgttgaagtgcatctggcaaccgcttgggtccgacgggcgaactccggctgccgnnacctgccgcttgnntccgnnggaggatgcccttgccgccancctggggcggncntccggcncggggcccgacggctccctggacggnttaccgtccnagaacagaagtcgncggccggcgccggccgcccggttaaaaatgatcgatgggggnatgattaannatcccnatcccggggatatatca

SEQ ID NO: 24654 - DNA, 684 bp, Zea mays
  misc_feature: Ceres CLONE 1395902-F
  misc_feature (573)..(573): n is a, c, t, g, unknown, or other
ggagctccccgcggtggcggccgctctagaactagtggatcccccgggctgcaggaattcgcacgagaccattacctagaacatcctaatcgaaaactccttcccctccctctttccacgacaccaaaagaaaccgaaaaccatggacgcgctccgtccaccctcccctaccccgcgtcctcctcccctacgcctcccagcccagcggggaaacctaaccctagatgggagccgtcacctctacggtcgcggcgcgctttgcctttgtcccgccgagaccggcgtcgtacggacctcgagcagccggcgccgattccgggccctgccacagcccgagcctccggccccgaccacatccaagccggcgactccggacccggtcacacccaagccgccgcctccgggcccgagcacacccaagacgccgccagtcggctaggagaagagaaggcatgcggtggtgtagctcatgcgcgcgccgagtacgagtaacgcggaacgcttcgaggttgaccactaagcgttgaaacgacagtcgtccacaatgaacctgacgagcatgggcgccacagntgcacgctctcgtactcatggggcagagaagcaaagctacgtgagatgtgaagctctcgctcgagtggattcctgagctgacgacattaccgggggggggatgagaataag

SEQ ID NO: 24655 - DNA, 731 bp, Zea mays
  misc_feature: Ceres CLONE 1395904-F
  misc_feature: Encodes the peptide sequence at SEQ ID NO. 24656
  misc_feature (609)..(609): n is a, c, t, g, unknown, or other
  misc_feature (690)..(690): n is a, c, t, g, unknown, or other
aaagctggagctccccgcggtggcggccgctctagaactagtggatcccccgggctgcaggaattcgcacgagaccattacctagaacatcctaatcgaaaaaccaaaatgtaacaaaacgcatgccccggagctggacgctaggcaccccaaaggtccgcctccgcaccttctctcactcgcccagccgagggtatggcggccaccacatccacggcgggagcggcagtatccttctccctcccctcaccaccgcactgccgaggcgcccggcgccgacgcgcgccttccctcctccgtggcgcctccaccgccgcgcccgcctcccccgatgtctccatccagctctcgccccgcgcgtccccgcccgcgtctaccaacggcgccggcaccgcgcttggaccccacgtgtccgactcctttgcccgtgaccgcgcagaggacctgcaggacgaggcccgagcgatggcccgcgccggtggcgccacagactacagacccgagctcctcgccggccgttacggctcccgtcccttcaaggtgtcgctccgagatagtggaggtgctgaccaacgtgtagtccattcgacttgaaaggcctactggagnacgacaaaagtcgagtcgtcatacggagaggatgcatcgacagggtcgctgaagttcgcgcaccatcttcaataggctcgntgccagccctacgtcaaaatttggagaggaactgtcccacg

SEQ ID NO: 24656 - protein, 132 aa, Zea mays
  misc_feature: Ceres CLONE 1395904-F
MAATTSTAGAAVSFSLPSPPHCRGARRRRAPSLLRGASTAAPASPDVSIQLSPRASPPASTNGAGTALGPHVSDSFARDRAEDLQDEARAMARAGGATDYRPELLAGRYGSRPFKVSLRDSGGADQRVVHST

SEQ ID NO: 24657 - DNA, 648 bp, Zea mays
  misc_feature: Ceres CLONE 1395905-F
  misc_feature (300)..(300): n is a, c, t, g, unknown, or other
  misc_feature (333)..(333): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (352)..(352): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (384)..(384): n is a, c, t, g, unknown, or other
  misc_feature (387)..(387): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (403)..(403): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (454)..(454): n is a, c, t, g, unknown, or other
  misc_feature (469)..(469): n is a, c, t, g, unknown, or other
  misc_feature (471)..(471): n is a, c, t, g, unknown, or other
  misc_feature (497)..(497): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (558)..(558): n is a, c, t, g, unknown, or other
  misc_feature (559)..(559): n is a, c, t, g, unknown, or other
  misc_feature (561)..(561): n is a, c, t, g, unknown, or other
  misc_feature (562)..(562): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (612)..(612): n is a, c, t, g, unknown, or other
  misc_feature (613)..(613): n is a, c, t, g, unknown, or other
  misc_feature (620)..(620): n is a, c, t, g, unknown, or other
  misc_feature (634)..(634): n is a, c, t, g, unknown, or other
caaagctggagctccccgcggtggcggccgctctagaactagtggatcccccgggctgcaggaattcgcacgagaccattacctagaacatcctaatcgaaaagttccaaaaagaaaaaagaaaaactcagccgccggccgctgcccctctcggctgcacgacgtccgtgagggcgtgccccctggccccgtcccttgtcgcctgcccgccggtgcccgcacaggctagaccagtgaccattacttgccattccactccgtccggcccgtctgcccaggcatgcactgcccccggcgcgnttgggccatccccggatcgctggttttctctgnccccagggcgccnnncccnaaaannnnngggccccgcgcccagggggtccnccnaaacacccnnnnnngngggnnnnnnnnnnnnnnnnnnnnncccccccccccccnnnnnnnnnnnngnggggggaaaaaaaancncccccccccccgcccccggaaaaaanaaaaaaaannnnnnaaannnnnnnaaaacgcccccccgcgcggnnngnnnnnnnngnnngnngnnaaaaaaaagaccggggcgcggnnnngcggcggcggggggggtgagggtgnntggtggnggcgacaccccccnaatttttttcttcc

SEQ ID NO: 24658 - DNA, 752 bp, Zea mays
  misc_feature: Ceres CLONE 1395906-F
  misc_feature (348)..(348): n is a, c, t, g, unknown, or other
  misc_feature (349)..(349): n is a, c, t, g, unknown, or other
  misc_feature (396)..(396): n is a, c, t, g, unknown, or other
  misc_feature (403)..(403): n is a, c, t, g, unknown, or other
  misc_feature (653)..(653): n is a, c, t, g, unknown, or other
  misc_feature (655)..(655): n is a, c, t, g, unknown, or other
  misc_feature (661)..(661): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (750)..(750): n is a, c, t, g, unknown, or other
aaagctggagctccccgcggtggcggccgctctagaacaagtggatcccccgggctgcaggaattcgcacgagaaccatttaccctagaacttcctaaaaaaaacataaattaacacacaaagttgtccgatcaaagctttgcgcgtttacaatgtctggacgatcaaggcactttcacaatgtccaccccttcttcgcttacgagcttccttcttttgtaacttcctaatgcagctcgcttacaaagtacgtggcgtgaactaacacgttcgtgaaggacgcggcgttggcgcccagcgtgtcgtaactaacgactaaatcaatcgttgcacggtggcaccgaccgnntgccgctgcccgccacgctgtcggacgactacgcgtgctgctgctgnagcgcgnctctcgccctactacacgaccgcatcggagactgccccgcttccggacacctgtcgaaaacttcccgggtcgccgggaagcttcgggcgaagacgggtataacccggccccgggggtttggcgggaatttatataaaccggttttaaacgggccaggaaaaaaaatggggggttttggtgaacctgggccccccggccaaaaacggttttaaaaaaagtgttctccccacgggagttgggcccttgaccngnaaaaantttttccnnnnnnnnnnnnnngnnnnnnnnaaaannnnnnccnnnnncnnnncccccnnnnnnnnnnnnnnnnnnnnnnnnnnnnnnangt

SEQ ID NO: 24659 - DNA, 745 bp, Zea mays
  misc_feature: Ceres CLONE 1395907-F
  misc_feature: Encodes the peptide sequence at SEQ ID NO. 24660
  misc_feature (409)..(409): n is a, c, t, g, unknown, or other
  misc_feature (414)..(414): n is a, c, t, g, unknown, or other
  misc_feature (423)..(423): n is a, c, t, g, unknown, or other
tggagctccccgcggtggcggccgctctagaactagtggatcccccgggctgcaggaattcgcacgagaccattacctagaacatcctaatcaaaaattaataaaaagtttgctagtgagtcgagaagagagagagaggcgtccggaattcatcgccagcgatgtctccgtccgccgacgcccccggaccggactcctccgcctcggggcccccgctcgcgcccctcatcgccgcgcagctcaactacctcctctcgcactccaagctgcccattagggtggtacagatctggtccggctgccgcaacggtcgccctgccgcatcggttcaggctcgccatccccttctgcctcgactacgtccactggggatttcgtgtacaatgagctgtctcccaaggtggaccangacgntgctgatcnggaccggagagatgacatgttccagaccggtgtacgattacgctgactgctggagatgtcgataacagctggtttgagaagttgggattgccgcgaccccctaggtactccatgcgctcgtacaggagcttcgagtactggacattgaatacaaaaaggtgcggattcacatgagggatgacgccggactagagtttgaacaaagcacgttctctctaggaagggatttgaaggcggggtggtaacttctgctgaaggccggatgagggccaagttgctgaacacttctggggcttgaatttgatttggccattgcgtgccg

SEQ ID NO: 24660 - protein, 108 aa, Zea mays
  misc_feature: Ceres CLONE 1395907-F
  misc_feature (83)..(83): Xaa is any aa, unknown, or other
  misc_feature (85)..(85): Xaa is any aa, unknown, or other
  misc_feature (88)..(88): Xaa is any aa, unknown, or other
MSPSADAPGPDSSASGPPLAPLIAAQLNYLLSHSKLPIRVVQIWSGCRNGRPAASVQARHPLLPRLRPLGISCTMSCLPRWTXTXLIXTGEMTCSRPVYDYADCWRCR

SEQ ID NO: 24661 - DNA, 693 bp, Zea mays
  misc_feature: Ceres CLONE 1395909-F
  misc_feature: Translation starting site: 251
  misc_feature: SWISSPROT Homolog: EC 3.4.16.6 Carboxypeptidase D
  misc_feature (417)..(417): n is a, c, t, g, unknown, or other
  misc_feature (451)..(451): n is a, c, t, g, unknown, or other
  misc_feature (464)..(464): n is a, c, t, g, unknown, or other
  misc_feature (481)..(481): n is a, c, t, g, unknown, or other
  misc_feature (494)..(494): n is a, c, t, g, unknown, or other
  misc_feature (507)..(507): n is a, c, t, g, unknown, or other
  misc_feature (513)..(513): n is a, c, t, g, unknown, or other
  misc_feature (626)..(626): n is a, c, t, g, unknown, or other
aagctggagctccccgcggtggcggccgctctagaactagtggatcccccgggctgcaggaattcgcacgagaccattacctagaacatcctaattgaaaaattggctgtcagtcacttccagtcctggcccactcctccgatgctccaatcatcaacactctctacctgtgtccgtgtgctctgctactctgcaccaccaaccaaccagtgctgccctccgccgatccactgacctaccgcgagcgccaatggcgaccgccgcggtcctggccgccacattagcgctgttcctccgcgccgccgccgcaacggccgcgacggctgcggcggaggcggaccggatcggcaggctgcctggccagccgccggtcaacttctccatgtactccggctacgtcaccgtggacgcggcggncggggcgggccctcttctactggttcatcgaggncggccggcgtggnccgcggagtccgcgccngctcgtgctgtgnctcaacggcgggncccggntgctcctccgtcggctacggcgcgtcagaggagctcggcgccttccggatcaacgccgacggcaggacgctctacttgaaccctacccctggaataaagtgcgaacatgctgntcttggactcgcccggccggcggtcgctactcatactccactccacctccgatctgtacaactgccg

SEQ ID NO: 24662 - DNA, 757 bp, Zea mays
  misc_feature: Ceres CLONE 1395910-F
  misc_feature: Encodes the peptide sequence at SEQ ID NO. 24663
  misc_feature (379)..(379): n is a, c, t, g, unknown, or other
  misc_feature (406)..(406): n is a, c, t, g, unknown, or other
  misc_feature (415)..(415): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (442)..(442): n is a, c, t, g, unknown, or other
  misc_feature (466)..(466): n is a, c, t, g, unknown, or other
  misc_feature (496)..(496): n is a, c, t, g, unknown, or other
  misc_feature (497)..(497): n is a, c, t, g, unknown, or other
aagctggagctccccgcggtggcggccgctctagaacaagtggatcccccgggctgcaggaattcgcacgagaccatttacctaaaacatcctaaatcgaaaaatccgacccagtatccccgacaaagtcaatgcgatgcgtctcctccttgctctatcgactatcgtagccgattccccgttgcaagtaactaaaactaagtctcaagtctgcagagtaaccggagtagcataagcactagcaagcaatggccgctctcacttccgctttccttttcgccgccctcctcgtggccgcccagtacgtgctccgcttgctccactccttcctgtgggtcccgttccgcctggaacgccgctttccggcgcaggaaatccnggtgccaccacgaagcctggtctccgntaacgcagncgactaccgcgacctgtagnnncgcgncaggtcgggcccctctctcttcgncaaaaaaaggggtcgtcgccggccacgccnnaaatacgcggctggtttgccgcggacacgccggcccgtttttgaaatggtttcggccccggcccgggtttgggaattcccaaccggaatttcgtgaaggccggatgaccattccccggggggtttttaaaaggggccctcgggggaaaaaacccttccccgggaattctatgggagggggtccgcgccttcccccgggaaaatggggcgccccccgccgggatttctcccggtttaaatggaaaggggagaattttattt

SEQ ID NO: 24663 - protein, 61 aa, Zea mays
  misc_feature: Ceres CLONE 1395910-F
  misc_feature (44)..(44): Xaa is any aa, unknown, or other
  misc_feature (53)..(53): Xaa is any aa, unknown, or other
  misc_feature (56)..(56): Xaa is any aa, unknown, or other
MAALTSAFLFAALLVAAQYVLRLLHSFLWVPFRLERRFPAQEIXVPPRSLVSXNAXDYRDL

SEQ ID NO: 24664 - DNA, 747 bp, Zea mays
  misc_feature: Ceres CLONE 1395911-F
  misc_feature: Encodes the peptide sequence at SEQ ID NO. 24665
  misc_feature (384)..(384): n is a, c, t, g, unknown, or other
tggagctccccgcggtggcggccgctctagaactagtggatcccccgggctgcaggaattcgcacgagaccattacctagaacatcctaatcgaaaaatccgcccgccgcttttctctctgctttggagagggagccgcacgcagtggtttctgctgctgctgccgctggtccgccagggtcccgggcgctgtgctcattccaccggtcggcggtgcactttcaggctacttcgacggtgacgagagtggaggaaatgtcgacgacggagtgcgcggacctcggggaggagttctggctgccggaggactttttggacgacgacttcttctccgaggaggagaaggcggccgtggcggcgcggagcgagagcgacgaggagganagcctggcggggctctcgcgccgcctcgcgggcctcctcggcgacgggggagagcgcaaggctcccgcggccaaggcggaggtggacggttgggtcgctcagtcgacgctgtgcggcctgcccaagtcggggcaggagagccccagcggcggggcgtccaagggcaccgtcgccgccgtcgtcgcccctggagcagagcccgcccgacccgtgggatctgctctacgaggcgggcgggacaggttgcgcgcatgcgcgccgcccacagcgtgccggtgcagcccgccaacgttttcacggccagagggggttcgcgcccgccgcaagaaagccctcggccactccaatcggaccttcctcctt

SEQ ID NO: 24665 - protein, 164 aa, Zea mays
  misc_feature: Ceres CLONE 1395911-F
  misc_feature (43)..(43): Xaa is any aa, unknown, or other
MSTTECADLGEEFWLPEDFLDDDFFSEEEKAAVAARSESDEEXSLAGLSRRLAGLLGDGGERKAPAAKAEVDGWVAQSTLCGLPKSGQESPSGGASKGTVAAVVAPGAEPARPVGSALRGGRDRLRACAPPTACRCSPPTFSRPEGVRARRKKALGHSNRTFLL

SEQ ID NO: 24666 - DNA, 705 bp, Zea mays
  misc_feature: Ceres CLONE 1395911-R
cgaattgggtaccgggccccccctcgaggtcgacggtatcgataagcttttttttttttttttttggtagtagtgaaattccatatattattgtaccacaaagccatgagaggcatacacaagatatatataaatttatatcgctgctgtcgacactggaaaccggcaaccagcagctgtgctaagcaactaaccacttcactaataaacaccattactactagcaaaacaggggggacactgttactactagcaagcactggtacaggcgaaacacaaacaattcctttgataaatactctaggacaacaaagcaaacgcccttattcatggagcccacggcaagcttcttttgcaagtacaaaaaaaaaggttgcaaacagagggacgagagagaggctctagctgcggctgctggtagccccccaccaaagcaagcaaaagccactcgtggatggatggagaaatgacatgttatctatcatctccatgagcgaaaaatcccttattccacattttttttttcaaatctcaaattcttgcatcagctaaacactttttttcttcgaacccctaatatatacgggtccccccaaaccccaaactggatttcaaaactttccccccaatcccccccaaaaaaccaaaattctcccgaacccaaaagaaaaaacccccccccgggggtaaaccctaaattttttt

SEQ ID NO: 24667 - DNA, 728 bp, Zea mays
  misc_feature: Ceres CLONE 1395912-F
  misc_feature (351)..(351): n is a, c, t, g, unknown, or other
  misc_feature (352)..(352): n is a, c, t, g, unknown, or other
  misc_feature (358)..(358): n is a, c, t, g, unknown, or other
  misc_feature (383)..(383): n is a, c, t, g, unknown, or other
  misc_feature (389)..(389): n is a, c, t, g, unknown, or other
  misc_feature (418)..(418): n is a, c, t, g, unknown, or other
  misc_feature (441)..(441): n is a, c, t, g, unknown, or other
  misc_feature (548)..(548): n is a, c, t, g, unknown, or other
  misc_feature (560)..(560): n is a, c, t, g, unknown, or other
tggagctccaccgcggtggcggccgctctagaactagtggatcccccgggctgcaggaattcgcacgagaccattacctagaacatcctaatcgaaaaatcgccgcccacacccgaccgcgtggccggcctcatgtgggagcgcggcaggccgccccgcaagccgcgcccgtccccaatcctcgtgccgccgccaccgtcgtcgccgcctccccgcctgaacctcctcctcccgagatccctcctcgcgctcgccgcgcgcgccatgccgtcgcgcccccctccccggtcctcctcctcctcctcgcgctctcgctcgccctcctcttccttctcctctccccttccttcnncctcanctcccgcttctctcgctccctcagntctggnctccgctttcgcctcctccattctccggngtcaaccctccgcctcgcctggnaccccgtcagatcttacctgtacgacctggccgggcaggttaacctaacgggcggtcgtcgtagctacaagggggtgggcggggggacatctggcttcccggaaagnggcgttctactntttctgccgcgaaaaactggggtacccgggaccagaatttcctgggggggaggtggggtttttcaggactgtcctccaacaaaagccgaagaaccccccccgggggaccggtgggaacacccagggacccaaccttttttaaggggcttttttcccttcttaagaggg

SEQ ID NO: 24668 - DNA, 757 bp, Zea mays
  misc_feature: Ceres CLONE 1395916-F
  misc_feature: Encodes the peptide sequence at SEQ ID NO. 24669
  misc_feature (416)..(416): n is a, c, t, g, unknown, or other
  misc_feature (542)..(542): n is a, c, t, g, unknown, or other
  misc_feature (682)..(682): n is a, c, t, g, unknown, or other
  misc_feature (704)..(704): n is a, c, t, g, unknown, or other
ggagctccccgcggtggcggccgctctagaactagtggatcccccgggctgcaggaattcgcacgagaccattacctagaacatcctaatcgaaaaagcctgcgctccccttctttcccgttcggctcacagcgaagaaggaagccggttagggtttccacctcctttcccctcctctccttcagcgacgaccgcgggccacaccctcgatatccttcccctcggacccggaggcgagcagcagcctccagcgcctgccacgcctgcccgtctcgttattgggaggattcgccatgtctgacatggagtccgtcacagctcttatgaactcgacaagctccaagatacagcagcttcaggaggcatttgctgagcttgagagccagagcacggtttccatgaacctcaagtggagncagcttgaagacccactttcgtggtcttgaacagtccctcaagaaaaagtttgacgagctaaaagagcagggagaaggagttccaggagactgtcgcaaaatcagagcagattctggagcagcggnaggcagctgttgtggcaaaggaactgactccctttggagaagttgcaggagaagagggaagctgcattagctatgatctttagcaagtccaggctttccttacctgttcctaccatcaacccaatgaacaaggcgctganttaatcttgggtgtcaagtggncaaaacggcatccggaggagagtgtgcactttgcagttgataatgctgtagtg

SEQ ID NO: 24669 - protein, 50 aa, Zea mays
  misc_feature: Ceres CLONE 1395916-F
  misc_feature (41)..(41): Xaa is any aa, unknown, or other
MSDMESVTALMNSTSSKIQQLQEAFAELESQSTVSMNLKWXQLEDPLSWS

SEQ ID NO: 24670 - DNA, 766 bp, Zea mays
  misc_feature: Ceres CLONE 1395917-F
  misc_feature: Translation starting site: 289
  misc_feature (739)..(739): n is a, c, t, g, unknown, or other
  misc_feature (753)..(753): n is a, c, t, g, unknown, or other
aaagctggagctccccgcggtggcggccgctctagaactagtggatcccccgggctgcaggaattcgcacgagaccattacctagaacatcctaatcgaaaagcatcttcgcctccgctcaacgctcgcccagcccgccgcccccccaccgatccacgagaaaccttctcgcctccgcgggacgattcgccagggagagcaaaggtagcagaggcgccatggacgctgccaagtcggtgacgccgggcgccgtgtcctacatcctggcgcacccgtctacgggctccgatggcgccgtgtcggatctcgtcgttcaggtcctcgatctcaagtccatcggcatgggcaagccggttcagtttcacggcaaccgatgggaacgacaaaatcaaggcgatgctccccacttacttttgcgtcggaggtccactccggcaatctgaaagaatttcggtctcatccgcatcctcgactacacttgcaactccgtcaaaggcaacgctgacaaaagtcctgattgtcgtcaaatgcgagactgtgtgcgaagcgctcgacgccgagatcaacggcgaggccaagaaagaggatcctccaattgtgctgaagcctaaagacgaaggctcagtcgtggctgaggaaacaaattctcccccactcgtgatgaacctaagccaagaggtgaagtcccgcgtcccagatcgtgactggagcagcgtggaaatgctgctcctgccacgcngctttcattggacnaggagggtccatc

SEQ ID NO: 24671 - DNA, 747 bp, Zea mays
  misc_feature: Ceres CLONE 1395920-F
  misc_feature: Translation starting site: 274
  misc_feature (388)..(388): n is a, c, t, g, unknown, or other
  misc_feature (505)..(505): n is a, c, t, g, unknown, or other
  misc_feature (639)..(639): n is a, c, t, g, unknown, or other
  misc_feature (642)..(642): n is a, c, t, g, unknown, or other
  misc_feature (673)..(673): n is a, c, t, g, unknown, or other
  misc_feature (691)..(691): n is a, c, t, g, unknown, or other
ctggagctccccgcggtggcggccgcttctagaacttagtggatcccccgggctgcaggaattcgcacgagaccatttacctagaacatcctaatcaaaaaaaacaacacacgaacaccgcaccgcaacgtagccggctaggggaagaagctctttccttcagctgtgccgtgcacaacgcacggcacgctggtttggtttgcatcgcccccgccaagaaagacgctgccgtgagcgggctgagcgggcgggaagcagcagcaggcgggcgacatgccgagcggcagcgcgttctccgggtcggtgaacctcaagcacgtcaagctggggtaccagtacctggtgaaccacttcctgacgctgctgctgggtggccggtgatggccgncacgggcgctggagctggcgcgcctcggccccggcgagctgctctcgctgtggcgctccgctggagctggacctggtccacatctcctgctcggcgttcctggtcttcttcgtcggnaccgttgtacgtggatgtcgcggccccaggccggtgttaccctggtggactacgcctgctacaagccccccgccaggctgccgcgtgcccttcgccaccttcatggagcacacgcgcctcatcagcgacgaccnacnagagcgtgcgcttccagaccaggatcctggnagcgctcgggggctcggngaggacacgtgcctcccgcccgccaccactacttcccgccaacccccagcagggaa

SEQ ID NO: 24672 - DNA, 860 bp, Zea mays
  misc_feature: Ceres CLONE 1395922-F
  misc_feature: Translation starting site: 127
  misc_feature: SWISSPROT Homolog: EC 4.3.1.5 Phenylalanine ammonia-lyase
  misc_feature (266)..(266): n is a, c, t, g, unknown, or other
  misc_feature (319)..(319): n is a, c, t, g, unknown, or other
  misc_feature (338)..(338): n is a, c, t, g, unknown, or other
  misc_feature (381)..(381): n is a, c, t, g, unknown, or other
  misc_feature (382)..(382): n is a, c, t, g, unknown, or other
  misc_feature (411)..(411): n is a, c, t, g, unknown, or other
  misc_feature (441)..(441): n is a, c, t, g, unknown, or other
  misc_feature (445)..(445): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (528)..(528): n is a, c, t, g, unknown, or other
  misc_feature (533)..(533): n is a, c, t, g, unknown, or other
  misc_feature (534)..(534): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (563)..(563): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (597)..(597): n is a, c, t, g, unknown, or other
  misc_feature (640)..(640): n is a, c, t, g, unknown, or other
  misc_feature (641)..(641): n is a, c, t, g, unknown, or other
  misc_feature (656)..(656): n is a, c, t, g, unknown, or other
  misc_feature (657)..(657): n is a, c, t, g, unknown, or other
tgtggagtcccgcggtggcggccgctctagaatagtggatccccccggctgcaggaattcgcacgagaccattacctagaacatcctaatcaaaaaacgctcccgtccgaggtttcgcgtgcgggcatgctcgtccgcatcaacaccctcctccaggggtactccggcatccgcttcgagatcctcgaggccatcaccaagctcatcaacaccggcgtcagcccgtgcctgccgctgcggggcaccatcaccgcggcgggcgactnccgtcccgctgtcctacatcgccggcctcatcacggggcgtcccaacgcgagngccggtcacggttgacggncaggaaaggtggacgcccgccgaggcgttccaaggcggccggnncatcggaggggcggcttcttcaagtcaancccccccaaggagggcctggccatcgtcancggnacgggnnncggggggggggggcggcgctcgcccccgccacatgggggtggctttcgagcannnnnngtcctcgccggnnnncntgttnnccgaaggnnncctggtccgcgtctttttnttctttgcggnnnnaagcgggatgaagnnnnagncccgaaagtacggggaacaccctttaccccacaagctcaaggnncccccacccgggggnntcccatccgaagggcctctggcccatcatgggagaaaaaaatccctgggaaggggcggctccctttcatggagccccgccccccggggaggtggaaacgcccatggaacccccctgctgaaaagcccaaaaaaaagggaccggggacgcgggtccgaacaaatttcgccccaaagtggtctcggcccccccccaaaacgaggt

SEQ ID NO: 24673 - DNA, 763 bp, Zea mays
  misc_feature: Ceres CLONE 1395923-F
  misc_feature: Translation starting site: 198
  misc_feature (325)..(325): n is a, c, t, g, unknown, or other
  misc_feature (510)..(510): n is a, c, t, g, unknown, or other
  misc_feature (627)..(627): n is a, c, t, g, unknown, or other
  misc_feature (628)..(628): n is a, c, t, g, unknown, or other
  misc_feature (717)..(717): n is a, c, t, g, unknown, or other
  misc_feature (736)..(736): n is a, c, t, g, unknown, or other
aaagctggagctccccgcggtggcggccgctctagaactagtggatcccccgggctgcaggaattcgcacgagaccattacctagaacatcctaatcgaaaaatcacacactcgactctcctctctcgcatccgcagcctttcgagctctactccaccccctcgatctcgaagcgcagcagcagcagtcaggcggccatggacgcgagcgcagccggagccggcgggaaggcgaagaagggcgcggccgggcgcaaggccggcgggccgaggaagaagtcggtgacgaggtccgtcaaggtcgggctgcagtttcccgtcggcgncatcgggcggaccctgaaagaagggccggtacgcgcagcgcgtcggcacgggcgcccccgtctaccctggccgctcgtcctcgagtacctggcccgccgagatggctaggagctggctcggcaacgctgccaaggacaacaagaagacccgcatcatcccgcgccacgtgctccttgccatccgnaacgacgaggagctcgggcaagctgcctgtccggcgtcaccatcgcccaacggcggcgtcctccccgaacatcaacccggtgctcttgcccaagaaacccgctgaaaaaggcggggnntcaaggaggccaagccggcccaagaaggccgccaagtcccccagaaaagctttaagagggggcgggcgcctttccccgctgaggatgtnaaaatgctcggtgttcagnaagatctttacgtctttagaggggggc

SEQ ID NO: 24674 - DNA, 744 bp, Zea mays
  misc_feature: Ceres CLONE 1395924-F
  misc_feature: Translation starting site: 265
  misc_feature (292)..(292): n is a, c, t, g, unknown, or other
  misc_feature (430)..(430): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (638)..(638): n is a, c, t, g, unknown, or other
  misc_feature (639)..(639): n is a, c, t, g, unknown, or other
  misc_feature (642)..(642): n is a, c, t, g, unknown, or other
  misc_feature (645)..(645): n is a, c, t, g, unknown, or other
  misc_feature (646)..(646): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
tggagctccccgcggtggcggccgctctagaactagtggatcccccgggctgcaggaattcgcacgagaccattacctagaacatcctaatcaaaaatcgctctctcctttgcacccctagctagctagtactactgctgctcctccgacttgctcttcgcgcagcaggacggagaaacaagaaccatccctccccctaccggctaccgctgctactcatggtcgcgcgcactgcctcctggtgccgccgcgtatgatccagacatgaatagggcgcacagcagcagctccnagctcatcaacgagaagctcgtggaacaccggatctccactgcgaagcactgcccccactgcggcgagaaaatcgacagcaaaaccggattggggtggggctgccggcaggcggttcaagttcgatccaactgaccanggagctgatcgagcacctcgaggcgaaagtgaaaggatgaaaggctcgagatctcaccctctccatcgacgagttctaccacaaaaaaatggggggggagggacggcatatgttacacccaccccgagaaactttccaggtggggaacaagggatggcctaagcaagacttcttttcacgggccgtccaggcctaacgacgnnncccnnggnaannaggagaaataccgacccnnnagtggacgtcacaaggggggaaagacgagtggcacagacggaaaacaccgccccccggtgtatgtgacggccccctaa

SEQ ID NO: 24675 - DNA, 743 bp, Zea mays
  misc_feature: Ceres CLONE 1395926-F
  misc_feature: Translation starting site: 172
  misc_feature: SWISSPROT Homolog: EC 4.1.1.19 Arginine decarboxylase
  misc_feature (234)..(234): n is a, c, t, g, unknown, or other
  misc_feature (354)..(354): n is a, c, t, g, unknown, or other
  misc_feature (523)..(523): n is a, c, t, g, unknown, or other
  misc_feature (528)..(528): n is a, c, t, g, unknown, or other
  misc_feature (557)..(557): n is a, c, t, g, unknown, or other
  misc_feature (558)..(558): n is a, c, t, g, unknown, or other
  misc_feature (651)..(651): n is a, c, t, g, unknown, or other
  misc_feature (678)..(678): n is a, c, t, g, unknown, or other
  misc_feature (721)..(721): n is a, c, t, g, unknown, or other
aagctggagctccccgcggtggcggccgctctagaactagtggatcccccgggctgcaggaattcgcacgagaccattacctagaacatcctaatcgaaaaacacaccacagcactaaagtctattcatctctggctccccaaattcagctggagagcactttttcccatcatggataagaactacggtgaactctacaacatcctcggatggggtgaggggtacttcgcgggnaacacggaggggcacctcagcgtgaagcctttcggccgctggacggagcccgggcaggagatcgacgtgcactcggtcatcgtggaagctctagcgacccaacccaacgacagcaccagncaaatctcagttccccatgatccttcgcttccccgacgtgctcaagaaccgtatcgagacgctccataacgcattcaacagcgccatggagtccaccgggtacacgtccaggtacccaaggcgtggttcccgatcaaggtgaaccagaacaagcacgtcgtgcagaaanttggnttaggttcggccagcaatggaactatggnnctcgaggctggctccaagccagaactgctcatcgccatgagctgcctccccgtcaccgaagcgagcccagcccgtacttgatctgcacggcanccaggacgcggactacatcgcgtcggnttctctcggggcgggccatgggcctgaacccatctcgtgctcngaaaaggaggagagcttgcatc

SEQ ID NO: 24676 - DNA, 739 bp, Zea mays
  misc_feature: Ceres CLONE 1395927-F
  misc_feature: Encodes the peptide sequence at SEQ ID NO. 24677
  misc_feature (341)..(341): n is a, c, t, g, unknown, or other
  misc_feature (386)..(386): n is a, c, t, g, unknown, or other
  misc_feature (531)..(531): n is a, c, t, g, unknown, or other
  misc_feature (621)..(621): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (676)..(676): n is a, c, t, g, unknown, or other
  misc_feature (677)..(677): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (683)..(683): n is a, c, t, g, unknown, or other
  misc_feature (684)..(684): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (709)..(709): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
aaagctggagctccccgcggtggcggccgctctagaactagtggatcccccgggctgcaggaattcgcacgagaccattacctagaacatcctaatcgaaaacacataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactagacacatccaatcgtgggcggcggcacggccgggtgcccgctggncgccacgctgtcggagcgcttccgcgtgctgctgctggagcgcgncgcctcgccctacgacgacgaccgcatccgggacatggcccgcttcgcggacacgctgtcggacacctccccgggctcgccgcgcagcgcttcgtgtcgggaggacgggtcatcaatcccggcccggcgggggtttggcggcggnaaattgcttccaccgccggtttctacccgggggccaaggacaacaaaggggggggcgtccggggggaaccgggggggcccccgggggggntaaccgggggggggggagaacgggnnnnntttccccccggaggggggccccgggnnannncnnggnnngggggnnngggcggnnnngnggnnnnnnnnnnnnnnnnnnnngnnnnnct

SEQ ID NO: 24677 - protein, 39 aa, Zea mays
  misc_feature: Ceres CLONE 1395927-F
MSTLLATSFFFVLLCSSLQVRGVNYTFVKDAALAPSVSY

SEQ ID NO: 24678 - DNA, 645 bp, Zea mays
  misc_feature: Ceres CLONE 1395928-F
  misc_feature (104)..(104): n is a, c, t, g, unknown, or other
  misc_feature (291)..(291): n is a, c, t, g, unknown, or other
  misc_feature (297)..(297): n is a, c, t, g, unknown, or other
  misc_feature (298)..(298): n is a, c, t, g, unknown, or other
ggagtccccgcggtggcggccgctctagaactagtggatcccccgggctgcaggaattcgcacgagaccattacctagaacatcctaatcgaaaatagggtttnctcgcgcggcgctccgctccccgccctcctccgctccgcgcccgatcgcctcttcatctacctcctcaaagcttcgactgttccacacccccacccatatcaacccctttccccttttagctccttccaccgatacgcccgccgcgtgaagcattcgttagccgagcccgcgcaaccatgtcgtcgntctggnngtgtggaaagtgaagccccggaaagcccttaccctctcacccatgggggaatttccccgggccggcctgggccttcacccgaggggaaggttgggggtttgtatgcccccaagggggaaaaaaagctaaccggggggaaaaaaagggggggcttaaccggggcagggccccaaaaaaaaaaaacccccttttttttttttggcgccccctggggggaaaagaaaggggaaaaaatgcccccccgggaataataaattttgggggggaaaaaaccccccccccctccaggctggggggccacgagagacaccccccccccccggggggaaaattagaagggggggggg

SEQ ID NO: 24679 - DNA, 795 bp, Zea mays
  misc_feature: Ceres CLONE 1395931-F
  misc_feature: Translation starting site: 264
  misc_feature (200)..(200): n is a, c, t, g, unknown, or other
  misc_feature (268)..(268): n is a, c, t, g, unknown, or other
  misc_feature (276)..(276): n is a, c, t, g, unknown, or other
  misc_feature (289)..(289): n is a, c, t, g, unknown, or other
  misc_feature (290)..(290): n is a, c, t, g, unknown, or other
  misc_feature (324)..(324): n is a, c, t, g, unknown, or other
  misc_feature (721)..(721): n is a, c, t, g, unknown, or other
  misc_feature (722)..(722): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (765)..(765): n is a, c, t, g, unknown, or other
  misc_feature (792)..(792): n is a, c, t, g, unknown, or other
aagctggagctccccgcggtggcggccgctctagaactagtggatcccccgggctgcaggaattcgcacgagaccattacctagaacatcctaatcgaaaaatctctctcgctttctctagccatgacgctggtgaggatgccttgccgcctctgctgcttcctgctcgtcgtcgccgcctccgccgtctccgggcgggnggcgggtggtcaccaccctcccgggctacgagggccgcctccccttccacctcgaaacagggtatgtnggaggtgnacgaggacgccgnngcggagctcttctactacttcggtcgggccgagntcggcgccgacgacggcgaccccccgttcgtcctccggatccccgggggccaagctgctcccgcttcaggggcctccgctaagaaataggaggcccttcatggttggcggggaagccctaaaaggggggtttggcgggcccgttaaaaaccaaattcggggaaaagggggggcgaattctttttgggggatcccaaggggggggcggggttttccttctcccgaaggggccaagggtaaaacggttgggggggtacccccacagggggttgtgggaaaattctcccacagggggttaaagagacccccccgggacaaggggaaacctttttttattggggggggaaaacaccgccggggaaaatttcctctccttcgcggaaatgtttcagagaggnntgagagnnnnaaggnnnncccccccccccccggggggtttttnaatggggggggcgccctcttttttttntct

SEQ ID NO: 24680 - DNA, 743 bp, Zea mays
  misc_feature: Ceres CLONE 1395932-F
  misc_feature: Translation starting site: 157
  misc_feature (735)..(735): n is a, c, t, g, unknown, or other
aaagctggagctccccgcggtggcggccgctctagaactagtggatcccccgggctgcaggaattcgcacgagaccattacctagaacatcctaatcgaaaaaattcctgtctgtgcgcgcgcgcgcgtggcgccggccgagcggccgttgacccgatgaccggcgcggcggccgtcgatcccccggtgcctcggccgcggcggctcacggtcctcccgctcatcgcgctcatcttctacgacgtctcgggaggccccttcgcatcgaggactcggtccgcacgggcggcggcgcgctgctcccgatccttggcttcatcgtcctcccagtcctctgggcgctcccggaggcgctggtcacggccgagctcgcatcggctgtccccacaacgacgtgtacgtggtctgggtgtccgccgcttccgcccggccgggtggttctcggcgggttttccaggggccgtcttggagactcaataccggtttccctggggttggggctcactactctgctccgggggcttttttggtgcccaaactgacttttggtggattttaaagggccagggagctttcgtttgcttttgggccgggggcccctaacttggggacttggggcttgaggttccccggggtctgggaggcctttcccagagaaaaggggttgcgggcacaaggattttccccggaccctctgttggtatgtctttcacaaaggggcctcttttttttccnccccataa

SEQ ID NO: 24681 - DNA, 762 bp, Zea mays
  misc_feature: Ceres CLONE 1395934-F
  misc_feature (330)..(330): n is a, c, t, g, unknown, or other
  misc_feature (379)..(379): n is a, c, t, g, unknown, or other
  misc_feature (405)..(405): n is a, c, t, g, unknown, or other
  misc_feature (406)..(406): n is a, c, t, g, unknown, or other
  misc_feature (477)..(477): n is a, c, t, g, unknown, or other
  misc_feature (484)..(484): n is a, c, t, g, unknown, or other
  misc_feature (490)..(490): n is a, c, t, g, unknown, or other
  misc_feature (501)..(501): n is a, c, t, g, unknown, or other
  misc_feature (502)..(502): n is a, c, t, g, unknown, or other
catagctggagctccccgcggtggcggccgctctagaactagtggatcccccgggctgcaggaattcgcacgagaccattacctagaacatcctaatcgaaaaattccaaaagctctcgagacttcctcagcaatcaatcagctttccagcgatcggcagctcctcgatcgtttcgaagctccaatccgcccggccgcctccgcctgttgccactagctaggtgatcgatcgaatggactgcggtggctcgctgcagctcccgcctgggttccgcttccaccccaccgatgacgagctggtgatgtactatctcctccgcaagtggcggnggcctgccgctcgccgcgccggtcatcgccgaggtggatctctacaagntcgacccatggcagctcccagagaanngcgtcggtggggaagaaaggagtggtactttctttctcgcgcgcgaccgcaagtacccgaatgggtccagnctaaccnggcggncgggaacgggnnaaattggaaggccaccggggccaaaaaaccggaagggtcccccggcccccgggcccatcaaaaaggggtcggttttcaagcccggaaagcccccaagggcgccaaaacaaatgggattttggcaaaaaccccccctcgggaaaaaaaaccgtttgggcgcccaaaaaaaaaaaaaaaaacaccctccgggtggaaaaaagggggggtgccccaaacccaaaaaaaagggtgtttttggggggcaaaacgggggagaaacc

SEQ ID NO: 24682 - DNA, 711 bp, Zea mays
  misc_feature: Ceres CLONE 1395935-F
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (464)..(464): n is a, c, t, g, unknown, or other
aaagctggagctccccgcggtggcggccgctctagaactagtggatcccccgggctgcaggaattcgcacgagaccattacctagaacatcctaatcgaaaaatgtcataccccggctcctctgcttctcggttcccgccgttccatgtccgccacaaggtgcccgccacaagggcagaccggcggcagaggttgtaccgatcgctctggcccacgtcgccggccggaccatcaaccaccgcgcggagcatcaagcagctgccattccaaagcccgttgaagcatcgaaggatttccagccgtgagcgtgtgcggtggcggcgcggccgtctcgccgggatgggcaagatgaactgcttctccggactgctcagcggcaagagcaaggcattcaagggtggcaacaagggcgcttaaccnnnnccccaaaagaaggcggccagtggtgggcacgattgccccanggtgaagccggtagagttcgtagacatggcgggcactgctgtcgacgacttcgtcgggagacgcgggggaaggagcgttcttgcgcccaatgcagaaatagcttttgcgttcagaaacaccgaagttgcagccttgccctgccaaaaaggtgaaaaccagccccggttaaaaggaacatccccccccggggtttgttcccccgataaccattttggcccagtccccaggggtccccaaagtgaaccc

SEQ ID NO: 24683 - DNA, 719 bp, Zea mays
  misc_feature: Ceres CLONE 1395936-F
  misc_feature (280)..(280): n is a, c, t, g, unknown, or other
aaagctggagctccccgcggtggcggccgctctagaactagtggatcccccgggctgcaggaattcgcacgagaccattacctagaacatccgaatcgaaaaatcgcagaaattctccgcaacttcacagcgtatcatcgttttccatcgctcctactcctatcatccagaaaatctgagcggtattgatggcgcccaaggcggagaagaagccggcggcgaagaaggtggcggaggaggagccctcggagaaggcggctccggcggagaaggcccccgncggggaagaaggccaaggcggagaagcggctacctgcgggcaagtccgccggcaaggagggcggccgacaagaaggggaggaagaaggcgaagaagagcgtggagacctacaagatctacatcttcaaggtctccgttctcccccaattcgccttcacctcgccgcttcctccttgccgcaccggttgacgtcgtctttccggcgaggtagctcgccggaagacctcacctggacttttccgacgcaccctccacacactctttacccctccggaatggccgcctgcttctagctcgtcgaagccccaatctccgcttgcttcctcgacagcccatccgcttcttctcgtctcgctacggctcctctgcctgttcgccatggcgatccgaaccccgtctcctactccggctacggggggagaacccgccccgcactggg

SEQ ID NO: 24684 - DNA, 562 bp, Zea mays
  misc_feature: Ceres CLONE 1395937-F
  misc_feature (116)..(116): n is a, c, t, g, unknown, or other
  misc_feature (123)..(123): n is a, c, t, g, unknown, or other
aaagctggagctccaccgcggtggcggccgctctagaactagtggatcccccgggctgcaggaattcgcacgagaccattacctagaacatcctaatcgaaaaacagccagacggntctcgangctggatctctaccgttcgtccgttccagcagacagcagtgcgcgctctctctctccctcgtggcgacgactgggcgaccgctgccgctgcccttgtgccccggtctccgtcggtcccgtcgcccagtctcctgcgggctcttttgtcgtcgacagctcccgcagtttgctgggtggaagtccagggttggcccatgggattccgcaccagattttccaacccagggactttcccaaaaaggtttggggccccccaggggaaaacccccgggtttttgtttttgtaaaaaggaaggaaaaaaaatttgtggcccaaagagcccttttttttccccaaaaaaaaacccctttttgggaaaaaaaaaagggcctttctggaaaagacaaaaaaccgggggaaaaaatttttttcttttccccttggagggggaaagaaaaa

SEQ ID NO: 24685 - DNA, 767 bp, Zea mays
  misc_feature: Ceres CLONE 1395939-F
  misc_feature: Encodes the peptide sequence at SEQ ID NO. 24686
  misc_feature (430)..(430): n is a, c, t, g, unknown, or other
  misc_feature (431)..(431): n is a, c, t, g, unknown, or other
  misc_feature (539)..(539): n is a, c, t, g, unknown, or other
  misc_feature (584)..(584): n is a, c, t, g, unknown, or other
acaagctggagctccccgcggtggcggccgctcttgaactagtggatcccccgggcttgcaggaattcgcacgaagaaccatttcctaagaacattcctaatcgaaaaattttcgatcccagccccaggccatggcgacgaggtggaggaggtcgctgctctgggtcgccgtcgtccagttcctgaccctgtgcgtcgccgagcatctcgtagtggaagcatacaaaaagtcctacattgtgtatctgggatcacatgcatatggccgtgatgcgtcggcggaggagcatgctcgcgcaacccagtctcaccaccacctcctggcatcgatcctcggcggcgacgacgaccaccaccatgagacgggcgcggcagtccatcttctactcctacaccaagagcagcatcaatggcttcgcgcgcacctggnnaggagtcggtcgcgcagcagatcgcgagcaccctgagggtgggtggcggtgctggagagcaagatgctcaagctgcacaccacgcggtcctgggacttcatggaccgnaagcgccgacggtcacgtcctccctggctccatctggaaccacgnctaggttcgggacaggacgtcatcatcgccatctcgaaaaggcggagtgtggcccgagtccacagcttccaagacgacggcggccaatgccgctttcgctggaagggcttctgtcagaacaccgttttagtaacggtgtccgcctgcaccgcaactcattcggggctaggttcttcacaaaga

SEQ ID NO: 24686 - protein, 111 aa, Zea mays
  misc_feature: Ceres CLONE 1395939-F
  misc_feature (100)..(100): Xaa is any aa, unknown, or other
MATRWRRSLLWVAVVQFLTLCVAEHLVVEAYKKSYIVYLGSHAYGRDASAEEHARATQSHHHLLASILGGDDDHHHETGAAVHLLLLHQEQHQWLRAHLXRSRSRSRSRAP

SEQ ID NO: 24687 - DNA, 757 bp, Zea mays
  misc_feature: Ceres CLONE 1395941-F
  misc_feature: Translation starting site: 252
  misc_feature (334)..(334): n is a, c, t, g, unknown, or other
  misc_feature (337)..(337): n is a, c, t, g, unknown, or other
  misc_feature (349)..(349): n is a, c, t, g, unknown, or other
  misc_feature (351)..(351): n is a, c, t, g, unknown, or other
  misc_feature (354)..(354): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (398)..(398): n is a, c, t, g, unknown, or other
  misc_feature (410)..(410): n is a, c, t, g, unknown, or other
  misc_feature (424)..(424): n is a, c, t, g, unknown, or other
  misc_feature (429)..(429): n is a, c, t, g, unknown, or other
  misc_feature (438)..(438): n is a, c, t, g, unknown, or other
  misc_feature (439)..(439): n is a, c, t, g, unknown, or other
caaagctggagctccccgcggtggcggccgctctagaactagtggatcccccgggctgcaggaattcgcacgagaccattacctgaacatcctaatcgaaaaacgaaatggttttgccttcgcttttgcttatgcgtacgcgcggcgaatcacggcgcccaccttccaaccggacttgagtcacttgactccgccgcgggattccccgccagatctcattctcgccccaaccctaaccgccgacggtggccatgatggccaccgagcccttgtccccggggaatctcgtcgaggacgtcgaaacactaaccctggactcctccctcactctcgnggntacgagggaccngntgntcnnngccactccccccctcgtcaccttctctcccaccgccggntgagaacatggncgcttttctgaacnagagnatgaagacnntggtgaatgacttcacgcctcgttgggttcccatggccgtacgcccgggaagaaatcccgggaggggaccccggggttccctgaaatccttggccccgagcctaagaaacacccgaaccccggaccggagcccgggggtttattcccgggtggggaagttagtcccccacctaccccccactagggggcccaaaggagggatttccccgggggggggaaatccggggaggcggggcgccccccaacccctccggaaaacaccgaggtttttttgagggggcgggcccaaaaaaaattttcggggggggctgtgtgggg

SEQ ID NO: 24688 - DNA, 758 bp, Zea mays
  misc_feature: Ceres CLONE 1395944-F
  misc_feature: Encodes the peptide sequence at SEQ ID NO. 24689
  misc_feature (447)..(447): n is a, c, t, g, unknown, or other
  misc_feature (448)..(448): n is a, c, t, g, unknown, or other
  misc_feature (505)..(505): n is a, c, t, g, unknown, or other
  misc_feature (538)..(538): n is a, c, t, g, unknown, or other
  misc_feature (541)..(541): n is a, c, t, g, unknown, or other
  misc_feature (589)..(589): n is a, c, t, g, unknown, or other
  misc_feature (590)..(590): n is a, c, t, g, unknown, or other
  misc_feature (627)..(627): n is a, c, t, g, unknown, or other
  misc_feature (653)..(653): n is a, c, t, g, unknown, or other
  misc_feature (654)..(654): n is a, c, t, g, unknown, or other
  misc_feature (659)..(659): n is a, c, t, g, unknown, or other
  misc_feature (660)..(660): n is a, c, t, g, unknown, or other
  misc_feature (673)..(673): n is a, c, t, g, unknown, or other
  misc_feature (730)..(730): n is a, c, t, g, unknown, or other
  misc_feature (731)..(731): n is a, c, t, g, unknown, or other
caaagctggagctccccgcggtggcggccgctctagaactagtggatcccccgggctgcaggaattcgcacgagaccattacctagaacatcctaatcgaaaaactaggaaaaacctagacacgaagtccaacccaaatctcaatatcccaaccctccgatccccatttccatccactccgacaccaatcctccgctccgaccaccgccggagaaatggggcggcgccgccggttcgcgcagctggacgatgacgacgacgacgacgaagacgtgcccatcaatttcaagccctcgggtggcgcctcctcctcggacgccaaacccaggaagccccagccgccgccgcagcagcgccgcggagtctccgatgacgacgacgaggacgtggaggaagtgggaacttgaggaggaggaggacgacgagaaggatctcgaggcaatgccnnacgggccgaggaggaggagcgccgcgagcagaaggccgagacgaagactcgccgccngccggggacggcccaagcgccgccgcgacccgntgnagcgaggatgaggagcccgaggagctagagctgcaaacggaggatccnncgtgaggagggagatcacggaggcgtgggcccgtaanctgtagggacccggtcagatcacggnncaggnngaagaagcagaangagcactatgcttcccttcgagtacgagggcaacaggcttcgagctgggaggacccnngtgctcttcacgcctgaggacagcatc

SEQ ID NO: 24689 - protein, 63 aa, Zea mays
  misc_feature: Ceres CLONE 1395944-F
MGRRRRFAQLDDDDDDDEDVPINFKPSGGASSSDAKPRKPQPPPQQRRGVSDDDDEDVEEVGT

SEQ ID NO: 24690 - DNA, 730 bp, Zea mays
  misc_feature: Ceres CLONE 1395946-F
  misc_feature: Encodes the peptide sequence at SEQ ID NO. 24691
  misc_feature (541)..(541): n is a, c, t, g, unknown, or other
  misc_feature (649)..(649): n is a, c, t, g, unknown, or other
  misc_feature (650)..(650): n is a, c, t, g, unknown, or other
aaagctggagctccccgcggtggcggccgctctagaactagtggatcccccgggctgcaggaattcgcacgagaccattacctagaacatcctaatcgaaaaaaaaagaaaaaaaaatagcaaatttctcggcttccgccacacccgctccagggcccctcccccaaactgaaacgaagttgcggcggtcgcgactgagtgcagaggctgcagttcccggcgctgatgcggcagtggccatcgccgccgctgatcccggcgtccacgctgctccccgtgccggccacctcccaggaggacgagcttctcctctccatggccgagtccgacctcgaggataagctgaacgagatccggaagaccaacagccacctggttatcatcgggaagcccacgggcgacaccaaggaggagtacgacgctgacgtggaggacgacgatgcagacaacgtcgaggagtctgacggcgacgacttcgaccaggcagaccggttgacccaggtggctcccccgtggcttcgtcggcgtccttgagcgtcgncatccccgctgtccagtctgtatttcgcaatccctgagttgctccttctatttagatacgctgttaccctattttggctgctgtctgttctcaggatctgagcatgtnncttgtcgtgtggaccttgtgtatgaaacaagtacatgattaatcggtccaatttaaatggctatattagtttcttcaaaa

SEQ ID NO: 24691 - protein, 102 aa, Zea mays
  misc_feature: Ceres CLONE 1395946-F
MRQWPSPPLIPASTLLPVPATSQEDELLLSMAESDLEDKLNEIRKTNSHLVIIGKPTGDTKEEYDADVEDDDADNVEESDGDDFDQADRLTQVAPPWLRRRP

SEQ ID NO: 24692 - DNA, 746 bp, Zea mays
  misc_feature: Ceres CLONE 1395950-F
  misc_feature: Encodes the peptide sequence at SEQ ID NO. 24693
  misc_feature (407)..(407): n is a, c, t, g, unknown, or other
  misc_feature (410)..(410): n is a, c, t, g, unknown, or other
  misc_feature (487)..(487): n is a, c, t, g, unknown, or other
caaagctggagctccccgcggtggcggccgctctagaactagtggatcccccgggctgcaggaattcgcacgagaccattacctagaacatcctaatcgaaaaatatgactctctccctagtccctacactttctcccccgtgtcccgttgctaaaagcttagagaaaaacctaatcggacagcactgtggccaagcagggcgcgggagatcgtacgccggcggcgaggtcctgcggtggcgggcctcggcagagtggtggtgctagcggagtgcagctgttgggttggtgggtaagagtgagaaggacatgaaggcgctgcggcgatccagcacctcgtcctcgccgacgggcgcgtcctcccctccgtcctcatcgtggatccacatccggtcgctcctcgccgncgncgcgtcctcgtcctcgtcctcctccttcgcagcggctgcggctgggagcgcggtggctgtgggtgtgccccttgggngggccgcctcggcttcttcctcgggcggggtcgtcctcgccgcactcggaaggggggtggtcctaaatcttcatgggccccggaggaaaagaaacgagcactttctcgtgaacagtgggaaaagttttgtttcagcaaatgggaagcttcctgatggtgggaaagaaagttcttcagaaaagttccgaagggtggcattgaaacaagctttaaggcgttgaagtttgccccttcctactaggaggctatgatttgaata

SEQ ID NO: 24693 - protein, 132 aa, Zea mays
  misc_feature: Ceres CLONE 1395950-F
  misc_feature (33)..(33): Xaa is any aa, unknown, or other
  misc_feature (34)..(34): Xaa is any aa, unknown, or other
  misc_feature (60)..(60): Xaa is any aa, unknown, or other
MKALRRSSTSSSPTGASSPPSSSWIHIRSLLAXXASSSSSSSFAAAAAGSAVAVGVPLGXAASASSSGGVVLAALGRGVVLNLHGPRRKRNEHFLVNSGKSFVSANGKLPDGGKESSSEKFRRVALKQALRR

SEQ ID NO: 24694 - DNA, 756 bp, Zea mays
  misc_feature: Ceres CLONE 1395957-F
  misc_feature: Encodes the peptide sequence at SEQ ID NO. 24695
  misc_feature (151)..(151): n is a, c, t, g, unknown, or other
  misc_feature (249)..(249): n is a, c, t, g, unknown, or other
  misc_feature (301)..(301): n is a, c, t, g, unknown, or other
  misc_feature (304)..(304): n is a, c, t, g, unknown, or other
  misc_feature (398)..(398): n is a, c, t, g, unknown, or other
  misc_feature (421)..(421): n is a, c, t, g, unknown, or other
  misc_feature (467)..(467): n is a, c, t, g, unknown, or other
  misc_feature (564)..(564): n is a, c, t, g, unknown, or other
  misc_feature (616)..(616): n is a, c, t, g, unknown, or other
  misc_feature (742)..(742): n is a, c, t, g, unknown, or other
aaaagctgggagcttccccgcggtggcggccgctctagaactagtggatcccccgggctgcaggaattcgcacgagaccattacctagaacatcctaatcaaaaaaaaaaacatcactccctcgcgaaccccaagaactgcagcgacggcnatgcgatggcggcggagggcgcggcgagcgagccagaagctggtgtcgatcccggcgacgccgcacggtctgtcgacgccggagggcgcggccaccgnaccggagcgggcggggggcggcggcggcaggagcaagggctccgggaccccnggncgtcgcggtgggtggagggcctgcgcgggtacctgggaggacgtgggccacctcacgcgcctcgacccgcgcgacgcctggctgcccgtcaccngagagccgcggcggcaacgcccngctacgccgctttccactccctcaacgccggcctcggcttccaggnacttctcctcccgctcgccttccgggacctcgggctggagctggggggataatttcattgactattggcttatttctggcaactgtacacactgtgnatcctagtggagctttcatgaggctgtgcccaggcaggagttaccacagatnatgttgagcttgcacaggcagcatttggagaaaaatgggaaatggggttggctcttttcccaattatttatctctcggcaggcactgcactgcatggatccttgggtgggcgggaaaccccatganctgttcttcccaaa

SEQ ID NO: 24695 - protein, 120 aa, Zea mays
  misc_feature: Ceres CLONE 1395957-F
  misc_feature (49)..(49): Xaa is any aa, unknown, or other
  misc_feature (50)..(50): Xaa is any aa, unknown, or other
  misc_feature (81)..(81): Xaa is any aa, unknown, or other
  misc_feature (89)..(89): Xaa is any aa, unknown, or other
  misc_feature (104)..(104): Xaa is any aa, unknown, or other
MAAEGAASEPEAGVDPGDAARSVDAGGRGHRTGAGGGRRRQEQGLRDPXXSRWVEGLRGYLGGRGPPHAPRPARRLAARHXRAAAATPXYAAFHSLNAGLGFQXLLLPLAFRDLGLELGG

SEQ ID NO: 24696 - DNA, 755 bp, Zea mays
  misc_feature: Ceres CLONE 1395963-F
  misc_feature (674)..(674): n is a, c, t, g, unknown, or other
  misc_feature (709)..(709): n is a, c, t, g, unknown, or other
  misc_feature (729)..(729): n is a, c, t, g, unknown, or other
  misc_feature (730)..(730): n is a, c, t, g, unknown, or other
aaagctggagctccccgcggtggcggccgctctagaactagtggatcccccgggctgcaggaattcgcacgagaccattacctagaacatcctaatcgaaaaaaccaacatatctactctactctatctcaagagcgctagacgccgcaatagcatgcgcaccacccaccgagcggcggcggcggctgggcaatccacaaagagaagaggacgtgcgcggacgtctggtcgcgatgttggacggcggcctcgccttgatcctcctgctcctggtgagggtcaggacggcgcccgaggtgaagtccccgaaagaagacagattgccagctaacggttccggcgtctatctgggcaccgattggcggactgaatgactactcagggttgccgcccttgttgctccctcgatagacgaacgtgcggccactagccggatacaggagcgaccctgcctcgtgttcatcaacgatcgaccgagcgccgatcgtccaggaacgatgccgagactcgaggactcgatgggtctcggagacctgcccaaggtgagtattagcagactcggcgcgattctctgtcgctgtgcagctcggaggtcatcgaccagacgatgacgaccacagctagtgtcaaatacgtgagcagctcctgcaacaatgccagccctcaagatgagnattccatcatgccagcaactcctcctatccctggntacccgcagtggcgccaggnncgcgatccatcacgcgatggcatgg

SEQ ID NO: 24697 - DNA, 728 bp, Zea mays
  misc_feature: Ceres CLONE 1395966-F
  misc_feature (437)..(437): n is a, c, t, g, unknown, or other
  misc_feature (541)..(541): n is a, c, t, g, unknown, or other
  misc_feature (600)..(600): n is a, c, t, g, unknown, or other
caaagctggagctccaccgcggtggcggccgctctagaactagtggatcccccgggctgcaggaattcgcacgagaccattacctagaacatcctaatcaaaaagatctacctgtctgttcttcgatcgagtctgagagatttgggaggaggagggaaacaaagcgaaagagcccatcttttttgtctttttggttcggtttcgtggttgcttcttttggaccccgcggaggagcccaccgtttctacaaaaacccaatctttgctgccttctcagcggtcgagatcgataggtttccagatctgaggctccgtgttctggctgtgagatcggaggcgcagcaatccgagcacgcagctagtagggaaagtatccgagaaaagttgcagattttgctgggggcaacggagcgagaacaagttactgcagaaggaaangggcaaaggtgggggaggcgcccggagatgagggatgctatcagctctgatggattatttgaaatcttggctcgggtccggcatcacccggctgggcgtccccngcaaaggatcggatgccaccggcccgccaggacggggctcctgtggtacaaggacggcnggcagggtcgtccgatggtgagtcctccaatggccgtggtccaggccaataaccctattggaggaccatagccaggttgaatccgggccgcttagcacatcggagcctggactgaaggcacccttcgt

SEQ ID NO: 24698 - DNA, 763 bp, Zea mays
  misc_feature: Ceres CLONE 1395968-F
  misc_feature: Encodes the peptide sequence at SEQ ID NO. 24699
  misc_feature (571)..(571): n is a, c, t, g, unknown, or other
  misc_feature (607)..(607): n is a, c, t, g, unknown, or other
  misc_feature (737)..(737): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
caaagctggagctccccgcggtggcggccgctctagaactagtggatcccccgggctgcaggaattcgcacgagaccattacctagaacatcctaatcgaaaaatgaccgactagcccatgttctctctccgctccgacgcgcccgacccaccaccacatccctcatggctgccctcgccgacatcgactcctcggcacttccgccgtccgagtcatccaaaggcaaggcaagatggacgaggaggaggaggacgaggcgcagggcgcggagaagatgtgcgtgatctgctatctcgactgccggagcgccatccgcgacgagctcgactgctgcgcccatttcttttgctttgtctgcatcatggcttggggccgcgtgaagtcccgctgtcccttctgcagggcccgcttccacaccatccgccgcccgcccgtcgccggccggttccccgacgagcgaatcgtctcgatccaagagcgcaaccaggtacaccatcctcagggcaacgggagcagcatagttgggcggagatccttacgtgaaacatattgcgcacggtttgcagcagntcccagcgatgacgagctgctgctactctgcgagcntctgcgactcagctgcacacactttactggtgtcgggctgaggaccccgtgcaagaagggggactggttctgcaaggaatgcgggaacgatcagagatgatcaattgagatggcaggctgagaatcaggnttgatttgagnnntcagcatggatgt

SEQ ID NO: 24699 - protein, 157 aa, Zea mays
  misc_feature: Ceres CLONE 1395968-F
  misc_feature (113)..(113): Xaa is any aa, unknown, or other
  misc_feature (125)..(125): Xaa is any aa, unknown, or other
MDEEEEDEAQGAEKMCVICYLDCRSAIRDELDCCAHFFCFVCIMAWGRVKSRCPFCRARFHTIRRPPVAGRFPDERIVSIQERNQVHHPQGNGSSIVGRRSLRETYCARFAAXPSDDELLLLCEXLRLSCTHFTGVGLRTPCKKGDWFCKECGNDQR

SEQ ID NO: 24700 - DNA, 794 bp, Zea mays
  misc_feature: Ceres CLONE 1395969-F
  misc_feature (317)..(317): n is a, c, t, g, unknown, or other
  misc_feature (364)..(364): n is a, c, t, g, unknown, or other
  misc_feature (408)..(408): n is a, c, t, g, unknown, or other
caaagctggagctcaccgcggtggcggccgctctagaactagtggatcccccgggctgcaggaattcgcacgagaccattacctagaacatcctaatcgaaaagcaaattgcgcgtctcctccgcccttaatcctgacaaaaggaaaaacgcgaagcagagctcccttccctcctctctcctcttcttcttcgtcgtggtgttggtgtggggcatctcgcaccccacccatccctgtcctcccgctcgccggtgcgcgcgcttttctagggtttccgctgccccagccgccaatcccgctcacctctcgtcaccggngatggcgtcgggcgtcggtgtccggccccggtggcaggggcaggggnccgggggcgggaaaggacgaggagctcgcccgatctgggtgcgncgccctcatggacgccctcgctttcgctacgctgatcgcctgccctttcgacctttgattcgccaaaaacttcgtttcactactaacacttggctgcgatctcgattaacaacttctgtttgcctggaaaaatgggtgaaaggctcttcaagagcaaccttcggaaggccttcgaaaggaaaagttggccccatccttttagcaaaccccggcctttaatttcgggccagggggtttttaaccggtaaacaaagtgtttgtgttccttcgggatttttaaagacccccgaagggggcccccccctttttttccccccaaaaaatttttttcttttgaaggttgtgtgaggaaaaaattaaaaagagggggggagtttcattgccct

SEQ ID NO: 24701 - DNA, 735 bp, Zea mays
  misc_feature: Ceres CLONE 1395972-F
  misc_feature: Encodes the peptide sequence at SEQ ID NO. 24702
  misc_feature (1)..(1): n is a, c, t, g, unknown, or other
  misc_feature (445)..(445): n is a, c, t, g, unknown, or other
  misc_feature (499)..(499): n is a, c, t, g, unknown, or other
  misc_feature (579)..(579): n is a, c, t, g, unknown, or other
  misc_feature (653)..(653): n is a, c, t, g, unknown, or other
  misc_feature (678)..(678): n is a, c, t, g, unknown, or other
  misc_feature (686)..(686): n is a, c, t, g, unknown, or other
naaagctggagctccccgcggtggcggccgctctagaactagtggatcccccgggctgcaggaattcgcacgagaccattacctagaacatcctaatcaaaaagtgctgcatagccctacatgcatcgatccctagctctttgcttgccgcggatttctcctgctcatacaacacaagccatgaggggtttccagctgctactcatcatagtggcattgcttgccggcgagttgcactgcgcaagagcagcatcagcagcagatgcaccggaggctgcaccacagtcccccgaagcaccaacagcagatgagcaaacgccaccgcaggcgcctgggccaacatcaccacctccacctccacgacgtcggggatcaccacatcgacggtcaccagcaccgacggatcaacaggatccagcaccgccaaggttggtcgtgccaccancaggaacctcctgcaccggcctcacctgtaatgacgatcaaccgcactacgagnctgtactacactcctttgtacttgaagactcaaccgtggaccctggaaaacaacaaccatctgcccaccacagccagggncaaatttcttgccctacggcttgaacttcttacggtcgcagggcgactggctgatcaccaaaatggccggtagncacaaaatttttagctggaaaactnagcatatncggattatttcccccggtttctttgaccaaaatctgagtgcccagcccc

SEQ ID NO: 24702 - protein, 160 aa, Zea mays
  misc_feature: Ceres CLONE 1395972-F
  misc_feature (109)..(109): Xaa is any aa, unknown, or other
  misc_feature (127)..(127): Xaa is any aa, unknown, or other
MHRSLALCLPRISPAHTTQAMRGFQLLLIIVALLAGELHCARAASAADAPEAAPQSPEAPTADEQTPPQAPGPTSPPPPPRRRGSPHRRSPAPTDQQDPAPPRLVVPPXGTSCTGLTCNDDQPHYEXVLHSFVLEDSTVDPGKQQPSAHHSQGQISCPTA

SEQ ID NO: 24703 - DNA, 760 bp, Zea mays
  misc_feature: Ceres CLONE 1395973-F
  misc_feature: Encodes the peptide sequence at SEQ ID NO. 24704
  misc_feature (270)..(270): n is a, c, t, g, unknown, or other
  misc_feature (327)..(327): n is a, c, t, g, unknown, or other
  misc_feature (373)..(373): n is a, c, t, g, unknown, or other
  misc_feature (476)..(476): n is a, c, t, g, unknown, or other
  misc_feature (606)..(606): n is a, c, t, g, unknown, or other
  misc_feature (654)..(654): n is a, c, t, g, unknown, or other
  misc_feature (660)..(660): n is a, c, t, g, unknown, or other
  misc_feature (663)..(663): n is a, c, t, g, unknown, or other
  misc_feature (664)..(664): n is a, c, t, g, unknown, or other
  misc_feature (667)..(667): n is a, c, t, g, unknown, or other
  misc_feature (673)..(673): n is a, c, t, g, unknown, or other
  misc_feature (674)..(674): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (700)..(700): n is a, c, t, g, unknown, or other
  misc_feature (701)..(701): n is a, c, t, g, unknown, or other
  misc_feature (704)..(704): n is a, c, t, g, unknown, or other
  misc_feature (705)..(705): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (728)..(728): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (751)..(751): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
aaaagctgggagctccccgcggtgggcggccgctctagaactagtgggatcccccgggctgcaggaattcgcacgagaaccattacctaaaacatcctaatcgaaaaacatcatcacactcgaaacccaacagcttccttcctggcgatccaattaacggcttctcttctgagctcaggacgaacaatggccaccatcctcaccgtcgcaagcttcttcgcacttgtgtgcatctctcaacaagcgcgggctgcgaactacacgttatgnaaggacgcggtgcacgcgccgcggacgggcttctacgactacatcatagtcggcgcngggcacggcgggactgtcccgctggcggcctaccctgatcggccgncgcagcgggtgctgctgctaggaagtcgcgaagctcttccgcacgatggacgcgcgcgatcctgaacatggcccacttttctcggacagtgctggcgaacacngtccgagcgtcgtccccggtcgccagcggttcggtgtcggaggggacggcgtgatcaactccccgcccgcgcgtggctgggcggcggcagctgcatcaacgccggcttcttcacgcgcggccggcgcggnctacgtcagggccgccggctgggaccccagggaaagggcgggcgggcnaacggnggnnggnaacacnngnnnnnnnncccccggnnnngggccnnggnnggccccccnnnnngggnnnnggnggaaaannnnnnncnnnnnaaanggnnnccgg

SEQ ID NO: 24704 - protein, 83 aa, Zea mays
  misc_feature: Ceres CLONE 1395973-F
  misc_feature (28)..(28): Xaa is any aa, unknown, or other
  misc_feature (63)..(63): Xaa is any aa, unknown, or other
MATILTVASFFALVCISQQARAANYTLXKDAVHAPRTGFYDYIIVGAGHGGTVPLAAYPDRPXQRVLLLGSREALPHDGRARS

SEQ ID NO: 24705 - DNA, 754 bp, Zea mays
  misc_feature: Ceres CLONE 1395976-F
  misc_feature: Encodes the peptide sequence at SEQ ID NO. 24706
  misc_feature (436)..(436): n is a, c, t, g, unknown, or other
  misc_feature (489)..(489): n is a, c, t, g, unknown, or other
  misc_feature (496)..(496): n is a, c, t, g, unknown, or other
  misc_feature (510)..(510): n is a, c, t, g, unknown, or other
  misc_feature (526)..(526): n is a, c, t, g, unknown, or other
  misc_feature (532)..(532): n is a, c, t, g, unknown, or other
  misc_feature (537)..(537): n is a, c, t, g, unknown, or other
  misc_feature (538)..(538): n is a, c, t, g, unknown, or other
  misc_feature (565)..(565): n is a, c, t, g, unknown, or other
acaagctggagctccccgcggtggcggccgctctagaactagtggatcccccgggctgcaggaattcgcacgagaccattacctagaacatcctaatcgaaaaaggctcctctcccccgttgcgcaacgcgctttcccccacttcacccgcctcggcgccatggctaagctcgcgctggcgctcctcctcctgctggccgtggcggcgtccgcgtcggccagcagcgggagccacctggatctcgacctgggcttcctctcctctggggaacgccggagggagtgccgcggcacggtggccgagtgcctcgccgaggagcggaatgaggagggccttggacctggccggatcccaccgccgcgcgctcttacggcggcgggacatcaagctacggcgcggctgcggcgggacaacgtgccctgctccccgccgcgncgccagctactaacactgcccggcccggggcggccaggccaaacccctaccanccgcggntggctcccgcatcnaccgctgtgccggggnttgaangcggnntccggattccgcccgactggccgaggnaaaagggcctgggtttggtcaaaggtccccggtcctttttcgccgaacaataattttctttccccttgtgttgggttcagggcgcttaccgccaccgggcccttggtggtttactattaggaccaaacccacggatttggaatgtgtggaatggaaattttgtttggcccaaaacctttgttctggcca

SEQ ID NO: 24706 - protein, 174 aa, Zea mays
  misc_feature: Ceres CLONE 1395976-F
  misc_feature (110)..(110): Xaa is any aa, unknown, or other
  misc_feature (117)..(117): Xaa is any aa, unknown, or other
  misc_feature (124)..(124): Xaa is any aa, unknown, or other
  misc_feature (126)..(126): Xaa is any aa, unknown, or other
MAKLALALLLLLAVAASASASSGSHLDLDLGFLSSGERRRECRGTVAECLAEERNEEGLGPGRIPPPRALTAAGHQATARLRRDNVPCSPPRRQLLTLPGPGRPGQTPTXRGWLPHXPLCRGLXAXSGFRPTGRGKRAWVWSKVPGPFSPNNNFLSPCVGFRALTATGPLVVYY

SEQ ID NO: 24707 - DNA, 732 bp, Zea mays
  misc_feature: Ceres CLONE 1395977-F
  misc_feature: Encodes the peptide sequence at SEQ ID NO. 24708
  misc_feature (427)..(427): n is a, c, t, g, unknown, or other
  misc_feature (520)..(520): n is a, c, t, g, unknown, or other
aaagctggagctccaccgcggtggcggccgctctagaactagtgcgatcccccgaggctgcaagaattcacacgagaccattacctagaacatcctaatcgaaaagacgccgccccggtcggctccgtcgccgccgacatcgccaccaccgaaccatggacaccacggagccgcccgtggcaccaagcgccctctcaccgccactgcaggcgatgacgacgatgctggcctggagcgcaagccgcggttccctaaggggaagaaggccaagtaccgcgacgtcggtgcggagggaggcccctctggcaacgctgtggacctcgacagcatgctgaatccggagcttgcggcggagcggcgggcgcggcagcgccacggccagctcaaggagggagacgacgcgaagggaggtgccgctgaggtgagnggcttcgaagtccgctacaacgacagtgttaactttgttgacgatggtatcgggatagagccgtttaacttggagcgagaaagggaagaaggntatttcgatgagaatgggaactttgtggagtatgcaagaggcaatgagattaagaatgcttggttggcacccgggtgcaagtggacccaacatatgctgcaaaggttcagaacaaaggcaaagagaaagtacaccgaagttgaggacctctcttccgatgaacattgggagggctaaaaaggcagatagcaaacttgcttgagccaggagaa

SEQ ID NO: 24708 - protein, 122 aa, Zea mays
  misc_feature: Ceres CLONE 1395977-F
  misc_feature (33)..(33): Xaa is any aa, unknown, or other
MLNPELAAERRARQRHGQLKEGDDAKGGAAEVXGFEVRYNDSVNFVDDGIGIEPFNLEREREEGYFDENGNFVEYARGNEIKNAWLAPGCKWTQHMLQRFRTKAKRKYTEVEDLSSDEHWEG

SEQ ID NO: 24709 - DNA, 726 bp, Zea mays
  misc_feature: Ceres CLONE 1395978-F
  misc_feature: Encodes the peptide sequence at SEQ ID NO. 24710
  misc_feature (572)..(572): n is a, c, t, g, unknown, or other
  misc_feature (594)..(594): n is a, c, t, g, unknown, or other
  misc_feature (595)..(595): n is a, c, t, g, unknown, or other
  misc_feature (601)..(601): n is a, c, t, g, unknown, or other
aaagctggagctccccgcggtggcggccgctctagaactagtggatcccccgggctgcaggaattcgcacgagaccattacctagaacatcctaatcgaaaaacacacccggaccccggtctgcgtttgtccctgcgggctgcggccctgcctcttctcgtctcccgttcccctcgccgcgtgagctctctctctctctctctctcctctgtggtgacgactgggcgcccgcacccctggcagccgccgccgcccagtccccgtcgggcccttcggcaggtcttcttcggcctcttcgccggcgacgagccgcaccaggcgtacatgtgtacacccagcccaggcccttaactgcgcccgcccctgcgactggttttcctgctggtttctgtggatttggctgccggaggattggtgcagcctttaggatcacggtagattcgctgtgaaatccgaagggtgctcaggtcatgttgcgggaccagcgcatgatactgggcttagactcggcaacctcatcaagcactgcccctgatttgacccgcgctgaagaggatccttctgtgagcagnagctgcgtgatcaccgctgcannggtggnatgggcgcataaagagaacacgtgggaagccccgggggaaatggttataccaagagaagacagaaacggcaagggggtcgagggatcttgcagtcagagctggtcccccaaaaaaaggaggggtt

SEQ ID NO: 24710 - protein, 85 aa, Zea mays
  misc_feature: Ceres CLONE 1395978-F
  misc_feature (34)..(34): Xaa is any aa, unknown, or other
  misc_feature (42)..(42): Xaa is any aa, unknown, or other
  misc_feature (44)..(44): Xaa is any aa, unknown, or other
MLRDQRMILGLDSATSSSTAPDLTRAEEDPSVSXSCVITAAXVXWAHKENTWEAPGEMVIPREDRNGKGVEGSCSQSWSPKKRRG

SEQ ID NO: 24711 - DNA, 624 bp, Zea mays
  misc_feature: Ceres CLONE 1395980-F
  misc_feature: Translation starting site: 131
  misc_feature (295)..(295): n is a, c, t, g, unknown, or other
  misc_feature (353)..(353): n is a, c, t, g, unknown, or other
  misc_feature (386)..(386): n is a, c, t, g, unknown, or other
  misc_feature (417)..(417): n is a, c, t, g, unknown, or other
  misc_feature (529)..(529): n is a, c, t, g, unknown, or other
tggggaattcgcacgagaccattacctagaacttcctaatcgaaaactcgaaaccctagcgccggcgcctccacttcgttttcctcactctctcctccagctcagggtccggcggcgaagggaaggcaagatgtacaccgcgaggaagaagatccagaaggagaagggccttgagccctccgagttcgaggactccgttgcccaggctttctttgatctggagaacgggaacaggagctcaagagcgaccctcaggacctgtacatcaacaatgctatccagatgggatgtaccnggagcagggagggttgttgtcatcacggtccatagcggcgtgcgcagggcttcagggngatccatgtcagactcgtcagggagctgggagngaaattcagcggcagggatgtggtatttgtngctacaggaggattgtgaggccacccaaggagggttcagctggtctggggcctcgcaccaggactctggctgggtgtcaccgtggcatctttggagggatgtcgctacccanctgagaatggggggaagccgggcacatacccgctgggatggttcaaaaattatcaagtttttcttggccccaaggggggggacaaccctgaatag

SEQ ID NO: 24712 - DNA, 662 bp, Zea mays
  misc_feature: Ceres CLONE 1395985-F
  misc_feature: Encodes the peptide sequence at SEQ ID NO. 24713
  misc_feature (276)..(276): n is a, c, t, g, unknown, or other
  misc_feature (314)..(314): n is a, c, t, g, unknown, or other
  misc_feature (323)..(323): n is a, c, t, g, unknown, or other
  misc_feature (330)..(330): n is a, c, t, g, unknown, or other
  misc_feature (662)..(662): n is a, c, t, g, unknown, or other
aagctggagctccccgcggtggcggccgctctagaactagtggatcccccgggctgcaggaattcgcacgagaccattacctagaacacctaatcgaaaaactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgcccgcggttcatctaccgccgncggtgcatctgccacctccggttcacctggcacctccnggtgcatcntccaccngccgggtcacctggccgccgcggtccacctggcaccgcccgttcatggtgcgccggcgggtcatctgccgcccgcaccatggcactaccctactcacccgccccggctcaggctcatcccagccacacccatgcccgtggcaacagccgaatccaagcccgtgcagctgcaggggaccctggggggtttgcacacccccgatcctggcgcaggggggccagtttttgaggcatcaggggagcccgagggggaacccctattgttcccccaagggccatcttttgcggaagagggttcccccaattccggggggggggccccaaacccgtacn

SEQ ID NO: 24713 - protein, 167 aa, Zea mays
  misc_feature: Ceres CLONE 1395985-F
  misc_feature (39)..(39): Xaa is any aa, unknown, or other
  misc_feature (57)..(57): Xaa is any aa, unknown, or other
MRVLLVALALLALAASATSTHTSGGCGCQPPPAVHLPPXVHLPPPVHLAPPGASSTXRVTWPPRSTWHRPFMVRRRVICRPHHGTTLLTRPGSGSSQPHPCPWQQPNPSPCSCRGPWGVCTPPILAQGGQFLRHQGSPRGNPYCSPKGHLLRKRVPPIPGGGPQTRT

SEQ ID NO: 24714 - DNA, 673 bp, Zea mays
  misc_feature: Ceres CLONE 1395986-F
  misc_feature: Encodes the peptide sequence at SEQ ID NO. 24715
  misc_feature (315)..(315): n is a, c, t, g, unknown, or other
  misc_feature (418)..(418): n is a, c, t, g, unknown, or other
aagctggagctccccgcggtggcggccgctctagaactagtggatcccccgggctgcaggaattcgcacgagaccattacctagaacatcctaatcgaaaaattccccggttggcttggttaccattcctcccccaaaacacatcctgcgatcctcgaagcctccgccgagcatcgatcatgtcggcctactgcggcaagtacgcggatgagctcatcaagaatgctgcctacatcggcacccctggcaagggtatccttgctgctgatgagtcaactggcaccattggcaagcgcctttccagcatcaatgtcnagaacgtggaggagaaccggcgggctctccgtgagctcctgttctgctgccctggtgccctccagtacatcagcggtgtgatcctcttcgaggagaccctctnacagaagaccaaggatggcaagccttttgtcgatgtcctcaaggaggggaggcgtcctccctggcatcagggtcgacaaggcaccattgaggttgttggcaccgacaaggagaccaccacccagggccacgatgacctcggcaagcgctgcgctaagtactacgaggccggtgcccgctttggccaggtggcgtgctggtctcaaggatggccccaacgagccggcacagcttgccactgacctggatgctcagg

SEQ ID NO: 24715 - protein, 159 aa, Zea mays
  misc_feature: Ceres CLONE 1395986-F
  misc_feature (11)..(159): Pfam Name: Glycolytic Pfam Description: Fructose-bisphosphate aldolase class-I
  misc_feature: SWISSPROT Homolog: EC 4.1.2.13 Fructose-bisphosphate aldolase
  misc_feature (46)..(46): Xaa is any aa, unknown, or other
  misc_feature (80)..(80): Xaa is any aa, unknown, or other
MSAYCGKYADELIKNAAYIGTPGKGILAADESTGTIGKRLSSINVXNVEENRRALRELLFCCPGALQYISGVILFEETLXQKTKDGKPFVDVLKEGRRPPWHQGRQGTIEVVGTDKETTTQGHDDLGKRCAKYYEAGARFGQVACWSQGWPQRAGTACH

SEQ ID NO: 24716 - DNA, 638 bp, Zea mays
  misc_feature: Ceres CLONE 1396001-F
  misc_feature: Encodes the peptide sequence at SEQ ID NO. 24717
  misc_feature (237)..(237): n is a, c, t, g, unknown, or other
  misc_feature (257)..(257): n is a, c, t, g, unknown, or other
  misc_feature (275)..(275): n is a, c, t, g, unknown, or other
  misc_feature (328)..(328): n is a, c, t, g, unknown, or other
  misc_feature (335)..(335): n is a, c, t, g, unknown, or other
  misc_feature (343)..(343): n is a, c, t, g, unknown, or other
  misc_feature (344)..(344): n is a, c, t, g, unknown, or other
  misc_feature (423)..(423): n is a, c, t, g, unknown, or other
  misc_feature (452)..(452): n is a, c, t, g, unknown, or other
  misc_feature (453)..(453): n is a, c, t, g, unknown, or other
  misc_feature (504)..(504): n is a, c, t, g, unknown, or other
  misc_feature (547)..(547): n is a, c, t, g, unknown, or other
  misc_feature (554)..(554): n is a, c, t, g, unknown, or other
cgctctagaactagtggatcccccgggctgcaggaattcgcacgagaccattacctagaacatcctaatcgaaaaacatcgacccagccatctcctcaccctcgttcaccacacagttcgccactcctttagtagcttgtgatttgtacgtcgacgagatcactggtcgggtggcggacgacgacacatggggaagggtagtgtgggtgcatcatggtgggcgttcctcctgctcgnccgcgtgctgctggtcgtancagccacggccggggcgnaggaacgagtggtcaaacgggaccgcaaggaggacctgcggtggtgcaagcangcgtgcnagtggcanntacgaaaggacaccccgcggaagagggatgcaagagcgagtgcgcgagcggcacagcaagcttgacgcggcgagacggnacagcgcgtggacgctactctccgctcgnnagggggcgagtgcccgcccagtgcctgcgccgcacgagggccagcgtgganacccagagtggatgaggcggtgccgccgcgcggactggccgcnacatgancaagagtaccgtcgcggagccagagcgcggcaagttcccggaagaggtcaagcgcaccacgcggggactggggggagagcaccc

SEQ ID NO: 24717 - protein, 73 aa, Zea mays
  misc_feature: Ceres CLONE 1396001-F
  misc_feature (17)..(17): Xaa is any aa, unknown, or other
  misc_feature (24)..(24): Xaa is any aa, unknown, or other
  misc_feature (30)..(30): Xaa is any aa, unknown, or other
  misc_feature (47)..(47): Xaa is any aa, unknown, or other
  misc_feature (50)..(50): Xaa is any aa, unknown, or other
  misc_feature (52)..(52): Xaa is any aa, unknown, or other
  misc_feature (53)..(53): Xaa is any aa, unknown, or other
MGKGSVGASWWAFLLLXRVLLVVXATAGAXERVVKRDRKEDLRWCKXACXWXXRKDTPRKRDARASARAAQQA

SEQ ID NO: 24718 - DNA, 668 bp, Zea mays
  misc_feature: Ceres CLONE 1396002-F
  misc_feature: Encodes the peptide sequence at SEQ ID NO. 24719
  misc_feature (230)..(230): n is a, c, t, g, unknown, or other
  misc_feature (426)..(426): n is a, c, t, g, unknown, or other
  misc_feature (427)..(427): n is a, c, t, g, unknown, or other
  misc_feature (451)..(451): n is a, c, t, g, unknown, or other
  misc_feature (491)..(491): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (522)..(522): n is a, c, t, g, unknown, or other
aagctggagctccccgcggtggcggccgctctagaactagtggatcccccgggctgcaggaattcgcacgagaccattacctagaacatcctaatcgaaaagcttcagctcggcgtcttcacaaacgccggcgcaaactctcgcccgagcccgacagatcttcaattccccattccgcccaccgatcgaccttcacgccagtctcggtctcttccgaaggcgtcgcgcgncggttgtttgagaggagaggaggaagatgagggagtgcatctcccgtcacatcgggcaggccggcatccaagtcggcaacgcgtgctgggaactttactgcctcgagcacggatccagcttgatgggcaagtgctggagatagaccgcgggacatcacgatgatgccttcagcacttttctcagcagactgtgctnntggaaagcacgtccccgtgcaatncctcgtgatctagaccccactgtgaatcgatgaaggcggncannnnttgacgaccggccgtcttccctggnagtcatcagtgggagggagggatgcgctacaatttccgcccgtggcactacacattgggcaggagattggtgatctgggctttgacggtatccgcagtttggtgacactgcacccctccagggcttctgggctccaagggcggtgg

SEQ ID NO: 24719 - protein, 38 aa, Zea mays
  misc_feature: Ceres CLONE 1396002-F
MRECISRHIGQAGIQVGNACWELYCLEHGSSLMGKCWR

SEQ ID NO: 24720 - DNA, 675 bp, Zea mays
  misc_feature: Ceres CLONE 1396006-F
  misc_feature: Encodes the peptide sequence at SEQ ID NO. 24721
  misc_feature (295)..(295): n is a, c, t, g, unknown, or other
  misc_feature (319)..(319): n is a, c, t, g, unknown, or other
  misc_feature (407)..(407): n is a, c, t, g, unknown, or other
  misc_feature (459)..(459): n is a, c, t, g, unknown, or other
aaagctggagctccccgcggtggcggccgctctagaactagtggatcccccgggctgcaggaattcgcacgagaccattacctagaacatcctaatcgaaaaagccttccccgtctctcctcttctgccgaacgagacagaccgggttatgtagcctgcctcgctttcggcgagagaggaagaggcggaggagatcagggcaatgggcggggcggaggcgctgggccagccggacggccatgcgaacggggccgtggtggaggagaagctggacttgctgcggcggcagctgggnaaggcggacggcgacccgctccgnatcgtcggcgtcggggcgggcgcctggggtagcgtcttctgcgcgctgctgcaggacgcgtacggccacctccgcgacaaggcgcagntccgcatctggcgccgcccgggccgagccgtcgaccgcgccaccgccgaganccctcttcgacgtcttcacgcgcggcgaggacgtcctgcgccgcctgatccgccgctgcgcctacctcaaggtacgtcgaggcgcgcctcggcgaccgcacgctctacgccgacgagataccttcagggacggcttctgcctcaacatgatcgacacgccgctctgcccggctcaaggtcgcaccaacctggcagggagggccgtctgggacgctt

SEQ ID NO: 24721 - protein, 157 aa, Zea mays
  misc_feature: Ceres CLONE 1396006-F
  misc_feature (69)..(69): Xaa is any aa, unknown, or other
  misc_feature (86)..(86): Xaa is any aa, unknown, or other
MGGAEALGQPDGHANGAVVEEKLDLLRRQLGKADGDPLRIVGVGAGAWGSVFCALLQDAYGHLRDKAQXRIWRRPGRAVDRATAEXPLRRLHARRGRPAPPDPPLRLPQGTSRRASATARSTPTRYLQGRLLPQHDRHAALPGSRSHQPGREGRLGR

SEQ ID NO: 24722 - DNA, 650 bp, Zea mays
  misc_feature: Ceres CLONE 1396007-F
  misc_feature: Translation starting site: 143
  misc_feature (538)..(538): n is a, c, t, g, unknown, or other
gctctagaactagtgggtcccccgggctgcaggaattcgcacgagaccattacctagaacatcctaatcgaaaaatcaaccatattattgagaccaacaagcaacatagaaagtggaatacagtagcaacaatagagcaacaatggcggccaagatattttccatccttatgctccttgctctttctgcatgtgttgctaacgcgaccatttttcctcaatactcacaagctcctatagctgcccttcttcccccataccttccatcaatgaccgcttcagtatgtgaaaacccagcccttcaaccctacaggctccaacaagcaatcgcaacaagcaacttacctttatcacccctgttctttcaacatcgccagccctatctttggtgcagtcattggtacaaaccatcagggcacaacagctgcagcaactcgtgctaccagtgatcagccaagtagctctgggaaacctttctccctactctcagcaacaacaatttcttccattcaaccaactgtctaccctgaaccctgctngctaatttgcagaacaaacactactaccattcagccagggtaggtactgcctactctccagaagaacaatttctttcatttaacccattcccccgactggaccccctttgtt

SEQ ID NO: 24723 - DNA, 680 bp, Zea mays
  misc_feature: Ceres CLONE 1396010-F
  misc_feature (501)..(501): n is a, c, t, g, unknown, or other
  misc_feature (517)..(517): n is a, c, t, g, unknown, or other
  misc_feature (553)..(553): n is a, c, t, g, unknown, or other
  misc_feature (585)..(585): n is a, c, t, g, unknown, or other
aaagctggagctccccgcggtggcggccgctctagaactagtggatcccccgggctgcaggaattcgcacgagaccattacctagaacatcctaatcgaaaaaaaactcctcggccccagcattttcgtgcaaggggcgagccgccagctactgctggccttttccctcacacaagtcacacgcacacccgctagcccccgtcccccgtcccgcccgtaccttcctccgccgcctccgtcctcgttccaaccgtgggcagcaggcaggcccaagtatctgcagtagattggtggagaggaagaagacggcaggcacccacgcagatcaaacgtgctccgccacccttggtttcggcgaatcggcgccgtacgccgtaaatcgagccgtctccgagcagatcgacgcgctgcatagcaattcgacccgtctccggccaaatcgacgtccagagctgcaaattgacccatctccgcgctgacctccgcttgtgcctgccgagnaagcgccgaagttacngcccttctcgtgaagacatccttgataaacctgatngctatcgcggagagctgtgttggatgcggggncatggagaaaatgtggtggcttaaatactgcggtggcctctatgccgcaaagccagagcttgctgcccgcccgcattgagggcatcgggcttttt

SEQ ID NO: 24724 - DNA, 693 bp, Zea mays
  misc_feature: Ceres CLONE 1396012-F
  misc_feature: Encodes the peptide sequence at SEQ ID NO. 24725
  misc_feature (529)..(529): n is a, c, t, g, unknown, or other
  misc_feature (530)..(530): n is a, c, t, g, unknown, or other
  misc_feature (592)..(592): n is a, c, t, g, unknown, or other
  misc_feature (631)..(631): n is a, c, t, g, unknown, or other
  misc_feature (635)..(635): n is a, c, t, g, unknown, or other
  misc_feature (644)..(644): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
aaagctggagctccccgcggtggcggccgctctagaactagtggatcccccgggctgcaggaattcgcacgagaccattacctagaacatcctaatcgaaaaatagcacacagccaaagccaccagcgctcgtcacctccaatcaacaaattcccaatccgccgcttcccatcccgcgttcgccgctccatttgatcgaattcccgatggcgcccaaggccgagaagaagcccgcggagaagaagccgacggaggagaaggccgagaagaagcccagggcggagaagcgcgtgccgggcaaggagggcgggcgagaagaaggggaagaagaaggccaagaagagcgtcgagacgtacaagatctacatcttcaaggtgctcaagcaggtgcacccggacattggtatctcgtccaaggccatgtccatcatgaactccttcatcaacgacatcttcgagaagctggctgccgaggccgccaagctcgcccgctacaacaagaagcccaccataaacctcccgggagacnncagacttcggtgcgcctcgtccttcctggcgagctcgccaagcacgcccgtctccgagggcnaccaaaggccgttaccaagttacttcccctcttagatcngcgncgcacgaanggaacgnnncttctgtttcgtttccctcgtactttttaggcagtggggt

SEQ ID NO: 24725 - protein, 68 aa, Zea mays
  misc_feature: Ceres CLONE 1396012-F
  misc_feature (37)..(37): Xaa is any aa, unknown, or other
  misc_feature (58)..(58): Xaa is any aa, unknown, or other
MSIMNSFINDIFEKLAAEAAKLARYNKKPTINLPGDXRLRCASSFLASSPSTPVSEGXQRPLPSYFPS

SEQ ID NO: 24726 - DNA, 787 bp, Zea mays
  misc_feature: Ceres CLONE 1396015-F
  misc_feature: Encodes the peptide sequence at SEQ ID NO. 24727
  misc_feature (18)..(18): n is a, c, t, g, unknown, or other
  misc_feature (27)..(27): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (45)..(45): n is a, c, t, g, unknown, or other
  misc_feature (787)..(787): n is a, c, t, g, unknown, or other
cccctcctcaccacctcntttcttttntttggtaggggccnnntntcaaagctggggctccaccgcggtggcggccgctctagaactagtggatcccccgggctgcgggaattcgcacgagaccattacctagaacatcctaatccaaaagcaccaccaccgtcactcaacacagcacaggcagctcgagagagagagagagagaaagatgtcgtggttcgggcaccaccaccacaaccagccggctcccccggcgtcgggccccaaccaggtgttcaagatcttctgccgcgccaacgagaactactgcctgggcgtccgcgacggcgccgtcgtgctggccccgggcaaccccaagggacgaccacccagcactggtacaaggacatgcgcttcaccacccgggtcaaggaccacgaaggcatggccggcgttccgcgctcgcaacaagggccagggggctcggaatcaaggactccctcgggcagtcccacccggggaagctcgcgccttttcagcccggaccaggagggacggcgccggctgctgggggacggagaacaaagggcgggggggcaagggctctcccgctggatcccggatggggcaacaaacacccggcttaaacttcgaccgctgtcgaggggggcggggaccagcgggcggggggggggaacgaaggggccccccccccgccgcgggtctgggggagggggggcggaggggccaaaaacccggccggcgggaagcatcccccggccgggggggggcccgcggagggccaacn

SEQ ID NO: 24727 - protein, 193 aa, Zea mays
  misc_feature: Ceres CLONE 1396015-F
MSWFGHHHHNQPAPPASGPNQVFKIFCRANENYCLGVRDGAVVLAPGNPKGRPPSTGTRTCASPPGSRTTKAWPAFRARNKGQGARNQGLPRAVPPGEARAFSARTRRDGAGCWGTENKGRGGKGSPAGSRMGQQTPGLNFDRCRGGRGPAGGGGERRGPPPAAGLGEGGRRGQKPGRREASPGRGGARGGPT

SEQ ID NO: 24728 - DNA, 675 bp, Zea mays
  misc_feature: Ceres CLONE 1396016-F
  misc_feature: Translation starting site: 198
  misc_feature (314)..(314): n is a, c, t, g, unknown, or other
  misc_feature (448)..(448): n is a, c, t, g, unknown, or other
  misc_feature (470)..(470): n is a, c, t, g, unknown, or other
tggagctccccgcggtggcggccgctctagaactagtggatcccccgggctgcaggaattcgcacgagaccattacctagaacatcctaatcgaaatctataaatggctagctcccacatatgaactagtctctatcatcatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggnctgacgacgatgatgggcgccggcgggctgtacccctacgcggagtacctgaggcagccgcagtgcagcccgctggcggcggcgcctactacggccgggtgtgggcagccgagcgccatggttcagccgctccngcaacagtgctggcagcagcanatggaggatgatggacgtgcagtccgtcgcgcagcagctgcagatgatgatgcagcttgagcgtgccgctgccggcagcagcagcctgtacgagccagctctgatgcagcagcagcagcagctgctggcagcccagggtctcacccccatggccatgatgatggcgcaaacatgcgggccatgggtggactctaccagtacagcg

SEQ ID NO: 24729 - DNA, 688 bp, Zea mays
  misc_feature: Ceres CLONE 1396018-F
  misc_feature: Encodes the peptide sequence at SEQ ID NO. 24730
  misc_feature (490)..(490): n is a, c, t, g, unknown, or other
aagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtggacgcctacgtctcccgctccgggnaggggcgagtgccggcgccagtgcctgcgccgccacgagggccagccgtgggagacccaggagtgcatgaggcggtgccgccgccgcggactggccgtcgaatggagcaagagtacggtcgcggcagcgagagcgcgggcaagtgccgggagaggtgcgagcgccccaccgcggggactggtgggaagcggtgtggtc

SEQ ID NO: 24730 - protein, 158 aa, Zea mays
  misc_feature: Ceres CLONE 1396018-F
  misc_feature (93)..(93): Xaa is any aa, unknown, or other
MGKGSVGASWWAFLLLAGVLLVVAATAGAEDGVVERDRKEDLRWCKQACEWQYGKDTPRKRECESECRERHQQADAGEDGDSGVDAYVSRSGXGRVPAPVPAPPRGPAVGDPGVHEAVPPPRTGRRMEQEYGRGSESAGKCRERCERPTAGTGGKRCG

SEQ ID NO: 24731 - DNA, 682 bp, Zea mays
  misc_feature: Ceres CLONE 1396019-F
  misc_feature: Translation starting site: 122
  misc_feature: SWISSPROT Homolog: EC 1.11.1.15 Peroxiredoxin
  misc_feature (363)..(363): n is a, c, t, g, unknown, or other
  misc_feature (425)..(425): n is a, c, t, g, unknown, or other
  misc_feature (476)..(476): n is a, c, t, g, unknown, or other
  misc_feature (525)..(525): n is a, c, t, g, unknown, or other
  misc_feature (562)..(562): n is a, c, t, g, unknown, or other
aagctggagctccccgcggtggcggccgctctagaactagtggatcccccgggctgcaggaattcgcacgagaccattacctagaacatcctaatcgaaaactcatccactccgggcggccatggcctgctccttctccgccgccatcaccgtctcttccgcccctaccccggccgccagacccctcgctgctgccacgcagtccgtctgcatcgctcgctccgcggtcgccaccactgccaggccgctccgcctcgccgcctcaaggtccgcgcgggctaccagactcgttgcccgcgccagcgtagtcgatgacttgccgctggtcgggaacaggcgccagacttcgaagccgaggctgtngtcgaccaggagttcatcaacgtgaagctctctgattacttgggaaagagtacgtcattctngtcttctacccctttggattcacttcgtctgcccgacccgagatactgcgnttagtgacagatacgaggaatttgagaaagtgacactgaggttcttggntgttccattgacagtgtgttctcccactttgcatggntgcagacagacaggaagtcggtggggctcggcgatctaaatacccacttggttcctgatgggaccaatcaattcaaggggcttttggggtctgatccctggaccgggaattggctttgag

SEQ ID NO: 24732 - DNA, 734 bp, Zea mays
  misc_feature: Ceres CLONE 1396020-F
  misc_feature: Encodes the peptide sequence at SEQ ID NO. 24733
  misc_feature (357)..(357): n is a, c, t, g, unknown, or other
aaagctggagctccccgcggtggcggccgctctagaactagtggatcccccgggctgcaggaattcgcacgagaccattacctagaacatcataatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattgncaggaacatggtggcgccgctcctggtgctcaacctcatcatgtacatcatcgtcatcggcttcgcgagctggaacctgaaccacttcatcaacgggcagaccaactaccccggggtgggccggcaacggcgcgacgttctaccttcctggtgttcgcctcctgccccccgcggtggggggcccccggctcccaaagcttggggggggggggccccacgtggcgcgcccggggggcaccgaaaggcctggccaccaaaaggcccggggtcggtccactctatcggcctggggcccttcacgggggcttccgccccttggggggtgggccctcggaaaagggaagatcccaacatccggcgggaaaacacccgccggg

SEQ ID NO: 24733 - protein, 130 aa, Zea mays
  misc_feature: Ceres CLONE 1396020-F
  misc_feature (5)..(5): Xaa is any aa, unknown, or other
MAGIXRNMVAPLLVLNLIMYIIVIGFASWNLNHFINGQTNYPGVGRQRRDVLPSWCSPPAPRGGGPPAPKAWGGGAPRGAPGGHRKAWPPKGPGSVHSIGLGPFTGASAPWGVGPRKREDPNIRRENTRR

SEQ ID NO: 24734 - DNA, 677 bp, Zea mays
  misc_feature: Ceres CLONE 1396022-F
  misc_feature: Translation starting site: 291
  misc_feature: SWISSPROT Homolog: EC 3.1.3.16 Phosphoprotein phosphatase
  misc_feature (359)..(359): n is a, c, t, g, unknown, or other
  misc_feature (360)..(360): n is a, c, t, g, unknown, or other
  misc_feature (491)..(491): n is a, c, t, g, unknown, or other
  misc_feature (494)..(494): n is a, c, t, g, unknown, or other
  misc_feature (579)..(579): n is a, c, t, g, unknown, or other
  misc_feature (640)..(640): n is a, c, t, g, unknown, or other
aagctggagctccccgcggtggcggccgctctagaactagtggatcccccgggctgcaggaattcgcacgagaccattacctagaacatcctaatcgaaaaagacaaaacagcgtccccctccctctactaaaaaaaaaatggaggcatgagctccgcctcctcctcgtctctcgccgatctccccaaaccctagccccgacctgaccgccggcgggcccgccggccggagaaggagtcgctcccacccacccaacttctgcggcggaaggggagcgggcggcggacgagatgccgtcgcacggggatctggaccggcagatcgcgcagctgcgcgactgcaagtacctgcccgaggcnngagtcaaggcgctctgcgagcaggcaaggccatccttatggaggagtggacgtgcagcccgtgcgctgtcctgtcaccgtctgtggcgactccacgggcagttctatgacctcatcgagctctccggatcnggngggacgctccccgacacaactagcctctcatgggcgactacgtcgatcgtggctactattcagtcgaaacagtttctctggtagnggctttggaaagcccgtacagagatagatttacatacttaggaggaatcatgggagcaganaatcactcaagtatatggcttctatggtgaatgctaa

SEQ ID NO: 24735 - DNA, 776 bp, Zea mays
  misc_feature: Ceres CLONE 1396033-F
  misc_feature: Encodes the peptide sequence at SEQ ID NO. 24736
  misc_feature (322)..(322): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
caaagctggagctccccgcggtggcggccgctctagaactagtggatcccccgggctgcaggaattcgcacgagaccattacctagaacatcctaatcgaaaagccaactcgcacgcagcagtacgacgtctctcctctgggtctggggccgagacacctagcacgtactaccagcaagatggtggcgtctcccagattcaagcccatcgaggagtgctgctcggaggggcggtcggagcagacggtggccgccgacctggacggcacgctgctcatctccaggagcgcgttcccctactacctcctcgtggctctcgaggncggcagcgtcctccgcgccgcgctgctgctcctgtcnnngtgcgtcgtctacgtcacctacgccttctttctcgagtcgctggccatcagcacgctggtatacatctccggtggcggggctcaaggtgggcagcatcgaagatggtggcgcgcttcgtggctccccaggttctaccggggcgaacgtgcacccgaaaagcgtggagggggttcagttccttcgggaggggtataattgttccgggcaagcccagggtatggggcaaaccctttcccaggcttttctagggcccaaaaagggtccccgaaccaaatttgaggtccaaagggaaaaaaagcccccttttttagggccacgccgggggttttctccgaaaaaccaaaaaaaaacccccctcaaggatttggggagctttccccatttttttgggggaattaaagagcccccctctct

SEQ ID NO: 24736 - protein, 125 aa, Zea mays
  misc_feature: Ceres CLONE 1396033-F
  misc_feature: SWISSPROT Homolog: EC 2.3.1.15 Glycerol-3-phosphate O-acyltransferase
  misc_feature (48)..(48): Xaa is any aa, unknown, or other
  misc_feature (61)..(61): Xaa is any aa, unknown, or other
MVASPRFKPIEECCSEGRSEQTVAADLDGTLLISRSAFPYYLLVALEXGSVLRAALLLLSXCVVYVTYAFFLESLAISTLVYISGGGAQGGQHRRWWRASWLPRFYRGERAPEKRGGGSVPSGGV

SEQ ID NO: 24737 - DNA, 777 bp, Zea mays
  misc_feature: Ceres CLONE 1396034-F
  misc_feature (518)..(518): n is a, c, t, g, unknown, or other
  misc_feature (622)..(622): n is a, c, t, g, unknown, or other
tggagctccccgcggtggcggccgctctagaactagtggatcccccgggctgcaggaattcgcacgagaccattacctagaacatcctaatcgaaaaactcgatcagtcgcgtgtctaggtttcctctctcaccatagcgcccgctctgtcgcccttcgttcacctctccttcctctcgtccctgcctgccagggagaggggaagtcagaggcacggagtggcgcagagcagacgcccgtgaaccattgtagctgtccctgtcatcgccgtcgtcaacgaacccccacaaggaaaggatggagaatatgccgaccatcctcatgaacaggtaccgagctcgggcgcacggctcgggcagggcaccttcgcccaggtgtaccacggccgggaacctcgcgttcggggagagcgtggccatcaatgtcatccaccaaggagaaggtgatgcgcgtccgcatgatcgacccgattcaagggcgagatcttccgtatgggcctctcccgccaccccaacgtnggggcgcttgcccgagggggttggcacaaagaacaagaatatccttcccctggaaatacgtcccggggggggggaacttttttccccccctttccccccggggnccgttttaaggggggacccgcggagagaaagtatttcccccaaatttcgggggggggccggccaatttttgcgcccgggcggcggggggttaacacccggggaacctttagcgccggaaaacactccctcgcgagaaagagcccggcaacccctg

SEQ ID NO: 24738 - DNA, 728 bp, Zea mays
  misc_feature: Ceres CLONE 1396035-F
  misc_feature: Encodes the peptide sequence at SEQ ID NO. 24739
  misc_feature (340)..(340): n is a, c, t, g, unknown, or other
  misc_feature (414)..(414): n is a, c, t, g, unknown, or other
  misc_feature (518)..(518): n is a, c, t, g, unknown, or other
  misc_feature (583)..(583): n is a, c, t, g, unknown, or other
aagctggagctccccgcggtggcggccgctctagaactagtggatcccccgggctgcaggaattcgcacgagaccattacctagaacatcctaatcgaaaaagcctgcgctccccttctttcccgttcggctcacagcgaagaaggaagccggttagggtttccacctcctttcccctcctctccttcagcgacgaccgcgggccacaccctcgatatccttcccctcggacccggaggcgagcagcagcctccagcgcctgccacgcctgcccgtctcgttattgggaggattcgccatgtctgacatggagtccgtcacagctcttatgaactcgacnagctccaagatacagcagcttcaggaggcatttgctgagcttgagagccagagcacggtttccatgaacctcangtggaagcagcttgaagaccactttcgtggtcttgaacagtccctcaagaaaaagtttgacgagctaaaagagcaggagaaggagttccaggagactgtcgcanaatcaaagcagattctggagcagcgggaggcagctgttgtggcaaaggaactgactcctttgaanaaattgcaggagaagagggaagtgcattagctatgatctttagcaggtccaggttttcttacctgggttctacatcaaccaatgaacaggcgctggaaataatcttgggtgcgaggtggccaaaccggatttttgaggagagggg

SEQ ID NO: 24739 - protein, 104 aa, Zea mays
  misc_feature: Ceres CLONE 1396035-F
  misc_feature (39)..(39): Xaa is any aa, unknown, or other
  misc_feature (74)..(74): Xaa is any aa, unknown, or other
  misc_feature (95)..(95): Xaa is any aa, unknown, or other
MSDMESVTALMNSTSSKIQQLQEAFAELESQSTVSMNLXWKQLEDHFRGLEQSLKKKFDELKEQEKEFQETVAXSKQILEQREAAVVAKELTPLXKLQEKREVH

SEQ ID NO: 24740 - DNA, 678 bp, Zea mays
  misc_feature: Ceres CLONE 1396038-F
  misc_feature: Encodes the peptide sequence at SEQ ID NO. 24741
  misc_feature (572)..(572): n is a, c, t, g, unknown, or other
caaagctggagctccccgcggtggcggccgctctagaactagtggatcccccgggctgcaggaattcgcacgagaccattacctagaacatcctaatcaaaaaaagtcccaatccaccgacgaattccaaaccctgcctaggacctcggcgccactcgccgcacgtcgtccacgtccgcctccaccccaatccgatgggctatgaagagagcaaaaaacatctcctcagtctcagctaccctgagctgcaatgtttgtgcaaaaggtataaccttcctgctaagaagacccactctcagttaggaagttcgctcgcctcgctgcttgaggcatctccatctcctgctcctcctcctgtccaattagcatatatgaaagaagcatccacatgtaatcatgctaacaacaaaagaggcccatacgatggcagggatgatgctaaaccacttgtgcatgcgaaacatcatacaggagatcagacgcctgttgatgaaacatctaagaacgtgattgacactggtacgagtatacctcctgtttctatgaaccatgtaagaccagaatatcatgtncatctatcttctgacctgagactgctcataattacagtcccaatgtgacgtgtgaattgcactaatacgacaatctagcatttggtggcaacatgattgttcactg

SEQ ID NO: 24741 - protein, 141 aa, Zea mays
  misc_feature: Ceres CLONE 1396038-F
MGYEESKKHLLSLSYPELQCLCKRYNLPAKKTHSQLGSSLASLLEASPSPAPPPVQLAYMKEASTCNHANNKRGPYDGRDDAKPLVHAKHHTGDQTPVDETSKNVIDTGTSIPPVSMNHVRPEYHVHLSSDLRLLIITVPM

SEQ ID NO: 24742 - DNA, 739 bp, Zea mays
  misc_feature: Ceres CLONE 1396039-F
  misc_feature: Encodes the peptide sequence at SEQ ID NO. 24743
  misc_feature (573)..(573): n is a, c, t, g, unknown, or other
  misc_feature (739)..(739): n is a, c, t, g, unknown, or other
aaagctggagctccccgcggtggcggccgctctagaactagtggatcccccgggctgcaggaattcgcacgagaccattacctagaacatcctaatcgaaaaatccgccactacgccacaaaatcctctcctactccggcagttctgctcgccgccgcctccacgatgacggaagacgtgcagatgaacgactcggagccccagcctgcggcctcagctcccgccgtcggggcgccggcgctctccacactacaccatctgaaggagatcgcgtccgtgatcgaggccggttctctgtccaaggaggtccgccggatctcccgcgccttccgcctcaccgtcgcgctccgtcgccgcctcgccgcgcgggacgtctccgccttcctcgccttcgcgctacccgcgtcctccgaagcctacggacgcctcactgccctggtgcccaaggaagatgatactgagatggatgttgatgctgcagctccagcaactcagatttcaatcaaacatggtctccctgagattgaaatatattgctacttgctcgtactgattttccttattgatcataanaaatatgatgaggctaaggcatgcgcaagtgtgagcattgctcgcctgaagatctaaaccggaaaaatgggtggatggtttggaatcacgactgtacttcattaactctttaggggatgagctaccaacagcctgctgaaacccgggggaatttggtttgtcaaan

SEQ ID NO: 24743 - protein, 154 aa, Zea mays
  misc_feature: Ceres CLONE 1396039-F
  misc_feature (136)..(136): Xaa is any aa, unknown, or other
MTEDVQMNDSEPQPAASAPAVGAPALSTLHHLKEIASVIEAGSLSKEVRRISRAFRLTVALRRRLAARDVSAFLAFALPASSEAYGRLTALVPKEDDTEMDVDAAAPATQISIKHGLPEIEIYCYLLVLIFLIDHXKYDEAKACASVSIARLKI

SEQ ID NO: 24744 - DNA, 649 bp, Zea mays
  misc_feature: Ceres CLONE 1396043-F
tggagctccccgcggtggcggccgctctagaactagtggatcccccgggctgcaggaattcgcacgagaccattacctagaacatcctaatcgaaaagtctatgataatagccagtggcctcggttctcttttccaggtactacaatcgatcgattcatcgtagcgtatgcatgaacagtttgctggaagatacggcgcgggatgtgccgtagctgcgtctccagcaacatatacaggacgaaggccagcatgatcaggatcatctgatggatgacgatgacctagacgatgatgaggatctgctacgatgagcagacgctaaaacaatgaggacgtcgagcacgacggcggaagcatcgtcatcagaggagcgttggatggcgggcgtgatgcagacgtcgtcgccagcagaatgtgtgccaacagagagtagtggggctggaaatgcgcggttcctcgagtgctggaatggtccccgggaggggggcatagtatgaaactcctacggcaaaccgtttggtccgactcaacaaattctctttccttatgggtggcaaaggggccccaaggggttttaaaaaattgaaaaaggtggcctaccctttttctatacgcggaggggaaactatgtccattggccttttgggg

SEQ ID NO: 24745 - DNA, 666 bp, Zea mays
  misc_feature: Ceres CLONE 1396045-F
  misc_feature: Encodes the peptide sequence at SEQ ID NO. 24746
tggagctccccgcggtggcggccgctctagaactagtggatcccccgggctgcaggaattcgcacgagaccattacctagaacatcctaatccaaaaacacgctctcgtctccgccgcgctaggaacttccaactcccaagcccagccgcctgcctagggttaaggtcgcccctccgccccctcgctccgctcgtgaccggcagggttcgtcgccgccgttggatatgtcgcggacgctggtgcagccggtggggcagaagcgcctcaccaacgtggctgtggtgcggctgcgcaagcacggccagcgcttcgagatcgcctgcttcccaaacaaggtggctctcgtggcgctcccggcgtcgagaggaaatctgacgaaggtgctccaggcccacaccgtctaatccaacggtcttccaggggcatcctcgccaactcccaggaactcgccaagcccttcggggaccgacgaccttacccaatctggatcgagagtctgggaaaaaggggaactccaggtctccgggaaaggagagaggaagcggagtctctcaggccagttcgcgaatcgcaactattgggcttgggaagaaaacattcaaccagagacccgcccgcccctacacattaacaatgatcgagcgcctcatgcacgagaacaccct

SEQ ID NO: 24746 - protein, 59 aa, Zea mays
  misc_feature: Ceres CLONE 1396045-F
MSRTLVQPVGQKRLTNVAVVRLRKHGQRFEIACFPNKVALVALPASRGNLTKVLQAHTV

SEQ ID NO: 24747 - DNA, 662 bp, Zea mays
  misc_feature: Ceres CLONE 1396048-F
  misc_feature: Translation starting site: 202
  misc_feature: SWISSPROT Homolog: EC 1.3.99.1 Succinate dehydrogenase
  misc_feature (307)..(307): n is a, c, t, g, unknown, or other
  misc_feature (317)..(317): n is a, c, t, g, unknown, or other
  misc_feature (324)..(324): n is a, c, t, g, unknown, or other
  misc_feature (325)..(325): n is a, c, t, g, unknown, or other
  misc_feature (379)..(379): n is a, c, t, g, unknown, or other
  misc_feature (396)..(396): n is a, c, t, g, unknown, or other
  misc_feature (438)..(438): n is a, c, t, g, unknown, or other
  misc_feature (509)..(509): n is a, c, t, g, unknown, or other
  misc_feature (510)..(510): n is a, c, t, g, unknown, or other
  misc_feature (528)..(528): n is a, c, t, g, unknown, or other
aaagctggagctccccgcggtggcggccgctctagaactagtggatcccccgggctgcaggaattcgcacgagaccattacctagaacatcctaatcgaaaagttgtttcgtctccaccgccgctctcctttccagtctccaccaccgctcgtctccccgtaccgcccgcaacccccctcccctgcgagatccggggcgcgatgtggcgcagctgcgtctcgcggggcctctccagggccaaggcctccgcctccaggctcctctccacggcgtcgtcgtcctacacggtggtcgaccacacctacnacgcagtggntggtggnnggccggcggcgcggggctcccgggcggcgatcggcctctccgagcacggcttcnacacccgcgtgcatcancaagctcttccccacgcgctcgcacaccgtcgcgggtcaggnaggcataaatgctgcacttggaaacatgagtgaaagatgactggaggtggcatatgtatgacactggtaannggaagcgattgggctggnggacccagaattctatttcagtattatggggcagaaaggggacccaaagctgggtttagaggtttggagaacttgggactaccctttttcaaaaattgggaaagggaaagaattccccccggggcctttggggt

SEQ ID NO: 24748 - DNA, 664 bp, Zea mays
  misc_feature: Ceres CLONE 1396049-F
  misc_feature: Translation starting site: 166
  misc_feature (519)..(519): n is a, c, t, g, unknown, or other
  misc_feature (522)..(522): n is a, c, t, g, unknown, or other
  misc_feature (526)..(526): n is a, c, t, g, unknown, or other
  misc_feature (527)..(527): n is a, c, t, g, unknown, or other
  misc_feature (533)..(533): n is a, c, t, g, unknown, or other
  misc_feature (555)..(555): n is a, c, t, g, unknown, or other
  misc_feature (599)..(599): n is a, c, t, g, unknown, or other
  misc_feature (637)..(637): n is a, c, t, g, unknown, or other
  misc_feature (638)..(638): n is a, c, t, g, unknown, or other
  misc_feature (655)..(655): n is a, c, t, g, unknown, or other
ggagctccccgcggtggcggccgctctagaactagtggatcccccgggctgcaggaattcgcacgagaccattacctagaacatcctaatcgaaaaatcgcacaaatcctcttcctcgagttctcctcaaccaaattcaaagtcacagcggcgaaactctcggcgatgtctggccgcggcaagggcgggaagggtctgggcaagggcggcgccaagcgccaccgcaaggtgctgcgtgacaacatcgggcatcaccaagccggcgatcctcaggttggcgaggaggggcggcgtcaagcgcatctccgggctcatctacgaggagacccgcggcgtgctcaagatcttcctcgagaacgtcatcccgcgacgccgtcacctacaccgagcacgcccgccgcaagactgtgaccgccaatggacgttgtctacgctctcaagcgccagggccgacccctctacgggtttccggggggttaggtcgcccctctcccggtggcgaattacgtgggtggcggnggngggnncggtgntgtggtcttggtctaagttagnctggggtgccttttatcggggctggtttcctggggggggttggncttgctttcgttctagtttcctggtcccttggggctgnnttttctcccctgctggnttcccttgg

SEQ ID NO: 24749 - DNA, 621 bp, Zea mays
  misc_feature: Ceres CLONE 1396050-F
  misc_feature: Encodes the peptide sequence at SEQ ID NO. 24750
  misc_feature (172)..(172): n is a, c, t, g, unknown, or other
  misc_feature (284)..(284): n is a, c, t, g, unknown, or other
  misc_feature (287)..(287): n is a, c, t, g, unknown, or other
  misc_feature (351)..(351): n is a, c, t, g, unknown, or other
ggagctccccgcggtggcggccgctctagaatagtggatcccccgggctgcaggaattcgcacgagaccattacctagaacatcctaatcgaaaatggctgtttctgggagtgggcagcaacatggcagtgtttattggaagaaggcagccatgctgtgttatcctccttgnatgctagtaaaagcttgttatctcaactcaaggatgcatttttctacaatgaactcaccattatggatggatagtagcacaacaaagcaatgcaaagaaatagagatgcagntgnaggtgcactggagttaacaaaactgacaggatctcgtgcgtatgaaagattccctggccccccngattagggagatctatcaaacggcggcgtgatgtttatgaaaaacccgaaaagaatactttgggggaatcgggtcatgggatttaaatccttggttgaaaccttttccagtatttgtgtaaaactggggggggggggggaattaacttttttggaatttaagaaaagggcccctgggcaaaagtttgtttttaaaggaaactttcccccggaccttttaaaaaaaaatttgtggaaaattgtggcccccaaaatatttttgtgggggggg

SEQ ID NO: 24750 - protein, 69 aa, Zea mays
  misc_feature: Ceres CLONE 1396050-F
  misc_feature: SWISSPROT Homolog: EC 2.7.1.17 Xylulokinase
  misc_feature (26)..(26): Xaa is any aa, unknown, or other
  misc_feature (64)..(64): Xaa is any aa, unknown, or other
  misc_feature (65)..(65): Xaa is any aa, unknown, or other
MAVSGSGQQHGSVYWKKAAMLCYPPXMLVKACYLNSRMHFSTMNSPLWMDSSTTKQCKEIEMQXXVHWS

SEQ ID NO: 24751 - DNA, 705 bp, Zea mays
  misc_feature: Ceres CLONE 1396052-F
  misc_feature (137)..(137): n is a, c, t, g, unknown, or other
cgcggtggcggccgctctagaactagtggatcccccgggctgcaggaattcgcacgagaccattacctagaacatcctaatcgaaaaatagcctcctcgtctcctcgagaactgtagcatcacgcgccgcctttgtntgagcagggactgggagagaggagaagagagggtgaaagggggcaagaaaacgcttcttgttgcctttgtgcttcagcggatccgcggtggctgcgcacgccggcggggaagaggagtcgcgggcggcgcgcctccagtctttcttcgcctccgtgctctccgggctcttccggcagggcgaggccgaggacgaggaccgaggaccacaagagtccccgcgggaccgtaacgcttgccgggactgccgctccggaccattcaccttccaaaaccgtaggtggggttccctcttcttgggaattacctgggcgcggtcccggcctaagctgttccccatgaacccgggtaccccccccctggggcggatggggagaaccctactggggtctcccgccgccggcgctgggggagcctgcctttgacggaagagagtcctcccggccccctaccccatcgccttcctcctcgtggtgtggaatggaacggggtgccggcggccggccgcccgcccgggcggatcggcgccgcgcccccgcggcgcccggggcccgggcggcgccaccaccg

SEQ ID NO: 24752 - DNA, 779 bp, Zea mays
  misc_feature: Ceres CLONE 1396054-F
  misc_feature: Translation starting site: 364
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (484)..(484): n is a, c, t, g, unknown, or other
  misc_feature (486)..(486): n is a, c, t, g, unknown, or other
  misc_feature (487)..(487): n is a, c, t, g, unknown, or other
  misc_feature (491)..(491): n is a, c, t, g, unknown, or other
  misc_feature (495)..(495): n is a, c, t, g, unknown, or other
  misc_feature (496)..(496): n is a, c, t, g, unknown, or other
  misc_feature (507)..(507): n is a, c, t, g, unknown, or other
  misc_feature (508)..(508): n is a, c, t, g, unknown, or other
  misc_feature (547)..(547): n is a, c, t, g, unknown, or other
  misc_feature (575)..(575): n is a, c, t, g, unknown, or other
  misc_feature (601)..(601): n is a, c, t, g, unknown, or other
  misc_feature (611)..(611): n is a, c, t, g, unknown, or other
  misc_feature (627)..(627): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (661)..(661): n is a, c, t, g, unknown, or other
  misc_feature (662)..(662): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (704)..(704): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (774)..(774): n is a, c, t, g, unknown, or other
aaagctggagctccccgcggtggcggccgctctagaactagtggatcccccgggctgcaggaattcgcacgagaccattacctagaacatcctaatcaaaaattcccttctccatccacaactgtcctccacacacatccacacacgccacactgaggagccctgagccctccgcccttaaaccctagcgagcgagccagcgagaggtctcatccccaccaacaccacccatggagctccgcctctaccacctcgcgctgctgctcggcctcgtcgcctggggcggcggctgctgccacgggagccgaggcgcagccggtgtgcgacccctccatcatcgccacccagatcgcgctcttctgcatgccggacatgcccacggcgccctgctgcgagccgatcatcgcctccgcgacctcggggcggcggcgcctgtctgttttgggggggggggccgggggnnnngggggtttttttgtttttngnngggntttnnggggccccccnncctccttcggggttcttcggcttccctgggggggggccnccccccccgggggggggctccccctccnttgccggcctggccgggggcccgtcncccttccggnttccggttccctgttnttcgccccgnnnnncgccccgccggggccctcgnntttnnnnnnnncnnnnnnngnnngggcccccctcccccgtcngnnnnnnnnnnnnggggggnnnnnttcttcttnnnnnntctcnnnncnnnnnnnnnnnngnnnnctcttntgtgt

SEQ ID NO: 24753 - DNA, 665 bp, Zea mays
  misc_feature: Ceres CLONE 1396055-F
  misc_feature: Encodes the peptide sequence at SEQ ID NO. 24754
tccccgcggtggcggccgctctagaactagtggatcccccgggctgcaggaattcgcacgagaccattacctagaacatcctaatcgaaaaagcagagggccatcttctactcttctctcccagccaacccccttgtccaacggttcagcctgctcaattttagtgaccagttacggcaaatgcagccctcggcggacagcaggaagaagagccggcggcggcggaggaggaggaggctggcggcatgctactcatcgagacctgctgccggcgccgctcaaggccagtgtcagtgcggctcctctagccccggtggcggcggcggaagcggcagcctcgtggcaagaacaccgcgcgcgttctcgagctgctccagctacgccgcctcgtctgcctgcgcgccgggcggcggccgtccatctcggcacccagcacaagctgacggcgctcctcgtcgcgctcgcgctcctcctcgtcctccctcgcctctctcggtggaggggatccccgttgggtgtccccccgcaggaatggcgaagaatcccgcgcccggtgggagaggttcacataaaccccggcgggttccttggggagcgggagtgcccatatcctccaacggcttggcggcgcccaacaaacaaaggtctggaccagcgtgctcctc

SEQ ID NO: 24754 - protein, 161 aa, Zea mays
  misc_feature: Ceres CLONE 1396055-F
MQPSADSRKKSRRRRRRRRLAACYSSRPAAGAAQGQCQCGSSSPGGGGGSGSLVARTPRAFSSCSSYAASSACAPGGGRPSRHPAQADGAPRRARAPPRPPSPLSVEGIPVGCPPAGMAKNPAPGGRGSHKPRRVPWGAGVPISSNGLAAPNKQRSGPACS

SEQ ID NO: 24755 - DNA, 745 bp, Zea mays
  misc_feature: Ceres CLONE 1396059-F
  misc_feature: Encodes the peptide sequence at SEQ ID NO. 24756
  misc_feature (643)..(643): n is a, c, t, g, unknown, or other
  misc_feature (707)..(707): n is a, c, t, g, unknown, or other
aaaagctggagctccccgcggtggcggccgctctagaactagtggatcccccgggctgcaggaattcgcacgagaccattacctagaacatcctaatcgaaaaacctcgcgtggcctcccgttctgacttcggagtccctcggtctcaacgactagttgagagctcgcggctccgttcgggcgaggggaggaggttcatgaggctgctgtaggctccgttgcagccgccgcgggcgggagtccgtgattttggacgccccaccgcggcaagatccggaagcgcgttggctgttgtgccgtgagtttcagtttcggtggtcgattgcttcagcctgctgagaagtaggaggggcggccatggcggggtcgaggttcgggtcgttcaagtcggagaagggcgactccgcctccgcagcggcggcagcgggtggagcggcgcagaggagggacccgtacgaggtgctcggtgtgggccgcaccgccaccgaccaggagatcaagagtgcgttccgacgcatggcgctcaagtaccatccggacaagaatggcgatgaccctgttgcatcagacaggtttcaggaagtcacattctccctatacatcctgtcagatcccgataagaggcggcagtacgatacatcanggatttgatggcatcgaatctgatagtcaggaactggagctggacttgtcgagtctcacactgnaaaacacggggtttgcagctctttttagaaaagctggg

SEQ ID NO: 24756 - protein, 97 aa, Zea mays
  misc_feature: Ceres CLONE 1396059-F
  misc_feature (31)..(93): Pfam Name: DnaJ Pfam Description: DnaJ domain
  misc_feature (96)..(96): Xaa is any aa, unknown, or other
MAGSRFGSFKSEKGDSASAAAAAGGAAQRRDPYEVLGVGRTATDQEIKSAFRRMALKYHPDKNGDDPVASDRFQEVTFSLYILSDPDKRRQYDTSXI

SEQ ID NO: 24757 - DNA, 656 bp, Zea mays
  misc_feature: Ceres CLONE 1396060-F
  misc_feature: Encodes the peptide sequence at SEQ ID NO. 24758
tccccgcggtggcggccgctctagaactagtggatcccccgggctgcaggaattcgcacgagaccattacctagaacatcctaatcaaaaacgatcagccgggggtctaggattcctctctcaccatagcgcccgctctgtcgcccttcgttcagctctccttcctctcgtccctgactgccaggtataggggaagtcagaggcacggagtggtgcacagcacaggcgcgcgaaccattgtagctgtccctgtcgtcatcggcgtcaacgaacccacactaggaaaggatggagaacaagacgaccatcctcatgaacaggtacgagctcggaggcacgctcgggcagggtaccttcgccaaggtgtaccacggcggtaacctcgggtccggcgagagcgtgtccagcaaggtcatcgacaaggagaaggtgatgcgcgtgcagtatgatcgaccagacaagcgcgagaactccgtcatggcgctcgtccgcccccccaacgtcgtgtagctgcacgaggggatggtccgtaagaagcagataacttcccccatggagtaaacttccggggaggccaagttttcggcccgggttctcctcgcgggggggaaaatgggagaaactcacgataaagtgaatccctcaacctcccaccc

SEQ ID NO: 24758 - protein, 73 aa, Zea mays
  misc_feature: Ceres CLONE 1396060-F
  misc_feature: SWISSPROT Homolog: EC 2.7.11.1 Non-specific serine/threonine protein kinase
MENKTTILMNRYELGGTLGQGTFAKVYHGGNLGSGESVSSKVIDKEKVMRVQYDRPDKRENSVMALVRPPNVV

SEQ ID NO: 24759 - DNA, 666 bp, Zea mays
  misc_feature: Ceres CLONE 1396061-F
  misc_feature: Encodes the peptide sequence at SEQ ID NO. 24760
tggcggccgctctagaactagtggatcccccgggctgcaggaattcgcacgagaccattacctagaacatcctaatcgaaatctagaaatccacttcgattcgccctggacgctcctgcctcctgctagtcgacgcgcaatccttggcagatctggcagacaggtgaggcgctgagcctgctactactaactaggagccgcggcggcaaatgagggatgcggaggcggcgtcgcgccggcggtggacgctggtgctggtgaacatggcgtcggtgctggaaaggcagacgaggtgttgctgcccgccggtacaaggaggtggccacggagctgggcgcttcccgaccgcgctgggctccctcaccctctgccgcgcgctcgtccaggccgcctgctacccgctcgccgcctacgcctcgcggcgccacgatcgggcccgtgtcgatcggcgtgggagccttcctctgggacgccgccacctgcctcgtcgccgtctccggcagattcctccagatgcggatctcgcggtgtctcaacgggatcggacctcgcgctggtcgtcctagacgatctactcgatctccgtcgaatacgccgtatgatcgcacccggtgggcggcagagaacagggaggcctctatagacggcggggagccgcccgtatgc

SEQ ID NO: 24760 - protein, 118 aa, Zea mays
  misc_feature: Ceres CLONE 1396061-F
MRDAEAASRRRWTLVLVNMASVLERQTRCCCPPVQGGGHGAGRFPTALGSLTLCRALVQAACYPLAAYASRRHDRARVDRRGSLPLGRRHLPRRRLRQIPPDADLAVSQRDRTSRWSS

SEQ ID NO: 24761 - DNA, 768 bp, Zea mays
  misc_feature: Ceres CLONE 1396062-F
  misc_feature: Encodes the peptide sequence at SEQ ID NO. 24762
  misc_feature (297)..(297): n is a, c, t, g, unknown, or other
  misc_feature (625)..(625): n is a, c, t, g, unknown, or other
  misc_feature (626)..(626): n is a, c, t, g, unknown, or other
  misc_feature (654)..(654): n is a, c, t, g, unknown, or other
  misc_feature (658)..(658): n is a, c, t, g, unknown, or other
  misc_feature (704)..(704): n is a, c, t, g, unknown, or other
  misc_feature (705)..(705): n is a, c, t, g, unknown, or other
  misc_feature (714)..(714): n is a, c, t, g, unknown, or other
aaagctggagctccccgcggtggcggccgctctagaactagtggatcccccgggctgcaggaattcgcacgagaccattacctagaacatcctaatcaaaaatcgctctctcctttgcacccctagctagctagtactactgctgctcctccgacttgctcttcgcgcagcaggacggagaaacaagaaccatccctccccctaccggctaccgctgctactcatggtcgcgcgcactgcctcctggtgccgccgcgtatgatccagacatgaatagggcgcacagcagcagctccnagctcatcaacgagaagctcgtggaacaccggatctccactgcgaagcactgcccccactgcggcgagaaaatcgacagcaaaccggattgggtggggctgccggcaggcgtcaagttcgatccaactgaccaggagctgatcgagcacctcgaggcgaaagtgaaggatgaaggctcgagatctcaccctctcatcgacgagttctacccacaatagatgggggaggacggcatatgttacacccaccccgagaaacttccaggtgtgacaagggatggcctaagcaagcacttctttcaccggccgtccaaggcctacacgacggnncacgagggaagaagaggaagatacagangggnagtgcgacgtccacaaggggggggagacgaggtggcacagaccggnnagacgcggncccggtggatgggtgacggccccctcaaaagggtgcaaaaaaaaaaatatttgt

SEQ ID NO: 24762 - protein, 81 aa, Zea mays
  misc_feature: Ceres CLONE 1396062-F
  misc_feature (10)..(10): Xaa is any aa, unknown, or other
MNRAHSSSSXLINEKLVEHRISTAKHCPHCGEKIDSKPDWVGLPAGVKFDPTDQELIEHLEAKVKDEGSRSHPLIDEFYPQ

SEQ ID NO: 24763 - DNA, 698 bp, Zea mays
  misc_feature: Ceres CLONE 1396063-F
  misc_feature: Encodes the peptide sequence at SEQ ID NO. 24764
  misc_feature (549)..(549): n is a, c, t, g, unknown, or other
ggagctccccgcggtggcggccgctctagaactagtggatcccccgggctgcaggaattcgcacgagaccattacctagaacatactaatcgaaaaattttcggccacaccctccttgcctccacggctccacccctgcttcaggttacctgtgccagcgacgccggtagaagccatggacagctctctcgcgagcgcggcggcgatagccgatcagcgccagaagatcgagcaggaccgccacatcctcgcctccgtcctctcgtcttccccaccggacatctctcaggccaagcgctttctcgaccacatggtgttcggacgaagttccgactcgtggtgtcgcgtcaattggctccagacgcttcgcgcaggacctaggtgaagctggagtcggacgcgcataaaggagcgttgcccactacgcgctcacgcagatccaagccggcgtgtggcctccttcgaggagcaagggtgggtagtgattagaagagaagcttgcagagctattatgagtctggaacaacaatgggtcaaaagcagacaaantgcttaaatgggggattggacttggagttcaggattcaggaatgcttgatgaacaccaacaattaattcccaagtggtgttccaaattgcacgatcctattttaaaaagaatggatgaatgcagtgaaatggctgaggcttttataaac

SEQ ID NO: 24764 - protein, 69 aa, Zea mays
  misc_feature: Ceres CLONE 1396063-F
MDSSLASAAAIADQRQKIEQDRHILASVLSSSPPDISQAKRFLDHMVFGRSSDSWCRVNWLQTLRAGPR

SEQ ID NO: 24765 - DNA, 719 bp, Zea mays
  misc_feature: Ceres CLONE 1396064-F
  misc_feature: Translation starting site: 442
caaagctggagctccccgcggtggcggccgctctagaactagtggatcccccgggctgcaggaattcgcacgagaccattacctagaacatcctaatcgaaaaagaggctcttatctgcagctctttttgccgcccgataatgcgcgttgccgactcacagattcccctccccaccaccaccccagcccgccgggaagggggagcctcggaagcgcacaccgtcgctgctgggcctgaacgcacaggacacggcgccgtactgcaatcgcgctccataatgtggtctctggcggaggacgtcgagcacgtccatggccagcgctcacgagggtgacgcgctggcatccaagtcttcttcggcgtcgatgcgactctctcaaatcggtcctcgccgtcgaggatcgcgcgccgaccagtgatttcctgctcatcaggcaggaatgggccgccgtcgctatccataccgcctacctagtattcttggcgagacgttgctgaaggcgctgaggcacatcgtccagatgcatgtgctggtgcacgaacggatggtgtttatataactggacggcacgcatcagtgcatgcactatctgctgcgagtgcaggaacacaaccgggaacggcggacgcgctcctccgctggatggcacagatcacaggtccaggactgaatcaacgattgcgcatgtacaaccgagagcctatggaagaatgaagg

SEQ ID NO: 24766 - DNA, 738 bp, Zea mays
  misc_feature: Ceres CLONE 1396065-F
  misc_feature: Encodes the peptide sequence at SEQ ID NO. 24767
  misc_feature (596)..(596): n is a, c, t, g, unknown, or other
  misc_feature (637)..(637): n is a, c, t, g, unknown, or other
  misc_feature (654)..(654): n is a, c, t, g, unknown, or other
aaagctggagctccccgcggtggcggccgctctataactagtggatcccccgggctgcaggaattcgcacgagaccattacctagaacatccaatcgaaaactccatcactgattctgattctgattccagccaccctgaccggcgaagcgcggctgacatttcccccccaccataccgccaccacctgagaagagatcgatccaatcagattaaccaattagcagggagggaggagaggggcaaaggcaatggccgggacggaggtggaggacccgccggcggcggcgttggaggtgcccgcgaaacgcggccttctgcggtacaactcgccgctggcgcaggtgtccctgctgggcctcatctgcttctgctgccccaggatgttcaacgcgctgtcgggcctcggcggcggaggccaggtcgaccccaccatcgccgactacgccaacaccgcgctctacgcctgcttcgcggtgttcggcgtgctgggcggcgccgcgcacaacctgctgggcccgcgcgcgacgctgctgggcggagcgctcacgtacccgctctacgccggctccttcctctactacaaccaccgcccgnactcgcaggtgtcgcccggtcacggcgggcgcctggctcgncgaccgagaggctttcntcttgggggggccgcaggtcgtccaacatgaacctccaagccggccccccaaacgaccgggggaagctacatctcccctttaag

SEQ ID NO: 24767 - protein, 144 aa, Zea mays
  misc_feature: Ceres CLONE 1396065-F
  misc_feature (116)..(116): Xaa is any aa, unknown, or other
  misc_feature (135)..(135): Xaa is any aa, unknown, or other
MAGTEVEDPPAAALEVPAKRGLLRYNSPLAQVSLLGLICFCCPRMFNALSGLGGGGQVDPTIADYANTALYACFAVFGVLGGAAHNLLGPRATLLGGALTYPLYAGSFLYYNHRPXSQVSPGHGGRLARRPRGFXLGGAAGRPT

SEQ ID NO: 24768 - DNA, 702 bp, Zea mays
  misc_feature: Ceres CLONE 1396069-F
  misc_feature: Encodes the peptide sequence at SEQ ID NO. 24769
  misc_feature (702)..(702): n is a, c, t, g, unknown, or other
tggagctccccgcggtggcggccgctctagaactagtggatcccccgggctgcaggaattcgcacgagaccattacctagaacatcctaatccgaaaactcctctcgctcgcgtccgcacaaatcccgtgctcccccgtctgaaaaccctccccacctccggcggtggcggcggcgctggcgaccgggtgtcttctccggcgagtctcccccctagcaacaagaaaatatggatgtacctgttgatgaccctgtggagaacctcactggaagacctagtacccttgcaatgaggaagaagccactacttatgctaatgtggaagatcagtccaaggaagaaccagaaaagctttacgaggaacccaaagacccaatgcaagaggagttgagtaaccaagggcatgtgagcatgaacaatgaagatgtgagaggccagcaaagtggaccaagctacccccacagagcacggcgaggaagctgtcgtgaagcagcatgatgctacagttcctgaggacaagaattgggcctgcgtgcctggcaagagaagtgtgttcccgtatactggctcctacaacaaagaggtggggtggccgtcattggggcgccaaagggggatttccttcaaaaaaaatggtgtgaggcaatcaagagcccccgccatccaaggtttcctggaggggaaccacccagggtgtgcccan

SEQ ID NO: 24769 - protein, 40 aa, Zea mays
  misc_feature: Ceres CLONE 1396069-F
MQEELSNQGHVSMNNEDVRGQQSGPSYPHRARRGSCREAA

SEQ ID NO: 24770 - DNA, 675 bp, Zea mays
  misc_feature: Ceres CLONE 1396071-F
  misc_feature: Translation starting site: 169
  misc_feature (552)..(552): n is a, c, t, g, unknown, or other
tccccgcggtggcggccgctctagaactagtggatcccccgggctgcaggaattcgcacgagaccattacctagaacatcctaatcaaaatcccttctccgccgccacgctagagaggaagagcgcgcggagagcgagagcccgggagaaacagcggccggcggcaaaatggtgcagcggctcacctaccggaagcgccacagctacgccacaaaatccaatcagacccgcgtggtcaagacccctggtgggaggcttgtgtaccagtacaccaagaagcgcgcgagcggaccgaaatgcccggtcaccgtggaagaagatccaaggaattccacacctgagacctgctgagtacaagaaggtctaggttgccaaggaaccgcaggactgtgaccgcccttataggggggtgttctgctgggtaccgcagtcagagagaggatctccgtggactttttgcgcgaggagcagaaatccccgggaacaggggtttgaacagccaacagaccaggggatagggactccatgaagttggcgatatagggtcttccncaaagggtcaagggcccttaaatatggaaatgggtaaattttcgagcggaagagtggcggatcccttttatttttttaaaatccccggggggaatggttttcactcgccccaggggggggggg

SEQ ID NO: 24771 - DNA, 678 bp, Zea mays
  misc_feature: Ceres CLONE 1396073-F
  misc_feature: Encodes the peptide sequence at SEQ ID NO. 24772
  misc_feature (233)..(233): n is a, c, t, g, unknown, or other
  misc_feature (307)..(307): n is a, c, t, g, unknown, or other
  misc_feature (308)..(308): n is a, c, t, g, unknown, or other
  misc_feature (389)..(389): n is a, c, t, g, unknown, or other
  misc_feature (394)..(394): n is a, c, t, g, unknown, or other
aaagctggagctccccgcggtggcggccgctctagaactagtggatcccccgggctgcaggaattcgcacgagaccattacctagaacatcctaatcgaaaaacggatcaaaatcgaatccaacgctactgcctagggtttcctctgcatttcccctaccacaccccgcgccgcccacccatggccgccgcagacgcgtccgccgagaccgccgccatcgcgcggcgcctggnctcctgcaacaccggcacccgggagcgcgcgctccgctacctcctctccgaatttctagcaggctgccgcgcgnngctctccagccactgactcatcaaggtctggaagggcatcttactctgctgctggcacgccgacatgcgctctacgagagntcgtngcctcggctccgccgtctccgtcccgcgtcccccgcgatggagcagcttacttcgcggctacctcacaaggtccgcggggagggggaacatcgagggcccccccctgaaaaaattaacctctttaccggcggtccttcccaaggccttctgggttccgggggaaactccttccccccccaaggacccttcaagggggggccccctctgaaaaaaaggcgcttctcccgaaaacaaaaaagtgcccctttcccctcccgggggccggggaaaccccccccaaagg

SEQ ID NO: 24772 - protein, 47 aa, Zea mays
  misc_feature: Ceres CLONE 1396073-F
  misc_feature (18)..(18): Xaa is any aa, unknown, or other
  misc_feature (43)..(43): Xaa is any aa, unknown, or other
MAAADASAETAAIARRLXSCNTGTRERALRYLLSEFLAGCRAXLSSH

SEQ ID NO: 24773 - DNA, 758 bp, Zea mays
  misc_feature: Ceres CLONE 1396076-F
  misc_feature: Encodes the peptide sequence at SEQ ID NO. 24774
  misc_feature (1)..(1): n is a, c, t, g, unknown, or other
  misc_feature (304)..(304): n is a, c, t, g, unknown, or other
  misc_feature (305)..(305): n is a, c, t, g, unknown, or other
  misc_feature (362)..(362): n is a, c, t, g, unknown, or other
  misc_feature (405)..(405): n is a, c, t, g, unknown, or other
  misc_feature (407)..(407): n is a, c, t, g, unknown, or other
  misc_feature (443)..(443): n is a, c, t, g, unknown, or other
  misc_feature (447)..(447): n is a, c, t, g, unknown, or other
naaaagctggagctccaccgcggtggcggccgctctagaactagtggatcccccgggctgcaggaattcgcacgagaccattacctagaacatcctaatcgaaaaccaatccccgccttcctcggttccctcaccgcgaaccctaaccctagtccaccccgctcccatggacgaggatgctggcggcgcctcgccgccgccggtgccactggctcacgtgccccctcttcagcaacccaccaccgccgccccctcgcatcgggacatggcggcgtcccccaccagctcgcgctccgtgacggannacgtgaacggctcccaccgcttcgtgatccagggctactcgctcgccagggcatggncgtgggaagcacatcgccgggagaccttctcggggcggatacnangggcggcctactccaccccgacgttaaaaccccganaaantccgttaaagtttccgtttcaatgcctcgtttcaagggagaccaaaggggggggccctttaaatcaggctcctgttcaaaggggaggggaaacaaaaggcccccccctttgaccgtccggggggccgggggcaaacccccaaagccggggtccgggggggggaaaaaaaattttttcggggaaaggcccttaaaaaaaacatccaaaaaagggggggaaaaaaaaccgcgcgggggggggggggggggaaaattaaaaaaccacccccctttttttttgtggaaaaaaaaaagtatatttgttgttccggt

SEQ ID NO: 24774 - protein, 130 aa, Zea mays
  misc_feature: Ceres CLONE 1396076-F
  misc_feature (46)..(46): Xaa is any aa, unknown, or other
  misc_feature (47)..(47): Xaa is any aa, unknown, or other
  misc_feature (66)..(66): Xaa is any aa, unknown, or other
  misc_feature (80)..(80): Xaa is any aa, unknown, or other
  misc_feature (81)..(81): Xaa is any aa, unknown, or other
  misc_feature (93)..(93): Xaa is any aa, unknown, or other
  misc_feature (94)..(94): Xaa is any aa, unknown, or other
MDEDAGGASPPPVPLAHVPPLQQPTTAAPSHRDMAASPTSSRSVTXXVNGSHRFVIQGYSLARAWXWEAHRRETFSGRIXXAAYSTPTLKPRXXPLKFPFQCLVSRETKGGGPLNQAPVQRGGETKGPPL

SEQ ID NO: 24775 - DNA, 650 bp, Zea mays
  misc_feature: Ceres CLONE 1396077-F
  misc_feature: Encodes the peptide sequence at SEQ ID NO. 24776
cgcggtggcggccgcggtcccggtagggtcgacggcgctcccccgagtcccccgcgtcgagcgtcgtcacgaaaaagtacatcggagctcgtggacgagaagctcggcgacgcgaggatcgagctgatgagcaaggtcgtcaacgtctactgctcctacggcctctcccacgtacgacctccgcgccaagatctccttctgcgacacgctcatccttggagctgcgagcaagatcccgcgggacgcccatgaggcgtctggtgccattgacccgggcgacgtacgcgtctcgggcgccgcatagtaggagcgatggggcgccggaagatgtccgcggcggcaccgacgtctcggagctggtccaacgttggcggaagcgtcatcccggaacttcgagctaaacacaaaacagacttggagaatatgacgctgaccaaacagccactcagaacattgcattttgtcctattagccatgttacaatacttgaaaagattagcaacatatatcctgaagtaaagggtggtttcttctttctcctaatagttttattggtagcttctggaatcttgctcgccgttttcggatggtctgcataacaagcatgggcaggaattccataataagctaaatttggggcagtgggtgaa

SEQ ID NO: 24776 - protein, 68 aa, Zea mays
  misc_feature: Ceres CLONE 1396077-F
MGRRKMSAAAPTSRSWSNVGGSVIPELRAKHKTDLENMTLTKQPLRTLHFVLLAMLQYLKRLATYILK

SEQ ID NO: 24777 - DNA, 766 bp, Zea mays
  misc_feature: Ceres CLONE 1396078-F
  misc_feature: Encodes the peptide sequence at SEQ ID NO. 24778
  misc_feature (380)..(380): n is a, c, t, g, unknown, or other
  misc_feature (433)..(433): n is a, c, t, g, unknown, or other
  misc_feature (511)..(511): n is a, c, t, g, unknown, or other
  misc_feature (530)..(530): n is a, c, t, g, unknown, or other
  misc_feature (659)..(659): n is a, c, t, g, unknown, or other
  misc_feature (709)..(709): n is a, c, t, g, unknown, or other
  misc_feature (710)..(710): n is a, c, t, g, unknown, or other
aaagctggagctccccgcggtggcggccgctctagaactagtggatcccccgggctgcaggaattcgcacgagaccattacctagaacatcctaatcgaaaaacttgcgcatcggatcgcatcagctgctgcttttgtccaccaagcaacgattccctttccttccgccgcccaaatgccagtggccaccttcctcctcgtcgcgcttctctcgtgcggcgcacgagccatccggacgcacggcggctatgtctccgcggtcggggaccccggcatgcggcgcgacggcctccgcgtggcatgggaggcgtggaacttctgcaacgaggtcggccaggaggcccccggcatgggcagcccccgcggtgccgattgcttcnatcttctcggtccgtccattccatctctttctctcctctttcgccggggtggntttgagtgggttgccaccaagattaggtttttgaggaagcgtggatcctctgttccgttccgcagaacgagctccacnaaggaagggggccggcggngggaactcggtgggcgcacctgggtgagcgacgccgacaccgccctggggcgcgggcgacccccgttcccggggtcccccgcccgggcgcggcccggcgttcacgaacggccgacttctacgcgccggnccaaggagctggaccctcggcgaccgctggcaggtggccgaaaccccggnngcccggggaaaatttctggatgggccatggctcaaaaacgggaaacctcgacacaa

SEQ ID NO: 24778 - protein, 197 aa, Zea mays
  misc_feature: Ceres CLONE 1396078-F
  misc_feature (69)..(69): Xaa is any aa, unknown, or other
  misc_feature (119)..(119): Xaa is any aa, unknown, or other
  misc_feature (162)..(162): Xaa is any aa, unknown, or other
  misc_feature (179)..(179): Xaa is any aa, unknown, or other
MPVATFLLVALLSCGARAIRTHGGYVSAVGDPGMRRDGLRVAWEAWNFCNEVGQEAPGMGSPRGADCFXLLGPSIPSLSLLFRRGGFEWVATKIRFLRKRGSSVPFRRTSSTKEGGRRXELGGRTWVSDADTALGRGRPPFPGSPARARPGVHERPTSTRRXKELDPRRPLAGGRNPGXPGKISGWAMAQKRETSTQ

SEQ ID NO: 24779 - DNA, 741 bp, Zea mays
  misc_feature: Ceres CLONE 1396080-F
  misc_feature: Encodes the peptide sequence at SEQ ID NO. 24780
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (409)..(409): n is a, c, t, g, unknown, or other
  misc_feature (412)..(412): n is a, c, t, g, unknown, or other
  misc_feature (413)..(413): n is a, c, t, g, unknown, or other
  misc_feature (457)..(457): n is a, c, t, g, unknown, or other
  misc_feature (459)..(459): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (534)..(534): n is a, c, t, g, unknown, or other
  misc_feature (545)..(545): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (555)..(555): n is a, c, t, g, unknown, or other
  misc_feature (558)..(558): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (565)..(565): n is a, c, t, g, unknown, or other
  misc_feature (566)..(566): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (741)..(741): n is a, c, t, g, unknown, or other
caaagctggagctccccgcggtggcggccgctctagaactagtggatcccccgggctgcaggaattcgcacgagaccattacctaagaacatcctaatcgaaaactttcagcggagcgcggcggcaagatggcagtgcaaatatccaagaagaggaagtttgtcgctgatggcatcttcaaagctgaactgaatgagtttcttactcgggagctggctgaagatggctactctggagttgaggtgcgagttacaccaaccaggacagaaatcattatcttagccatcagaacacagaatgtttcttggtgagaagggccggcggattcgggaactgactgctgtagtttcagaagaaggtttggctttccagagggcagtgtagagcttttatgctgaaagggnnnccntannagggtctgtgtgccattgccccaggcagagtctctgcgttacancntccttagagggcttgcttttgtgcgagggcttggctatgnnnngtgctgcggtcatcattgggagagtgggcaanggcttcgaagnttttnnntgnttnttnnnannaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntn

SEQ ID NO: 24780 - protein, 60 aa, Zea mays
  misc_feature: Ceres CLONE 1396080-F
MAVQISKKRKFVADGIFKAELNEFLTRELAEDGYSGVEVRVTPTRTEIIILAIRTQNVSW

SEQ ID NO: 24781 - DNA, 747 bp, Zea mays
  misc_feature: Ceres CLONE 1396081-F
  misc_feature: Translation starting site: 176
  misc_feature (511)..(511): n is a, c, t, g, unknown, or other
  misc_feature (559)..(559): n is a, c, t, g, unknown, or other
  misc_feature (612)..(612): n is a, c, t, g, unknown, or other
  misc_feature (630)..(630): n is a, c, t, g, unknown, or other
  misc_feature (631)..(631): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (676)..(676): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (734)..(734): n is a, c, t, g, unknown, or other
  misc_feature (735)..(735): n is a, c, t, g, unknown, or other
caaagctggagctccccgcggtggcggccgctctagaactagtggatcccccgggctgcaggaattcgcacgagaccattacctagaacatcctaaaaaaaaagcagtccaaacacgcaacgcaacactcgccttcccctcccaaccctccgaaccgaagcagcaaagctagacgatgacgctgacgatcccggacgaggtgcgcgccaaggcggaggtgtacgtgggcgacgcggcggggcaggagaagacgcggctgctcctccaggagacgggcctcccgagcgggctgctcccgctgcgggacatcatcgagtgcggctacgtggaggagacgggcttcgtgtggctccggcagcgccgcaaggtggaccactacttcgccaaggccggccgccacgtgtcctacggcgccgaggtggtcggcggtggccgacaagggccggctcaagaagatcacgggcgtcaaggccaaggagatggctgctgtgggtcaccctccacgagatcntgcgtcgacgacccgcccactggtaagctccactggcaggccatcggnggcctgtccgcagctcccccgcgagggctccgaggcccgagaccgcgcgcggnaaccccggggcccccccnnggacgcggggggggggnnnnnnnnnnnnnnnnnnnnnnnnnnncncccgccggnnnnnncgnnnnnnnccgnnnnnggcggcccccggggggggggggggggnnggcgggcgcggc

SEQ ID NO: 24782 - DNA, 729 bp, Zea mays
  misc_feature: Ceres CLONE 1396083-F
  misc_feature: Translation starting site: 509
  misc_feature: Pfam Name: MATH Pfam Description: MATH domain
gctctagaactagtgcatcccccgggctgcacgaattcgcacgagaccattacctagaacatcctaatcgaaaagcaatactggccttgcttggctccctccccgtgaaccctaaccctactccaccccgctactatggacgtaggatgctggcggcgtatccccaccgacggtgccactggctaacgtgcatcctcttcagcaacacaccaccgacgacccctcgcatcgggacatggcggcgtccaccaccagctcgcgctccgggacccagagagtgaaccggctccaaccgctccgtgatacagggctactcgttcgccccgggcatgggcgtgcggaagcacatcccccagcgagaccttctccgtgatcggataccagtgggcgcactacttctaccgcggaggggaagaaccccggaggacaacttccggctacgtctccgtcttcctcgacctcgcttccgatgaaaccgacgtgcgagccctcttccaagccccgctccatgatcagagcggcaagggtaatgccaaggtacactccccactttgaccgctccatggaatcccgggccagaaaccactcaggtaccgcggaataactgtggcggttcaagacattctattcggggaaatggccgctgaacaatcccaaatacctcaacgatgatttgtgtgaaaaacaaatggcccggcgggacaaaatcggggcggaatattcgattaa

SEQ ID NO: 24783 - DNA, 765 bp, Zea mays
  misc_feature: Ceres CLONE 1396085-F
tcaccgcggtggcggccgctctagaactagtggatcccccgggctgcaggaattcgcacgagaccattacctagaacatcctaatccaaaaaatctctctcttctcctcgcctcgccttggtgttcacgccgtcgctagcgcctgccgcggtgaagcttctgccctccccggcgccaggctcgggtcgtcgtcggtcaggcagctgctacgcgtgaacacggtgacaccactacggcagaccacgcgacgtgaatggtgaactcgtgaagaacagacccccactgaggaaaccctagcgacgggtgcgtgctacgggggaaatttgtccccctcgggccctggatccctggacgcattcgggcgcccgccttggatgaaaacccagcccccttatttttagaacaaggggctagtctttgggctgactcttgggcggacgttgacgcccggaatggcagggggttaactcgtgtgggggtaggggccctctatatattataatggctaactcacaaatacctctttctaaaattaatggtgggaagcctctttatctaacacacccccatcacccgtcgcggcgccaacaagagggaggtatagtcttcacgaggatgctatttaaattttactagattcagtgagaatcggatataagagaacgtgtgacacactgccagatgtggccaatcactgaggcccggctcatgaccgccgatggagaggagacgagagggatccagctacgttcgtggagggatata

SEQ ID NO: 24784 - DNA, 672 bp, Zea mays
  misc_feature: Ceres CLONE 1396089-F
  misc_feature: Encodes the peptide sequence at SEQ ID NO. 24785
  misc_feature (338)..(338): n is a, c, t, g, unknown, or other
  misc_feature (388)..(388): n is a, c, t, g, unknown, or other
  misc_feature (467)..(467): n is a, c, t, g, unknown, or other
  misc_feature (513)..(513): n is a, c, t, g, unknown, or other
  misc_feature (613)..(613): n is a, c, t, g, unknown, or other
  misc_feature (617)..(617): n is a, c, t, g, unknown, or other
  misc_feature (624)..(624): n is a, c, t, g, unknown, or other
  misc_feature (626)..(626): n is a, c, t, g, unknown, or other
  misc_feature (660)..(660): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (669)..(669): n is a, c, t, g, unknown, or other
tggcggccgctctagaactagtggatcccccgggctgcaggaattcgcacgagaccattacctagaacatcctaatcgaaaaacataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcatcgtgggcgggcggcacggccgggtgcccgctggccgccacgctgtcgagcngcttccgcgtgctgctgctggagcgcggcgcctcgccctacgacgacgancgcatcggggacatggcccgcttcgcggacacgctgtcggacacctccccgggctcgcccgcgcagcgctttcgtgtcnggaggacggcgtcatcaactcgcggcccgcgggtgctgggcggcgncagctgcatcaacgccggcttctacacgcgggccagcgacgactacgtgcgggggcgtcgggtgggaactgggcgccgcccgggggggcgaaccgggggntggnaggcccngngggcttccaagccgaaactgggcccctggaaggnccnnnnngnggt

SEQ ID NO: 24785 - protein, 86 aa, Zea mays
  misc_feature: Ceres CLONE 1396089-F
  misc_feature (23)..(23): Xaa is any aa, unknown, or other
  misc_feature (38)..(38): Xaa is any aa, unknown, or other
  misc_feature (73)..(73): Xaa is any aa, unknown, or other
  misc_feature (75)..(75): Xaa is any aa, unknown, or other
  misc_feature (76)..(76): Xaa is any aa, unknown, or other
MARFADTLSDTSPGSPAQRFRVXRTASSTRGPRVLGGXSCINAGFYTRASDDYVRGRRVGTGRRPGGRTGGWXAXXASKPKLGPWK

SEQ ID NO: 24786 - DNA, 681 bp, Zea mays
  misc_feature: Ceres CLONE 1396091-F
  misc_feature: Encodes the peptide sequence at SEQ ID NO. 24787
ccaagctggagctccccgcggtggcggccgctctagaactagtggatcccccgggctgcaggaattcgcacgagaccattacctagaacatcctaatcgaaaaaattttcttttagaaaacaagcaggcatcacctaattacttgtcctcgctcctctgaactactatatccagtccttaatccgatgccaattcctactggtctctgatcgccatgatccgcgtgtttttgggagcataaatgtgcagcgcagtccctgtgacaagctcctgtaacctcaatacaagctatgcagcagctcgtggcgttgctggtactgatctccctccccgtgcgcgcggcgcctgtctccggcgccggcgtcgtggtggcgctgttcacgcactccgacgccggccgcggcttcgcgaggcccgagctcgtgcggcgaatggcgcaccgagccagggcgcgccgccggctcctgtcctcgcacgaacgccccgtgcgcgcgcggatgcgcgcagggctcgtcgccgccgccggaggaattgcgacgaacgagtatctggcgcacctgtgggtcggcacgccgccgcggcccgtggagctcacgctcgacaccggcagcgacctcgtctggacgcagtgcgcgtcctgacacgagtgtttcgaccatggtatcccgctcctggaccccg

SEQ ID NO: 24787 - protein, 116 aa, Zea mays
  misc_feature: Ceres CLONE 1396091-F
  misc_feature: SWISSPROT Homolog: EC 3.4.23.12 Nepenthesin
MQQLVALLVLISLPVRAAPVSGAGVVVALFTHSDAGRGFARPELVRRMAHRARARRRLLSSHERPVRARMRAGLVAAAGGIATNEYLAHLWVGTPPRPVELTLDTGSDLVWTQCAS

SEQ ID NO: 24788 - DNA, 742 bp, Zea mays
  misc_feature: Ceres CLONE 1396097-F
  misc_feature (532)..(532): n is a, c, t, g, unknown, or other
  misc_feature (644)..(644): n is a, c, t, g, unknown, or other
caaagctggagctccccgcggtggcggccgctctagaactagtggatcccccgggctgcaggaattcgcacgagaccattacctagaacatcctaatcgaaaagattttcttcacccgtccacctcgtcttgcgctcctctgtctcggcgacgactgtgctaccgccgccgccgccgcaagacttcgtcgggcactttgccggcgacgatttcccaccagcccaacaggatcagaggaggtgatggcgaggagtgacagctgcctggcgcgcgtgggtgccggaattgctatcggtggcgcggtcggcggagccgtcggtaaccttcgtccctaaacccctaaacactaggcttgcagcatcaatccgtccgtgcgagccgcttcacccgtcggtgtttttttttttggttggaagtagataagtgtgcgatttcaggaatcttctcgagctagctagtagtacatccctgggttttgtgtggttagctagcggcagatgtaataactagggtggctttttgttaagagttnactagtgcttaggtagcatcatctggggagtggaagatatcgatgctcgagagttggaagtttgtttgccccccaattgcttgtgctcctaagggctgttggctgattcggnccctgcccgggggttttggttaacctttcctgctgggggcttaaaaactttgggatggaaaaaatgggaagattttgggaatttgcccttttgatttt

SEQ ID NO: 24789 - DNA, 761 bp, Zea mays
  misc_feature: Ceres CLONE 1396099-F
  misc_feature: Translation starting site: 323
  misc_feature (24)..(24): n is a, c, t, g, unknown, or other
  misc_feature (164)..(164): n is a, c, t, g, unknown, or other
  misc_feature (165)..(165): n is a, c, t, g, unknown, or other
  misc_feature (180)..(180): n is a, c, t, g, unknown, or other
  misc_feature (315)..(315): n is a, c, t, g, unknown, or other
  misc_feature (362)..(362): n is a, c, t, g, unknown, or other
  misc_feature (396)..(396): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (460)..(460): n is a, c, t, g, unknown, or other
caaagctgggagctccaccgcggngggcggccgcttctagaacttagtgggattccccccgggcttgcaggaaattcgcacgagaccatttaaccctaagaacattcctaatcgaaaaagaagcagaagcttgagcttgccttccaacttcccgacccacaccnnaacggcacgggcaangtcggcagcagcccagcgttgagcgcagtgccctcttgtctgctgcctcctacctccccgcccagtctcactcacacgctcccacttccgagtctcgctcgcagcctgttctcctggggtccgatcggagggggntgaggagatggagccagatttcgcgacgacgaggctcgcattgctgncgctgcttctcctggcggcgcccgcccgcccggnctcgnnnggtcgggtgggagatggcctgctcaggcatgttgactttgaaacgcacccagccggncgtttttgaagaacctgcctctggtgctgaaggtgcatcctcaatccctgggtggaacaacaaggggacattcaaggttctttccaaaggccagcaccaggggggtatggtcctgatttgtcccccagagaaacttttttaaaagcttaagaaatgtttttccttgtgcaaggggggggcccccaaaaaacttccaaaaaaatttttacattttcgggtgcccgcgagtgggccaatggggggccctatcccctcctcttaggggggggcccccaaaaaatattttccccgcttccacaaa

SEQ ID NO: 24790 - DNA, 722 bp, Zea mays
  misc_feature: Ceres CLONE 1396102-F
  misc_feature (186)..(186): n is a, c, t, g, unknown, or other
  misc_feature (338)..(338): n is a, c, t, g, unknown, or other
  misc_feature (501)..(501): n is a, c, t, g, unknown, or other
  misc_feature (554)..(554): n is a, c, t, g, unknown, or other
  misc_feature (612)..(612): n is a, c, t, g, unknown, or other
  misc_feature (626)..(626): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (665)..(665): n is a, c, t, g, unknown, or other
  misc_feature (676)..(676): n is a, c, t, g, unknown, or other
  misc_feature (692)..(692): n is a, c, t, g, unknown, or other
  misc_feature (693)..(693): n is a, c, t, g, unknown, or other
aagctggagctccccgcggtggcggccgctctagaactagtggatcccccgggctgcaggaattcgcacgagaccattacctagaacatcctaatcgaaaaatgctgggaccgcgggtgtgggatagggacggatgacaaagcaagagcagaaaaaagaactttcaccatcctccctatcaatacnagattcatctacacaaattataatatactccgtgcgaaggaaagatcaaattagagattcattcgatcaattctgattgtttccttccattccaaaccaccttcaattctgatttctgcgggtgtgggatatcgtccccccttgccattccnaatcctcctctgcaattttctcatggcagctgacgtttccatcccaactcgatccgcgtcaaccgcccgctaattcctcctagttctagtcccctctctcctgcgccgactcatctttttcctcgtgtcactcccctgctgctgctgctgccgggaagatcanatcccgtcaaaagctccaaagggattcagaagtctgtcaagatggcatgcccnagaggaaggacaccattttccctttgtttcttttctgatgatttggctcagggctcanctgggagctttccnatgttgtactcatggcgacaacactacccttgtcnnntnggatgatgtcnaggcacttttactccnncagggggaagttccagggggtaagtggcg

SEQ ID NO: 24791 - DNA, 761 bp, Zea mays
  misc_feature: Ceres CLONE 1396115-F
  misc_feature: Translation starting site: 345
  misc_feature (522)..(522): n is a, c, t, g, unknown, or other
  misc_feature (642)..(642): n is a, c, t, g, unknown, or other
  misc_feature (693)..(693): n is a, c, t, g, unknown, or other
  misc_feature (717)..(717): n is a, c, t, g, unknown, or other
  misc_feature (718)..(718): n is a, c, t, g, unknown, or other
caaagctggagctccccgcggtggcggccgctctagaactagtggatcccccgggctgcaggaattcgcacgagaccattacctagaacatcctaatcaaaacgaaggaacctgctcggcctcgccgtccccggcgcgtggagcgcgtcgcgtccgccacacgcaccgaccatcccctgccctcatcagcaatccccggcccgcagcgtacaaatacacgctccccgccgctccgacctcactttccccgcctccatcaccaattcacgatctcctttcccgcaccgcgccccggatcgccggctcgcaattccggagttaaattcccctccaccgcaaccgtcatgggcggctcccacagccgcgaggacgtcgatctcacctcctccgacgaagaggaggaattcgaggacgactatgacgcccgatcacccatcgcggaggccgcagcgagcgcggggcagcgcgacgacaacctcctccgcaccgccacaccttcctcgcttgaggccatcgacgccnagcttcaggtcgctggatctcaagtaccagagacctaccgccgccagctctacctcccacgggtcggcggggcctcgcctttcgggcgcgctggggtgccccgccgagcccgcgcgaccntacgcattcgtcgaccagtccgagcgacacgctctcccccccagtgggtgnccctaaaagaggtgtgggccccgnngcccccgtgtttctcccgcgcccgtgaactcggcgctcccagt

SEQ ID NO: 24792 - DNA, 679 bp, Zea mays
  misc_feature: Ceres CLONE 1396117-F
  misc_feature: Encodes the peptide sequence at SEQ ID NO. 24793
tggagctccccgcggtggcggccgctctagaactagtggatcccccgggctgcaggaattcgcacgagaccattacctagaacatcctaatcgaaaaaaacgaaagatcctcctccctcccaaaggtgaggccgttagccaggaattccggcaacaatgacttccctctcctccgcggtggcactgccgtcctcgtgccgggcccggccggcggggggcagccggagggcgcggatggtggtgacgcgcgcggcggcgtctagcccgaagctgccgaacgggcggccggctgcgggtggatgaggctgggagcggttcccgccgctggcacagccgagcatgcggtgccgaacacagccgagacgacgcctctggccccgcccacgacgaagacgtggaatccgtgcccggccataaccacgcagcggccgatcgcggaaggcgaagcgagcgcgcggccatggcgacgaccacgtcctccgcacggacacaccttcctcgcttgaggccatcgacgacaagctcaggtcgctggatctcaagtaccagagacctaccgccgccaagctctacctccacgtcggcggggcctcgccttccgcgcgctgggtgcccgacgaggccgcgcgacctacgcattcggcgaacagtcgagcgacgacgcctctttccccggggt

SEQ ID NO: 24793 - protein, 48 aa, Zea mays
  misc_feature: Ceres CLONE 1396117-F
MTSLSSAVALPSSCRARPAGGSRRARMVVTRAAASSPKLPNGRPAAGG

SEQ ID NO: 24794 - DNA, 693 bp, Zea mays
  misc_feature: Ceres CLONE 1396120-F
  misc_feature: Encodes the peptide sequence at SEQ ID NO. 24795
  misc_feature (678)..(678): n is a, c, t, g, unknown, or other
  misc_feature (683)..(683): n is a, c, t, g, unknown, or other
ggagctccccgcggtggcggccgctctagaactagtggatcccccgggctgcaggaattcgcacgagaccattacctagaacatcctaatcgaaaaagttccatcccaatcgccgagaaggggaagccaaatcgatggcggcggcggcggccggcggcgagaacagcggcgcgggcgcgggcgcgggcgagggcgagttctacctgcggcactacgcacaccgggcggtgaccctgcgggcgtgcctctctctctctctctctctctcccctcccgcatccggtggatcgtcaacgccgcccggcccgggcggcagcgccgcgcgccacctgagggcagcgggagccagcagccgctgcttcaccaaggcggacgcgccgcttttggagcgcttatgcccccgggccgctgagcgcttagtgcagtgtttttggaacatgagacctcctagcagcggcaaaaagactgaggtctcccataacgcggagagaatgtggcggtttctgatcgagcttgtcatggcaaatgccaaagctggggcatccatgcaaaacctttttgtgctggagtgaacgaagtgctccttgtttgaccggcagtcaccactggtgtggaggcctcaaaagagaatgtgtgggagcatgcacttttaaacaatgactcgtgctgacgctctancatgnaggaaggcct

SEQ ID NO: 24795 - protein, 145 aa, Zea mays
  misc_feature: Ceres CLONE 1396120-F
MAAAAAGGENSGAGAGAGEGEFYLRHYAHRAVTLRACLSLSLSLSPPASGGSSTPPGPGGSAARHLRAAGASSRCFTKADAPLLERLCPRAAERLVQCFWNMRPPSSGKKTEVSHNAERMWRFLIELVMANAKAGASMQNLFVLE

SEQ ID NO: 24796 - DNA, 672 bp, Zea mays
  misc_feature: Ceres CLONE 1396122-F
  misc_feature: Encodes the peptide sequence at SEQ ID NO. 24797
  misc_feature (361)..(361): n is a, c, t, g, unknown, or other
  misc_feature (433)..(433): n is a, c, t, g, unknown, or other
ggagctccccgcggtggcggccgctctagaactagtggatcccccgggctgcaggaattcgcacgagaccattacctagaacatcctaatcaaaaaattgtccagccatcctcaggcagcttcgagttccacgacgagagcaccggcagccgcacacgcgtttgtctcctcgccggaccttcccggcaccgccgccggctctccctcacggtccactacactccacagcaccgccgtcgcacaacgacatggcctcctccgctacctatctcatgctcgccagcgcccacgctcccctcgctcctctcataaggccaccgccgatggcccttgtcgcgagaaccgccgcaacctccatcanctaggcgcgaaagagccagtggtccctctgttagtcaaccccgctggcgtgccggccggactggggcggggnccgtgggctgggcccatatctggcagagactcgtccctccggggccccttcggggcgccgattctcctgctcaggagcaagaggatctgaagaagagcgaggcggtgtcagaggctgccggctcggattgccggaggcacttggcgggacgttaagcgatggaaacacgtcggtgctcatcttccgggatctgggcgggactcatggactacgtcttcctgctcgcgcctaccaaaaac

SEQ ID NO: 24797 - protein, 37 aa, Zea mays
  misc_feature: Ceres CLONE 1396122-F
MASSATYLMLASAHAPLAPLIRPPPMALVARTAATSI

SEQ ID NO: 24798 - DNA, 1901 bp, Zea mays
  misc_feature: Ceres CLONE 1396123
  misc_feature: Encodes the peptide sequence at SEQ ID NO. 24799
gcacctgcctctgcctctgcctgcctccatctcctccaccgcccttccctcccttcctctccgcatcgctcgccgtcccatctttggcctggacacctggcctgcccccccttcgcggacgcgccgggtcgccggccgaatccgccctcccgccgctgccaacgtcgatctgcgcccgcccgcccgcccaagggagattcaaaggtaggacgacgggggggtcgagttattgtcggtttcattcctggccgccgacttcacatgtcaacaaccccaaggagcagaagccagggtagtaggaccactaggccgtggatcttgtcagggatggactttgctggttccagacggaagcctaatctcacggggaagattgccgtggctgctgccctcacggtcatgtgcataatcgtgttgaaacagtcccctagtttcagcggtaccagcgtgttctctcgccatgaaactggggtgacccatgtgttagtaacagggggtgctgggtatattggctcacatgctactcttcgtctccttagtgacaagtaccgagttaccattgtggataacctatccagaggaaacatgggagctgttagagttcttcaacagctatttccagaacccggaaggctccaatttatttatgctgatttaggcgatgccaaagctgtgaacaaaatattttcggagaacgcatttgatgctgttatgcactttgctgctgttgcttatgttggtgagagcacaatggagccactcaggtactaccacaacataacgtcaaacacattgacagttcttgaggcaatggcagcacataatgtaaatactctgatttactcgagtacgtgtgcaacctatgttgaacctgatacaatgccaattgtagaaacaactcctcagaatcctatcaatccatatggtaaggcaaagaagatggcggaggacatcatcttagattttacaaaatcaaagaagcaatcaaatatggctgtcatgatcttaagatacttcaacgtgattggatcagacccagagggacggctaggagaagctccaaggccagagctacgcgagcatggacggatatccggtgcttgttttgatgcagctttgggaatcattccagggctaaaggttcgtggaaccgattactccactgcagatggaacttgcgttagagactacatcgatgtcacagatcttgtagatgctcacgtaaaagctcttggtaaagctcagcgaggcaaagttggaatctacaatgtcggaacaggccaaggtagatcagtgactgagtttgtagaagcttgcaagaaggcaacaggagcttctatcaaggtcgaatatcttgcacgtagacccggagattatgccgaggtatacagcgatccgtcgaaaatccacatggaactcaactggacagcccagtacactgatcttggccaaagcctcgcccaggcgtggaaatggcagaaagcgcacccgaacggatatggaccagcctgattcagagttcaaagattgagagagactcgtcacgcagatccaaagggtccatgtgcagtcatgtagccttcagacagttggttcttcatcaccatagaaagatagcaaagagcaacagaagagtccttattcttttattgcagcgctcgaagaaggaaaaaagtatcacagagaaccccctacctgctccttgattagtttcaaatatatatataggtcctcgttgttgacattttaatataatttgatgtgtgctgaggcgctatataataacacaaacgaagttttgttgtagacagggtagatcgatctcgtgtatcaacttttgtggtggtagaatgaaaggatataaataagttgatgtaagtttttgaaaaaaaaaaaaaaaa

SEQ ID NO: 24799 - protein, 416 aa, Zea mays
  misc_feature: Ceres CLONE 1396123
  misc_feature (74)..(338): Pfam Name: Epimerase Pfam Description: NAD dependent epimerase/dehydratase family
  misc_feature: SWISSPROT Homolog: EC 5.1.3.5 UDP-arabinose 4-epimerase
MSTTPRSRSQGSRTTRPWILSGMDFAGSRRKPNLTGKIAVAAALTVMCIIVLKQSPSFSGTSVFSRHETGVTHVLVTGGAGYIGSHATLRLLSDKYRVTIVDNLSRGNMGAVRVLQQLFPEPGRLQFIYADLGDAKAVNKIFSENAFDAVMHFAAVAYVGESTMEPLRYYHNITSNTLTVLEAMAAHNVNTLIYSSTCATYVEPDTMPIVETTPQNPINPYGKAKKMAEDIILDFTKSKKQSNMAVMILRYFNVIGSDPEGRLGEAPRPELREHGRISGACFDAALGIIPGLKVRGTDYSTADGTCVRDYIDVTDLVDAHVKALGKAQRGKVGIYNVGTGQGRSVTEFVEACKKATGASIKVEYLARRPGDYAEVYSDPSKIHMELNWTAQYTDLGQSLAQAWKWQKAHPNGYGPA

SEQ ID NO: 24800 - DNA, 684 bp, Zea mays
  misc_feature: Ceres CLONE 1396124-F
  misc_feature: Encodes the peptide sequence at SEQ ID NO. 24801
  misc_feature (560)..(560): n is a, c, t, g, unknown, or other
tggagctccccgcggtggcggccgctctagaactagtggatcccccgggctgcaggaattcgcacgagaccattacctagaacatcctaatcaaaaaattgtccagccatcctcaggcagcttcgagttccacgacgagagcaccggcagccgcacacgcgtttgtctcctcgtcggaccttcccggcaccgccgccggctctccctcacggtccactacactccacagcaccgccgtcgcacaacgacatggcctcctccgctacctatctcatgctcgccagcgcccacgctcccctcgctcctctcataaggccaccgccgatggcccttgtcgcgagaaccgccgcaacctccatcactaggcgcgaaagagccagtgtccctctgttagtcaaccccgctgcgtgccggccgggactgcggcgccgtggctgggcccatatctgcagagactcgtccctccagggcccttcgggcgccgattctcctgctcaggagcaagaggatctgaagaagagcgaggcggtgtcagaggctgcgggctcggattgccgganggcactggcgggacgttaagcgactggaagcacgtcggtgcttcatctttcgggaatctggggggcgactcatggaactaaggtctttcctggttcgcggcctaaaccaagaccccataaccgg

SEQ ID NO: 24801 - protein, 109 aa, Zea mays
  misc_feature: Ceres CLONE 1396124-F
  misc_feature (104)..(104): Xaa is any aa, unknown, or other
MASSATYLMLASAHAPLAPLIRPPPMALVARTAATSITRRERASVPLLVNPAACRPGLRRRGWAHICRDSSLQGPSGADSPAQEQEDLKKSEAVSEAAGSDCRXALAGR

SEQ ID NO: 24802 - DNA, 672 bp, Zea mays
  misc_feature: Ceres CLONE 1396128-F
  misc_feature (362)..(362): n is a, c, t, g, unknown, or other
  misc_feature (386)..(386): n is a, c, t, g, unknown, or other
  misc_feature (443)..(443): n is a, c, t, g, unknown, or other
tacccgcggtggcggccgctctagaactagtggatcccccgggctgcaggaattcgcacgagaccattacctagaacgtcctaatcaaaaaaattcgatcgcagactcgccaagctgctgccccgagcgggcgagtccaccgacctcgaaatcctccgtcttcctcctcgccgagtcgggcctcgacttgcatcgtgcccaaatccaagccaaactcctcaatctccgtcaatggaatggtgtcgcgagaccgagggtatcgccgtcctcgtctcaatgtacaacgacgactagggaagatgaggacgccgacgagcccaaccctccgtgcccagggccgctcaccacgcgtcacctcctcnttgaccgctggccctcatagcggnttagcgaggacacatagcccttccctggagcctccgtacgctccccggtcccgaatngagtcggacagcctcgaaaacccttagcgagtccacactgccccccgggggagcgttcgttgaaaccgacattgcccgtcgcgatggctcttagtcgcacgttaggttgctgagaacccggctcaagggggtatggcgtatcatactgatgagtaggcacccgacatggcgtgggcggggcctctggggggtcgcaactttaagattctcaagaatgatgcatatgaaa

SEQ ID NO: 24803 - DNA, 734 bp, Zea mays
  misc_feature: Ceres CLONE 1396130-F
  misc_feature: Translation starting site: 226
  misc_feature: Pfam Name: Bromodomain Pfam Description: Bromodomain
  misc_feature (552)..(552): n is a, c, t, g, unknown, or other
  misc_feature (553)..(553): n is a, c, t, g, unknown, or other
  misc_feature (562)..(562): n is a, c, t, g, unknown, or other
  misc_feature (563)..(563): n is a, c, t, g, unknown, or other
  misc_feature (595)..(595): n is a, c, t, g, unknown, or other
  misc_feature (601)..(601): n is a, c, t, g, unknown, or other
  misc_feature (682)..(682): n is a, c, t, g, unknown, or other
  misc_feature (708)..(708): n is a, c, t, g, unknown, or other
aaaagctggagctccccgcggtggcggccgctctagaactagtggatcccccgggctgcaggaattcgcacgagaccattacctagaacatcctaatcaaaaaatcccaaatagttactccactcccctcacccctcccgactcccgtgctctctctctctctctctctcggatccgaattgccagcgcaccagtcgagctcgcgggaactcgccggcaccggcgatggcctccgccctactggccggacagggcggggcgcgccaccacggctggggggagacgcgcgccccactcgcgcccatacctcccaaccctaaccccagccagccccacccgcgcgccgacgggtccaagtccaagccgcgggcggcagcctcctcgccggcggccggatacgtgacgttccgcccggcgtccctgggcccgcgcgaggcccgcgcgctccgggaacgcctcgcgggggagctcacccaggtgcgcgccctcctctcccgcatcgacacctggcagcagcagggcccgccgcccgcggggctccgcggcgaggtnngcgaagcgnntgcggcagatcctcaccaggctgcgcaagacnagcggnagcgtgtggttcacggccccggtcgaggtggagcgcctcggccgtcacgactaccacgccgtcatcaagcgccccatgggnactcgcacccgtcaaggagggctcgnccccccccggagctacgcctcgcacg

SEQ ID NO: 24804 - DNA, 629 bp, Zea mays
  misc_feature: Ceres CLONE 1396134-F
  misc_feature (245)..(245): n is a, c, t, g, unknown, or other
ggatcccccgggctgcaggaattcgcacgagaccattacctagaacatcctaatcgaaaaaagcttttgctttggtttaggtgcttcttttccacccctttactgttccccccacttttgcttgctttgtcacgcacacgaaaagctcctgcctttaccttatctccgcacccgtagtgggatttggtgggagctgcgctgctcgcccctcgcgtttctttgctcaattgggggtcacggtcacnggcccgcgggtgctgcgcgtgctcgtgggcggcgggaattcggggttcttgcgcggtcccggtcccctcggcgattgcggacgctctctgcagatcttcgcgtaactccgggagcgcgccggagatgaaatgcgggccgcccgaccagtggccgccgggaacggccgccggcggggctctctcatcctgaactggggaccatgtttattgcccgcggaccaactccacccggggctccacctcgccggacccgtcccccgaacccactgccactaccaccgtccgcgggcggttacggccgcacactcggggggcagtgcgacgaggagggagagggagagggggccgcgccaggggggggcatagggtgccggcgcgtgtata

SEQ ID NO: 24805 - DNA, 653 bp, Zea mays
  misc_feature: Ceres CLONE 1396136-F
  misc_feature: Encodes the peptide sequence at SEQ ID NO. 24806
  misc_feature (191)..(191): n is a, c, t, g, unknown, or other
  misc_feature (194)..(194): n is a, c, t, g, unknown, or other
  misc_feature (200)..(200): n is a, c, t, g, unknown, or other
  misc_feature (264)..(264): n is a, c, t, g, unknown, or other
  misc_feature (297)..(297): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
cgcggtggcggccgctctagaactagtggatcccccgggctgcaggaattcgcacgagaccattacctagaacatcctaatcgaaaacctcactctgtctcttcctcagtcccggcatcagcgctcaaaccctaacacgccacgcgatcccgatgcgcaggggtctgggcagcgaggcatcgttgcgccgncgncgcggnccggcgcggctttgggtggcagtggcggcgcttgtggtccgcaccgggtggctcctctcctccntctcggtcgggctggtgggcgcttcttacaggnccggaaggtgagggaaaaaaggtggggggaaatggaaattccaaggtttggggaggctcttttgggcccgggaccctatggccccccccaccaatggaatttgaaggaatggttattttggggccccggggaaaggggggtttttaaccccacggaagggggaatataaggggggttttttggggcccccccaaaaaggggccccggggggggggacacaaaaaaaacacatccttttttgggggggagaaagggggctttcaaaaatatttatattgccccccccctctcgaaaaaaaaatataactcccccttttttttttagaatttcttgaaaaaccaaaagcagcnnnnnn

SEQ ID NO: 24806 - protein, 51 aa, Zea mays
  misc_feature: Ceres CLONE 1396136-F
  misc_feature (38)..(38): Xaa is any aa, unknown, or other
  misc_feature (49)..(49): Xaa is any aa, unknown, or other
MRRGLGSEASLRRRRGPARLWVAVAALVVRTGWLLSSXSVGLVGASYRXGR

SEQ ID NO: 24807 - DNA, 630 bp, Zea mays
  misc_feature: Ceres CLONE 1396137-F
  misc_feature: Encodes the peptide sequence at SEQ ID NO. 24808
  misc_feature (630)..(630): n is a, c, t, g, unknown, or other
tccccgcggtggcggccgctctagaactagtggatcccccgggctgcaggaattcgcacgagaccattacctagaacatcctaatcgaaaaaacctttgcctctcctcccgttgtcagccgccgtgcctgttctctctgcctttctaaaagtgcggcgactggttgggctgccgccgactgccggggccttcgccgacctcttcgccggcgaagaggtcccatcaggagaaggagtagatcgtcgacccagaaccctcgctgatggcgactttcgcgaaacctgagaacgcgctgaagagagccgaagaattaatccatgttggtcaaaagcagtcagccctgcaggctttacatgatctcattacctcgaaaaggtacaggtcatggcagaagcctctcgaaaaattcatggatgaagtatgtaagaaactctgtgttgacctgaggaaaggcagatttgcaaaagatggtcttatcaagaatagggattgtctgccagcaagtaaacgggcatcctttgggaggatgtcataaagcacttcatgcagctttcaaatgagaaagctgaacagcctaagagtcaggtcgaagcactggaaatggctcgggaaggtccaaaatcttgaacn

SEQ ID NO: 24808 - protein, 90 aa, Zea mays
  misc_feature: Ceres CLONE 1396137-F
MATFAKPENALKRAEELIHVGQKQSALQALHDLITSKRYRSWQKPLEKFMDEVCKKLCVDLRKGRFAKDGLIKNRDCLPASKRASFGRMS

SEQ ID NO: 24809 - DNA, 645 bp, Zea mays
  misc_feature: Ceres CLONE 1396139-F
  misc_feature: Encodes the peptide sequence at SEQ ID NO. 24810
tggagctccccgcggtggcggccgctctagaactagtggatcccccgggctgcaggaattcgcacgagaccattacctagaacatcctaatcgaaaactccttcccctccctctttccacgacaccaaaagaaaccgaaaaccatcgacgcgctccgtccaccctcccctaccccgcgtcctcctcccctacgcctcccagcccagcggcaaaacctaaccctagatgggcgccgtcacctctacggtcgcggcgcgctttgcctttttcccgccgagcccgccgtcgtacgggttcgagcagccggcgccgcttccggcccctgccacacccgagcctccggccccggccacatccaagccgccgcctccggccccgggcacacccaagccgccgcctccggccccggacacacccaagccgccgccagctgggggaggagaagggcggtgtcgcggtggtggagctcacgggcgtcccgcggggggttaacgtggaggcgcggcggctgcggacgaagggggaaacggaggcggtccctacgcacgtgcgtacgggggaggctcaagctctcggcgggtctaatcccccgggaacggcggcgccctcggccccaaagggacggaccataccgaaggggccccc

SEQ ID NO: 24810 - protein, 88 aa, Zea mays
  misc_feature: Ceres CLONE 1396139-F
MGAVTSTVAARFAFFPPSPPSYGFEQPAPLPAPATPEPPAPATSKPPPPAPGTPKPPPPAPDTPKPPPAGGGEGRCRGGGAHGRPAGG

SEQ ID NO: 24811 - DNA, 647 bp, Zea mays
  misc_feature: Ceres CLONE 1396140-F
ggagctccccgcggtggcggccgctctagaactagtggatcccccgggctgcaggaattcgcacgagaccattacctagaacatcctaatcgaaaaacgacaattcggcgatcgccgtcttctcttggccattggataggtagagacacagcgcgagcgacctatgtcagtgcgtccttcgggtttgggcgtcacctgcagctatccgcgaccgcgacgatgagactgcgcgtggccgccaccgcgacagctccgggcgacgtgcgcgtgctcggtaggggcgccgcgcgcgtgacgccccgaccgagggcggctgtcctcgacagagacgcttctccgagcggatgtcgctcctgaccccgaggacaccatcccatcgccgaggaggcctcatatgctatgggttggaccaaggaaccgaatacgtgtcgtcaactgcctctacgtgggaatgcgaccatgttcttccgcgtgaccacagagagggccaaatcccggcggtctgtgggggggagatcgtctcacctattggcttaattgaattgcgaatgccccgggttcgtggaggtcgataaccaccgcgataccatttccaatgcccagaaacgagacatatcgcgcgccctattctttccccatggggggcg

SEQ ID NO: 24812 - DNA, 677 bp, Zea mays
  misc_feature: Ceres CLONE 1396142-F
  misc_feature: Encodes the peptide sequence at SEQ ID NO. 24813
  misc_feature (290)..(290): n is a, c, t, g, unknown, or other
  misc_feature (338)..(338): n is a, c, t, g, unknown, or other
  misc_feature (352)..(352): n is a, c, t, g, unknown, or other
  misc_feature (353)..(353): n is a, c, t, g, unknown, or other
  misc_feature (378)..(378): n is a, c, t, g, unknown, or other
  misc_feature (424)..(424): n is a, c, t, g, unknown, or other
cgcggtggcggccgctctagaactagtggatcccccgggctgcaggaattcgcacgagaccattacctagaacatcctaatcgaaaacttgccttcgtctccgcctcccgtctttcctcaagaagtcgattcccttccccaagaacccaagcccccaccatgacaagctcctcctctccttcccgaaaggcgctgagcaagatcgcttgcaatcggctgcagaaggaactcgccgagtggcaactcagcccccctgctggattcaagcacaaggtctccgataacctacnaaggtgggtaattgaggtcactggagcggcgggcacccttttacgcgncgagaccctacagnntgcagttgacttccctgagcatatnctatggaggcacctcaggtcatttttctcaatccagcgcaatgcantcacacatctacagcaacgggacatctgcttaaaatatttggatggctcgggggccccagcgaagaccgggactctgcctgaacaagacccggccaaagggggcaaattccccaaaaagcaagggccaggggaaatggacggttttgcgggactgccccaacgggagggccccaaagaacaaaagggggggtcctggaaaaacgggggaattggccccgaccgcttctcgggggggaaatctgggagggggaa

SEQ ID NO: 24813 - protein, 172 aa, Zea mays
  misc_feature: Ceres CLONE 1396142-F
  misc_feature: SWISSPROT Homolog: EC 6.3.2.19 Ubiquitin--protein ligase
  misc_feature (44)..(44): Xaa is any aa, unknown, or other
  misc_feature (60)..(60): Xaa is any aa, unknown, or other
  misc_feature (65)..(65): Xaa is any aa, unknown, or other
  misc_feature (73)..(73): Xaa is any aa, unknown, or other
  misc_feature (89)..(89): Xaa is any aa, unknown, or other
MTSSSSPSRKALSKIACNRLQKELAEWQLSPPAGFKHKVSDNLXRWVIEVTGAAGTLLRXETLQXAVDFPEHXLWRHLRSFFSIQRNAXTHLQQRDICLKYLDGSGAPAKTGTLPEQDPAKGGKFPKKQGPGEMDGFAGLPQREGPKEQKGGSWKNGGIGPDRFSGGKSGRG

SEQ ID NO: 24814 - DNA, 669 bp, Zea mays
  misc_feature: Ceres CLONE 1396150-F
  misc_feature: Encodes the peptide sequence at SEQ ID NO. 24815
  misc_feature (302)..(302): n is a, c, t, g, unknown, or other
  misc_feature (319)..(319): n is a, c, t, g, unknown, or other
  misc_feature (374)..(374): n is a, c, t, g, unknown, or other
  misc_feature (383)..(383): n is a, c, t, g, unknown, or other
tggagctccccgcggtggcggccgctctagaactagtggatcccccgggctgcaggaattcgcacgagaccattacctagaacatcctaatcgaaaagcgggtgctgcgcgtgctcgtgggcgggcggaattcggggttcttgcgcggtcccggtcccctcggcgattgcggacgctctctgcagatcttcgcgtaactccgggagcgcgccggagatgaactgcgggccgcccgaccagctgccgccggggtcggcgccgtcgtgcttcctcaacctgaactggggacagtctatgggcgnccgacagctcgacccgncgctcagctcgatggtctcctccccggcgtccaactcgacggccggcgccgcggntactgacgncggcgctctccacgggatctctccgcagcagcagtagggaagaactccggtcaagtcccccccaggtcaacttgttccaccaaatcgccccaggttccccactccccgccgcccaaggcggggggccggccaacctggaaaacctggggccatgggccttttaaaacagttccctcgccacccggttttcccaaaggggggggggggttttccctttttaaagccccccccggggaagggtatttaaagggcgcccccccccccccaacaattttgggctccccga

SEQ ID NO: 24815 - protein, 67 aa, Zea mays
  misc_feature: Ceres CLONE 1396150-F
  misc_feature (29)..(29): Xaa is any aa, unknown, or other
  misc_feature (35)..(35): Xaa is any aa, unknown, or other
  misc_feature (53)..(53): Xaa is any aa, unknown, or other
  misc_feature (56)..(56): Xaa is any aa, unknown, or other
MNCGPPDQLPPGSAPSCFLNLNWGQSMGXRQLDPXLSSMVSSPASNSTAGAAXTDXGALHGISPQQQ

SEQ ID NO: 24816 - DNA, 677 bp, Zea mays
  misc_feature: Ceres CLONE 1396153-F
  misc_feature: Translation starting site: 242
aaagctggagctccccgcggtggcggccgctctagaactagtggatcccccgggctgcaggaattcgcacgagaccattacctagaacatcctaatcaaaagaaaacacaccatctccacctcgccgccgccgctcggatttccctctacctcaccctgtccgccgtcaaggagcagcaaggccaaggccgccgcggcgtcggcggccgtggtcgtggacgacatagccgagctgcaggggatgctagagcgcctgcggctggagaaggagaaggcggaggagatggttagggagcgggatgaggtcatccggaagaaggaggaggagatcgagaccagagacaaggagcaggagcgtctccaggccgagctcaggaaggcgcaacgcgccaaggagttcaagcctaccgtgagcttccccctcgtcaagtcgttgctggagaaagagcaagaagcagacgactagggaaaagaagaagaaggtgaagggcggccacgagaggaagaagccgtgcccggcgtacgtgctctggctcaaggaccagtggaccgaggtcaagaaggagaaccctgaggccgacttcaaggaggtgtccaacacgctgggcgccaagtggaaggctctgggcgccgaggagaagcagccctatgaggatcgataccgccagggagaggag

SEQ ID NO: 24817 - DNA, 691 bp, Zea mays
  misc_feature: Ceres CLONE 1396154-F
  misc_feature: Encodes the peptide sequence at SEQ ID NO. 24818
  misc_feature (311)..(311): n is a, c, t, g, unknown, or other
  misc_feature (337)..(337): n is a, c, t, g, unknown, or other
  misc_feature (396)..(396): n is a, c, t, g, unknown, or other
  misc_feature (691)..(691): n is a, c, t, g, unknown, or other
aaagctggagctcaccgcggtggcggccgctctagaactagtggatcccccgggctgcaggaattcgcacgagaccattacctagaacatcctaatcgaaaaaaaaccacctcacgagcccaaccaaattcaaaccaacgctaccgtgcaaccaaaccaaccaaccccattcctccgccggccgccggcagccgcccgcgatgtcgaaggccgcgggagtgtccctcccgccgccgccgccagaggtggcgcaccttgtggagcagctccagcgccaccacctcgccgcggacgcgtccctcctctccagntccgcgcactccgacctccctcaggngcgcgaggaagtcgcggaggaacgcgcgctgtacctcgaggcactgccagtgtacgcgnatgcggtgaccaatctcgaaggagaaccatgccgttgccggcgccgccaagaagttcactgctccccgaagggtacgaacctttgaagaaccggtgggccggggaaaaggaaaaaaagaggtttaggccccacggctccccgggggggggaggcccaggagaaggaaaccaaaaatgtgccccctttttggaatttttttgaaaacccccccccaaggggacacccccttcaagttatttcccgggaggttcacaattttattgcccccccctgtggggggagaaggtggtctcn

SEQ ID NO: 24818 - protein, 93 aa, Zea mays
  misc_feature: Ceres CLONE 1396154-F
  misc_feature (37)..(37): Xaa is any aa, unknown, or other
  misc_feature (46)..(46): Xaa is any aa, unknown, or other
  misc_feature (66)..(66): Xaa is any aa, unknown, or other
MSKAAGVSLPPPPPEVAHLVEQLQRHHLAADASLLSXSAHSDLPQXREEVAEERALYLEALPVYAXAVTNLEGEPCRCRRRQEVHCSPKGTNL

SEQ ID NO: 24819 - DNA, 612 bp, Zea mays
  misc_feature: Ceres CLONE 1396156-F
  misc_feature: Encodes the peptide sequence at SEQ ID NO. 24820
  misc_feature (401)..(401): n is a, c, t, g, unknown, or other
  misc_feature (464)..(464): n is a, c, t, g, unknown, or other
ggagctccccgcggtggcggccgctctagaactagtggatcccccgggctgcaggaattcgcacgagaccattacctagaacatcctaatcgaaaacttcctcgtgccgacgaccgggcgaccgccgcgccccggcccgcgcccccttgtctcgggccactcgccggcaacgagcagccaccaggaaatgttgtgaggactgatgcaataactaagcttgctggatggacggatgtgattgcatcgagccactatggcctaccgatgatctccttgtcaagtatcagtacatctcagacttcttcatagccctcgcgtacttctctattccgttggagctcatatatttcgtgaagaagtcgtcctttctcccgtacagatgggtcttgatccagtttggntggcgtttatagtctctgtggggcaacccatctgataaacctgtggacgttcacacacatacnaagaccgttgcgatggtcatgacattagcaaaagtttctacaggcaggtggggcctgggggcactgcctttggaggctggtccaaaccacccccgacttattgggggggaaaattaaaaagttgttcttggaaaaaaaagcttaaaaa

SEQ ID NO: 24820 - protein, 62 aa, Zea mays
  misc_feature: Ceres CLONE 1396156-F
  misc_feature: SWISSPROT Homolog: EC 2.7.13.3 Histidine kinase
MDGCDCIEPLWPTDDLLVKYQYISDFFIALAYFSIPLELIYFVKKSSFLPYRWVLIQFGWRL

SEQ ID NO: 24821 - DNA, 687 bp, Zea mays
  misc_feature: Ceres CLONE 1396160-F
  misc_feature: Encodes the peptide sequence at SEQ ID NO. 24822
  misc_feature (414)..(414): n is a, c, t, g, unknown, or other
  misc_feature (465)..(465): n is a, c, t, g, unknown, or other
  misc_feature (470)..(470): n is a, c, t, g, unknown, or other
  misc_feature (499)..(499): n is a, c, t, g, unknown, or other
  misc_feature (566)..(566): n is a, c, t, g, unknown, or other
tccccgcggtggcggccgctctagaactagtggatcccccgggctgcaggaattcgctcgagaccattacctagaacatcctaatcgaaaaagctgcggcgccaccctcggcctcgggccgtccgccgtcggcggccacgaccctggtgtaatctgctccatacgtggcggcgcctgcaaaagccacgctgctgccagtgccagccatggatgcagtggcggccagcgacgccgtactcctccttgctaccgtagctatctccctgctcatcactgccactttctggagcaggcatcgtcgtcagggcgaagcgccgagcccgccgtcgctaccgctgctgggccacctccacctgctcggcaacggcaagccgctgcaccacacgctgggcggcgctggccatcgcggggggnaaacggggggcgccccggcgccgctcctgtcgctgcgcctggggcgcgcgncgcgngcctgcttggtgtcgtaccacgccgcggnccgaggagtgcttcacggcgcacgaacgcggctgctgggcggccggcccgcgccttgctggtccgcnaacagctcaactaacgtggccccaccggttggcctggtcctccgcacggacaacgactggcgcgccccctccgccggttcatagcccggggaaacttgtttcccccggccccgtctcgccg

SEQ ID NO: 24822 - protein, 147 aa, Zea mays
  misc_feature: Ceres CLONE 1396160-F
  misc_feature (70)..(70): Xaa is any aa, unknown, or other
  misc_feature (87)..(87): Xaa is any aa, unknown, or other
  misc_feature (98)..(98): Xaa is any aa, unknown, or other
MDAVAASDAVLLLATVAISLLITATFWSRHRRQGEAPSPPSLPLLGHLHLLGNGKPLHHTLGGAGHRGGXTGGAPAPLLSLRLGRAXRACLVSYHAAXRGVLHGARTRLLGGRPAPCWSANSSTNVAPPVGLVLRTDNDWRAPSAGS

SEQ ID NO: 24823 - DNA, 654 bp, Zea mays
  misc_feature: Ceres CLONE 1396168-F
  misc_feature: Encodes the peptide sequence at SEQ ID NO. 24824
  misc_feature (307)..(307): n is a, c, t, g, unknown, or other
  misc_feature (312)..(312): n is a, c, t, g, unknown, or other
  misc_feature (458)..(458): n is a, c, t, g, unknown, or other
  misc_feature (472)..(472): n is a, c, t, g, unknown, or other
  misc_feature (519)..(519): n is a, c, t, g, unknown, or other
  misc_feature (599)..(599): n is a, c, t, g, unknown, or other
  misc_feature (632)..(632): n is a, c, t, g, unknown, or other
gctctataatagtggatcccccgggctgcaggaattcgcacgagaccattacctagaacatcctaatcgaaaaatcccacgctgccctcggcgctgcgcctggacccggcacctacctcccccctccccacctcgccgccggcgggtggagtcgggctggagcagccgctctcctctgttacccccctaaccccctataaagaaaaagaaaaaaaaacagagagagagagcgagcgaccggcggctcggcagccatggggcacggcgtcagctgcgcccgcaccggcgacgagcacgactacttcgncgcgncgcaggtcggggacctcgaggccctggacgcgctcctcgacgccgacccctctctcgcccgccgcgccacgctctacgaccgcctctccgcgctccacatcgccgccgcgaatgcccccgcctcgaggtgctgtcaatggtctggnatcacggggtgccngccggacgtggtgaaatcgcacaagcagacgccgctgatgctcgcgncgatgcacggcaagactgactgcgtgctgaagctcctgcaggccggcgcaaatatcctcatgttcgattcccagcacggncggacctgcctgcaccacgcgtcctacttcggncacgtcgggtgcctgcaggcat

SEQ ID NO: 24824 - protein, 133 aa, Zea mays
  misc_feature: Ceres CLONE 1396168-F
  misc_feature (80)..(112): Pfam Name: Ank Pfam Description: Ankyrin repeat
  misc_feature: SWISSPROT Homolog: EC 2.7.11.1 Non-specific serine/threonine protein kinase
  misc_feature (18)..(18): Xaa is any aa, unknown, or other
  misc_feature (20)..(20): Xaa is any aa, unknown, or other
  misc_feature (73)..(73): Xaa is any aa, unknown, or other
  misc_feature (89)..(89): Xaa is any aa, unknown, or other
MGHGVSCARTGDEHDYFXAXQVGDLEALDALLDADPSLARRATLYDRLSALHIAAANAPASRCCQWSGITGCXPDVVKSHKQTPLMLAXMHGKTDCVLKLLQAGANILMFDSQHGRTCLHHASYFGHVGCLQA

SEQ ID NO: 24825 - DNA, 657 bp, Zea mays
  misc_feature: Ceres CLONE 1396169-F
  misc_feature (657)..(657): n is a, c, t, g, unknown, or other
tccccgcggtggcggccgctctagaactagtggatcccccgggctgcaggaattcgcacgagaccattacctagaacatcctaatcgaagagttccataaaccctaacctcgttggattcgcgggaaaaatcctcccaattcggaaccctccgatgttccagctacctgcgggagctgagccgtgctcggtttggtgaaatttcgcacccctcttgtgctaggaccacccggttcaagctgttcctcggaagggtcaggtcttcaccggtgttctccggcgacggatacaggtttgttccggagagaggtcggcctcttggtgggggacagcccagctgcgagctcaatttgccggcctgagatggaatcgcgactgcggggccggtgcctcatgtagtcgcgtcgagtcgacgcgcgattcctgtcatttgggtggggcagtctttactggcaatctcggggcgcgtttcggctcgctgcgtgccagaaaggtgtgacgtgcgatgcatcccatgctcgaatccacgccgaccgggtgcgcgaggacgaccacttctactgcctgccggattcactcgtcctgctcatcctgtacagggtcgaggacgtgcggtcgctcggacgttgctacagcgtgtccaagcgactctgtgggn

SEQ ID NO: 24826 - DNA, 615 bp, Zea mays
  misc_feature: Ceres CLONE 1396172-F
  misc_feature: Translation starting site: 149
  misc_feature: Pfam Name: IPPT Pfam Description: IPP transferase
  misc_feature: SWISSPROT Homolog: EC 2.5.1.8 tRNA isopentenyltransferase
  misc_feature (559)..(559): n is a, c, t, g, unknown, or other
  misc_feature (560)..(560): n is a, c, t, g, unknown, or other
tccccgcggtggcggccgctctagaactagtggatcccccgggctgcaggaattcgcacgagaccattacctagaacatcctaatcgaaaacattgaatttggccgagtaacagaaccgtgtctgtttttaattcctgacggttagagatggcccacccctccgccgccgccgtatcctccacggcgctcgctgcaaaccctagctctggcgccagcgaggaaggaggcgcccgctctccgccgtcgccgtctcagagggggcggaccaaggtggtgatcgttatgggcgccacgggcgccggcaagtcgcggctggccgtcgacctcgcggcccacttcgccggcgtcgaggtggtcagcgccgactccatgcagctctaccgcggcctcgacgtcctcaccaacaaggctcccctccagcgagcagaacggtgttcctcatcatctacttagcgtgattgatccctctgtcgagttcacttgccgtgattaccgcgaccgtgcccctgcgattatacaggaaaaagtggacccgcggtgccgccccctggtggttgnncgccggtacaaacttctacatccaggctctcgttagcccatccctccttggatga

SEQ ID NO: 24827 - DNA, 631 bp, Zea mays
  misc_feature: Ceres CLONE 1396173-F
  misc_feature: Encodes the peptide sequence at SEQ ID NO. 24828
  misc_feature (440)..(440): n is a, c, t, g, unknown, or other
ggagctccccgcggtggcggccgctctagaactagtggatcccccgggctgcaggaattcgcacgacccattacccataacatcctaatcgaaaagtgacctgggagtgggagggttggtgcctataggatcgtcatggacaccatcgaggagtgcggcgacggaggccgccacctgctgctgggcctcggcaccaggatactcgtcggcgtgccggacaactcccgcggctgctccgagctgctgtcgtgggcgatcggcgccgtcgccaagcccagcgactccgtcgtcgcgggcacgcctcccggagagggagaggggaaggaaaccgaagactggcaaaaggccaacagccttcgtcatctacatgctcggcgaattcgtcgaagcttgtgaggccaagcagattaatttggaggccaaggtgatatgcagctcanacattgggagagccctgacccaagaagctgcactgactgatgggaacatcctcattgttgggagatcaagaaatgcgtaccataggagccattttgagattgaaaactactgcttcatgcatgctccaaaaaactggtcggggatcgttgtgggaaggcaaggggtaacaaaaaaaaaagacccggttgaa

SEQ ID NO: 24828 - protein, 88 aa, Zea mays
  misc_feature: Ceres CLONE 1396173-F
  misc_feature (25)..(25): Xaa is any aa, unknown, or other
MLGEFVEACEAKQINLEAKVICSSXIGRALTQEAALTDGNILIVGRSRNAYHRSHFEIENYCFMHAPKNWSGIVVGRQGVTKKKDPVE

SEQ ID NO: 24829 - DNA, 643 bp, Zea mays
  misc_feature: Ceres CLONE 1396175-F
  misc_feature: Encodes the peptide sequence at SEQ ID NO. 24830
  misc_feature (345)..(345): n is a, c, t, g, unknown, or other
  misc_feature (468)..(468): n is a, c, t, g, unknown, or other
ggagctccccgcggtggcggccgctctagaactagtggatcccccgggctgcaggaattcgcacgagaccattacctagaacatcctaatcgaaaaattccgcgccgcatctgggaaggtctcgtcttgctcgcctccgtccgtcgccgcaccctgcgtcgtcgccatggccacgacgcagggtgcggcggcggccggagtgttcgtctcttgctccgccgggaactccggcccatccggatccaccgtctcaaactccgctccgtgggtcgccaccgtcggcgccgggacactggaccgcgacttcccggcatacgtgatgctccccacgggtgcgcgcctggncggcgtgtccctctaaccgggggcttcttccttcccaaggcccggcatgctcccggtcctctacagaagcgggcgtgacaacggccagcagctctgcctcttcgggacgctcgaaccgggcgncgggcgcggaaaaataaattgtgttgggaacggggcgtccacgcgcgcgtggagaaaaggcgccgccctgtaaaagggggccggggggccccggaattgaaattgggaaaaccgcaacccaagggaaaagaacttcgggggggaacagcactggtccccccgggggggggggggg

SEQ ID NO: 24830 - protein, 64 aa, Zea mays
  misc_feature: Ceres CLONE 1396175-F
  misc_feature: SWISSPROT Homolog: EC 3.4.21.25 Cucumisin
  misc_feature (60)..(60): Xaa is any aa, unknown, or other
MATTQGAAAAGVFVSCSAGNSGPSGSTVSNSAPWVATVGAGTLDRDFPAYVMLPTGARLXGVSL

SEQ ID NO: 24831 - DNA, 629 bp, Zea mays
  misc_feature: Ceres CLONE 1396176-F
  misc_feature: Encodes the peptide sequence at SEQ ID NO. 24832
  misc_feature (339)..(339): n is a, c, t, g, unknown, or other
  misc_feature (404)..(404): n is a, c, t, g, unknown, or other
  misc_feature (486)..(486): n is a, c, t, g, unknown, or other
cgctcttaactagtggatcccccgggctgcaggaattcgcacgagaccattacctagaacatcctaatcgaaaaaagatgaatgctacgtaggtagacagtgttcttgtggtgacgtgacctccacagagtgcagagatgggagaagctgaagaagcgccaggagacagcaatggtgaggcactggagctcctcatgtccatggcgtcctcttcgctggcctgctctgtctcgcagttcccagccaagtggcagtccatcaaggacaagctccagctgctctgctgcagcctcaattcactctgcggcggcggcggtgaccacgacgacgacgacgacnaggagcatcctggtgttggctgagcttctgcggctggcttcagcaaccgtgaggagcatccaggntcgttgcttctcagggcagcgacgggtcatacaaagggtgaaaggctccgtctgaggagcgacctggaacacctgagctggnagctccgatgggcccatgaagcagctcaaggaaatggccgccccgtcccgggggccccccccccccccagggccttgggcccccgccaggccccaggcccagggcacgggggggggaaaaagccctttcccctcaggattttt

SEQ ID NO: 24832 - protein, 74 aa, Zea mays
  misc_feature: Ceres CLONE 1396176-F
  misc_feature (68)..(68): Xaa is any aa, unknown, or other
MGEAEEAPGDSNGEALELLMSMASSSLACSVSQFPAKWQSIKDKLQLLCCSLNSLCGGGGDHDDDDDXEHPGVG

SEQ ID NO: 24833 - DNA, 859 bp, Zea mays
  misc_feature: Ceres CLONE 1396178-F
  misc_feature (1)..(1): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (19)..(19): n is a, c, t, g, unknown, or other
  misc_feature (21)..(21): n is a, c, t, g, unknown, or other
  misc_feature (353)..(353): n is a, c, t, g, unknown, or other
ncccccccccccnnnnccncnaccaccctcccccacccccgtccccccccacagatggagatccccgcggtggcggccgctctagaactagtggatcccccgggctgcaggaattcgcacgagaccattacctagaacatcctaatcgaaaagcgtttctttaccctaagcttttagctggtccaacgaaaggcacacagcccgacagccgccgctgtttcttcatcttcctcgcagcgccggcgctccttcttccgctccctctccgattcgcgctcggcacgcaggcgacggcggcggcgctcgtgctcgggctctcagcgacggcgggcagtcccagactcggtgtcggngtcagggggcccccctttccgcctgtcacaaatggcctggcgccctcggcttccgggcctccgaacaacgaacggggggccttgaggtggcaagccctcccggttccccctccttggcctccggaagggaaccggcccaaacggggcttcgtgaacccgggaagtatttgcattggtcgccgacccgggatggaaaaccggcctggcccaaggcgggaagatccatgacagccctgttcccgcatttttcggcgagagggcttaatccccctccaaaaagggtaatccctttcagggcccccccttaaatcctcctcacggcgcgcttgaaaatccggggcgtataaaggggcaaaatttttgtgggacacccatctccgtggattgttgcgttttaccccccacacccacctcacaaaccagccggtcacacacgaaacgggccgaggagttaattatctgatgctacgaacaacgaaaagcagtacacggccggagagaggtgg

SEQ ID NO: 24834 - DNA, 656 bp, Zea mays
  misc_feature: Ceres CLONE 1396179-F
  misc_feature: Encodes the peptide sequence at SEQ ID NO. 24835
gctcttaactagtggatcccccgggctgcaggaattcgcacgagaccattacctagaacatcctaatcgaaaaaaaccctaccctttggcttctccgtcctcgcccccgcccccgccccgcccccgcctatccgcgcaccagccgaatgtcgtcgggaggcggtggggggcagcagttccgctacacgcagacgccgtccaaggtgctgcacctgcggaaccttccgtgggagtgcgcggaagaggagctcgtcgagctctgcaagcctttcggccgcatcgtcaacaccaagagcggcgtcggcgccaaccacaactaggcctttgtcgagttcactgacgttaatcaggcaatctcgatggtttcttatttcgcatcatcttcagaaccagcacagatacgaggcaagactgtttatattcagtattcaaataggcaagaaataattaacaacaagagtcctggagagactgctggaaatgtcttgcttgtaccactagagggtgttcattctagtgatgtcaccattgatggatcccatatggttttctcgggttttttggggatgttcataaaatagccacctttgaaaagggctggcaggttttcaggaaattgatccaagtacacttgatgcggttaccggcttcagctg

SEQ ID NO: 24835 - protein, 57 aa, Zea mays
  misc_feature: Ceres CLONE 1396179-F
MSSGGGGGQQFRYTQTPSKVLHLRNLPWECAEEELVELCKPFGRIVNTKSGVGANHN

SEQ ID NO: 24836 - DNA, 770 bp, Zea mays
  misc_feature: Ceres CLONE 1396181-F
  misc_feature: Encodes the peptide sequence at SEQ ID NO. 24837
  misc_feature (1)..(1): n is a, c, t, g, unknown, or other
  misc_feature (13)..(13): n is a, c, t, g, unknown, or other
  misc_feature (14)..(14): n is a, c, t, g, unknown, or other
  misc_feature (24)..(24): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (36)..(36): n is a, c, t, g, unknown, or other
  misc_feature (37)..(37): n is a, c, t, g, unknown, or other
  misc_feature (770)..(770): n is a, c, t, g, unknown, or other
ngggccccccccnncccccccccnaccaannnnaanngagttcctcgcccccaaagctggcgctccccgcggtggcggccgctctacaatagtggatcccccgggctgcaggaattcgcacgagaccattacctagaacatcctaatcgaaaaaaaaagcagcagcagcagaccttcttgacctagcaagcaatggggccgccgttcctcgccgtcgccgtcatcgtcgccttcctggccgccgccgcgcaggccgccgaccccttcgccttcttcgactgggacgtctcctacatcaccgcctcccctctcggcgtcccgcagcaggtcatcgcagtcaacaagcagttcccaggccctatcatgaacgtcactaccaactacaatgtggtcgtcaatgtgctcaacagcttagacgagcccctgctcatcacttgggatgggatccagcagcgcaagaattgctggcaggatggggctctcggaaccacctgccccataccgccaggttggaactggacctacaacttccaggtccgggaccagattggcagcttcttctacttcccaccccttggaatgcagcgtgcccgcggccggggacacggaaggtattaactgtcaaccaacccgggcggaccatcctccgcccccacttcgaccgcgcccccgagggggggaaaccgcggcttctttccttccggggaaccggagaacaataaataaaacacccccagccacccctgcccgaaaccacggcttccgacccn

SEQ ID NO: 24837 - protein, 141 aa, Zea mays
  misc_feature: Ceres CLONE 1396181-F
  misc_feature (31)..(138): Pfam Name: Cu-oxidase_3 Pfam Description: Multicopper oxidase
  misc_feature: SWISSPROT Homolog: EC 1.10.3.3 L-ascorbate oxidase
MGPPFLAVAVIVAFLAAAAQAADPFAFFDWDVSYITASPLGVPQQVIAVNKQFPGPIMNVTTNYNVVVNVLNSLDEPLLITWDGIQQRKNCWQDGALGTTCPIPPGWNWTYNFQVRDQIGSFFYFPPLGMQRARGRGHGRY

SEQ ID NO: 24838 - DNA, 672 bp, Zea mays
  misc_feature: Ceres CLONE 1396183-F
  misc_feature (672)..(672): n is a, c, t, g, unknown, or other
tcaccgcggtggcggccgctctagaactagtggatcccccgggctgcaggaattcgcacgagaccattacctagaacatcctaatcgaaaagggagtcggcactcgggtctcgacgtctcgtctcgtctcgcctggcctgaccgcattgccttggcttcatccgattcctcttcgcggcggcggaggagaggaatggcacgacgcatggtgtgctacgagaagctgaaccggagggacggtacggacttcaccaccacatgagatgcaagtcatgcctaggagacctaccctacgatgggatgatatgagtaggatatgaagagcaaagcatgagtagggcattttattgtactgtgatgcggtgctggcctggacgataggtacggaactagaaaaatgtgatctaccagacgtgatgcaaggaaaggatggccagcctgcccggtctactgtgaatagaatatgaccggccagatccgagacagagaactctccactcgatcaaatggagagattgcatggagagaagtcgagcgcatctatttatgtattagataatggatatgatgggccagaccctgggctaggactagaaaaagaacccaaccctaagaggaaaggccctcaccgtaatcctttcccttttttttaaaaatggaaaaggggccaan

SEQ ID NO: 24839 - DNA, 763 bp, Zea mays
  misc_feature: Ceres CLONE 1396185-F
  misc_feature: Encodes the peptide sequence at SEQ ID NO. 24840
  misc_feature (1)..(1): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (17)..(17): n is a, c, t, g, unknown, or other
  misc_feature (18)..(18): n is a, c, t, g, unknown, or other
  misc_feature (20)..(20): n is a, c, t, g, unknown, or other
  misc_feature (27)..(27): n is a, c, t, g, unknown, or other
  misc_feature (28)..(28): n is a, c, t, g, unknown, or other
  misc_feature (36)..(36): n is a, c, t, g, unknown, or other
nttgccccccacnnncnncncccctannaaccccanaatgcgcctttttcaaaactggagctccccgcggtggcggccgctctataatagtggatcccccgggctgcaggaattcgcacgagaccattacctagaacatcctaatcgaaaagctcaattccactgccaagattcgccactccgtccgttaccttcactcgctcactcacaatgcggcgccatggcgaggtacgcgtgatcttagctatggccgccgccgccgccgccgcgctcttggcgtcggcggccgtggccggacgagacggccggcagacctacatcgtccacatgtcccattccgccatgccggacgagttcgcggagcatgaggaatggtacgccgcgtcgctttcaggcgggtgtcggatgccgccaccgtgctgtacacctacagcaccctcctccacggctactccggcgcggctgacagcgcgcggaggccggcggcgctggagtcgcagcccaggggtgatcgtcgtcaaaccgggagggggcgagaacgagtttgacaccacccggaacgccccgagttccctggggctggaccgtcacggcacgcgccggtctcccgggagtcgggcaccgagaaaaaaacattctgtgtgtgtgccgaccgtagacaggaggctacgctccgctacaaacgcacgcaaaagacaccgcctcaccccatgaccgccgcgcctgagggcgccccggctcgcccgccagccacccacccgcg

SEQ ID NO: 24840 - protein, 167 aa, Zea mays
  misc_feature: Ceres CLONE 1396185-F
MRRHGEVRVILAMAAAAAAALLASAAVAGRDGRQTYIVHMSHSAMPDEFAEHEEWYAASLSGGCRMPPPCCTPTAPSSTATPARLTARGGRRRWSRSPGVIVVKPGGGENEFDTTRNAPSSLGLDRHGTRRSPGSRAPRKKHSVCVPTVDRRLRSATNARKRHRLTP

SEQ ID NO: 24841 - DNA, 802 bp, Zea mays
  misc_feature: Ceres CLONE 1396192-F
  misc_feature: Encodes the peptide sequence at SEQ ID NO. 24842
  misc_feature (1)..(1): n is a, c, t, g, unknown, or other
  misc_feature (397)..(397): n is a, c, t, g, unknown, or other
nttttccccccccccccccccccccccacccaccaaacatacatactcctccccaaatctggtgctccaccgcggaggcggccgctctatttctagtggatcccccgggctgcaggaattcgcacgagaccattacctagaacatcctaatcgaaaagattcatactgctcgcctcgccgtctttcccccaatctgttgctcctccaagctgcgggcgatcgccgtaccccggccgccgcagggaaccccctcgccatggccttgcaggggaagaagctcatcaacaaccccgacgatgtggtgacggagttcatcgaagggttggtggagacttacccgggtctgcagtacctcgacgggttccctcagattaaggtcgttcttcgtgctgatggnccagcgcggttcctatgacaaagttgcagccatctcggggtgggtggaagtggccatgaaccttccccatgctggaatttgttgcggccaggaatgttgaccagcggctgttctctggaaaaagttttcgcctcctccacctgttggattctattttacctgctaatccgaacttgaactggcctccaatggcgttgccttctaataagaaaagaaactaccttgggtgaaagaaccccacttttggaccaaactgctggagcaagccaaaaccctcgaagggtattaaggaatgggacgaacggcacattagtataaaaagagtgattggagcgacctttcctaccacgataagacggcaatatcccccgccacaaaaacacgaagccaccaaccccgcgcaag

SEQ ID NO: 24842 - protein, 52 aa, Zea mays
  misc_feature: Ceres CLONE 1396192-F
MALQGKKLINNPDDVVTEFIEGLVETYPGLQYLDGFPQIKVVLRADGPARFL

SEQ ID NO: 24843 - DNA, 724 bp, Zea mays
  misc_feature: Ceres CLONE 1396193-F
  misc_feature (334)..(334): n is a, c, t, g, unknown, or other
ggagctccccgcggtggcggccgctctagaactagtggatcccccgggctgcaggaattcgcacgagaccattacctagaacatcctaatcgaaaaaacaaaaaccaacgctccccctgcccccctctttcctccccagacccgcgctcccctccgtggcgtgcaacgcgttcctcggctcctgcaggcggcgacctcggaaaggcgggggcgtctcgtcgcgaggcatttgaggccaggattttttggtgctctcattgttagctgactggggagggtctggatctagcaatggccggaaaacacccacgggaggtggtcgccacgtgctttngggactttgacaaaggttatttggaagcgaagcacccccatcaaatcgggaggagaagaacaggggggcataaaaaatcaacacggattgaaaaaaactgggacacaaggaaaaaaatccctattgcaaatggcaaaaggcttacccaatatttggaaaaaaggatattttaattctggccccctttggtctggaagggagcggccccaaaaaaaaaatatctcaaaagccctttttttttttttaaaaaaaaaagaggggcccaaacccaaatattctgccaaaaaacaccgtgtccctttttttccaagagagaacctatgggtctcaaaaaaaacacccatgtcgcctcattcggggtccattataaaatttccccggggaaggggg

SEQ ID NO: 24844 - DNA, 625 bp, Zea mays
  misc_feature: Ceres CLONE 1396196-F
  misc_feature (223)..(223): n is a, c, t, g, unknown, or other
  misc_feature (226)..(226): n is a, c, t, g, unknown, or other
  misc_feature (227)..(227): n is a, c, t, g, unknown, or other
  misc_feature (239)..(239): n is a, c, t, g, unknown, or other
  misc_feature (240)..(240): n is a, c, t, g, unknown, or other
  misc_feature (246)..(246): n is a, c, t, g, unknown, or other
  misc_feature (247)..(247): n is a, c, t, g, unknown, or other
  misc_feature (251)..(251): n is a, c, t, g, unknown, or other
  misc_feature (253)..(253): n is a, c, t, g, unknown, or other
  misc_feature (256)..(256): n is a, c, t, g, unknown, or other
  misc_feature (257)..(257): n is a, c, t, g, unknown, or other
  misc_feature (261)..(261): n is a, c, t, g, unknown, or other
  misc_feature (262)..(262): n is a, c, t, g, unknown, or other
  misc_feature (271)..(271): n is a, c, t, g, unknown, or other
  misc_feature (548)..(548): n is a, c, t, g, unknown, or other
  misc_feature (575)..(575): n is a, c, t, g, unknown, or other
  misc_feature (601)..(601): n is a, c, t, g, unknown, or other
aagctggagctccccgcggtggcggccgctctagaactagtggatcccccgggctgcaggaattcgcacgagaccattacctagaacatcctaatcgaaaatttccagccgccaagccttctagaagcttcaagagctcgattcgatcggaaccctcgccatggccgacgaggcgaaggcgaagggtaacgcggcgttctcggccggccgcttcgaggaggcnggnncgcggcactttnncacggnnacgncncanntcgnncgtcttggnccccccaaggaaaccaaaacccccaccgggtccccccttccttaaactttccccaaaccccgggggttcgggggggggggcggggtttttggcccccttcggggtttctccccccccgggggtatttttccccccaaaaggggggttttctccccccccgcggggggggggggaaaaaaaaaaaaaaacccgccgggggggggtttttttaaacccccccccccaagggggggggggggacacaagaggggtgtttttttttttccccccccccccnccctttttggggggggggggggggggnggagaaaaaaaaaaaaaaaaaccacncccccccccccgcgctcggggggg

SEQ ID NO: 24845 - DNA, 651 bp, Zea mays
  misc_feature: Ceres CLONE 1396197-F
  misc_feature: Encodes the peptide sequence at SEQ ID NO. 24846
cgctcttaactagtggatcccccgggctgcaggaattcgcacgagaccattacctagaacatcctaatcgaaaaagcacgccttaaaaacgagatccctgtggtcaccactgggcaactgcgtcactgggcccaatcactagaaaccccaacaaacggaatttcacacatccggcgagcaataccgcaccgcaagtaagatcaaagaggaggcgatggctggcggcgggcagggggcgatttcgttcatgacgcggatggcgaaggtggcggcggggttgcgcgtgacgacatccgcagcctccacgtccttctacacggtggacggcggagagcgcgccgtcatcttcgatcgcgtgcgcggtgtgctcccgcgtacgatgtcagagggcacccatttgctggtccccatccttcagaagcccttcattttcgacatccgcactcgccctcacaggttctcctccacctccggcaccaaggacctccagatggtcagcctcacgctccgcgttctgtcgcgacccgacgtcgaacacctcgcggacatcttcacctccctcggcctcgagtacgacgagaaggtcctcccatccatcggcaacgaggtgctcaaggccgtcgtcgcgcagttcaacgccgaccagctcct

SEQ ID NO: 24846 - protein, 145 aa, Zea mays
  misc_feature: Ceres CLONE 1396197-F
MAGGGQGAISFMTRMAKVAAGLRVTTSAASTSFYTVDGGERAVIFDRVRGVLPRTMSEGTHLLVPILQKPFIFDIRTRPHRFSSTSGTKDLQMVSLTLRVLSRPDVEHLADIFTSLGLEYDEKVLPSIGNEVLKAVVAQFNADQL

SEQ ID NO: 24847 - DNA, 667 bp, Zea mays
  misc_feature: Ceres CLONE 1396202-F
  misc_feature: Encodes the peptide sequence at SEQ ID NO. 24848
  misc_feature (458)..(458): n is a, c, t, g, unknown, or other
aaactggagctcaccgcggtggcggccgctctagaactagtggatcccccgggctgcaggaattcgcacgagaccattacctagaacatcctaatcgaaaagaacacatacctaattatcacctgtaagccagctgaaccacatctcgtcgtgcacatccggagcccgggaacacacacacacattgccatggccatgcccatgcccaagcccgtcctgagcctgctcgtgcacctacacgccgccgtcctgttccttcccgccccggccggcggcgcggtctacaacgttctgcgctacggcgcgcgccccgacggcgtgacggacgcggcggggcccttcctccgcgcgtgggcggacgcctgccgctcgcccctcccggccgccgtgtacgtgccgccagggaggtacctggtgcggagcgccacgttcaccggcccgtgcacagccgcgccggnacgttcgccgtcgccgggcacggtcgtcgcccccgcggcctacggcgcgcgcggctccgtccggggaagggtggatcacgttcgagaaaatggacggcctcgtccgtcggcggcggcggcaacgctggacgggccgcggcagggcgctctgggcctgcaaacagcgcggccaagcgcgactgtccgacccccacgtccacttctgacga

SEQ ID NO: 24848 - protein, 159 aa, Zea mays
  misc_feature: Ceres CLONE 1396202-F
  misc_feature: SWISSPROT Homolog: EC 3.2.1.15 Polygalacturonase
  misc_feature (90)..(90): Xaa is any aa, unknown, or other
MAMPMPKPVLSLLVHLHAAVLFLPAPAGGAVYNVLRYGARPDGVTDAAGPFLRAWADACRSPLPAAVYVPPGRYLVRSATFTGPCTAAPXRSPSPGTVVAPAAYGARGSVRGRVDHVRENGRPRPSAAAATLDGPRQGALGLQTARPSATVRPPRPLLT

SEQ ID NO: 24849 - DNA, 653 bp, Zea mays
  misc_feature: Ceres CLONE 1396204-F
  misc_feature: Encodes the peptide sequence at SEQ ID NO. 24850
  misc_feature (653)..(653): n is a, c, t, g, unknown, or other
cgctcttaactagtggatcccccgggctgcaggaattcgcacgagaccattacctagaacatcctaatcgaaaaaatgaccattgcgtgatagatcgcaccgatctcggtctccgtgtctcactctcaagttgcagcagccagtcatttcgttggcaaccagggcagaaataaatatccgtggataagagctgcgctgtgtgctgctgagatatcaagaacggtagggtggaagacaaggccccgttctcgattaacccaagccaaagagtcagagggagagagagagagagagtcgtattggtcgtcacctgtcgaaggttttcggtgtctcctgagccacagctgctgctgctgctggaaccatggagatggaggccgtggagtcgcacggcggcgccggtcgccggacgcccaagagggatcgcggcatctcctgggcctgcgtcttcatcctggcgagtaactgcttccagttcatcgcctacttcgccgtgtcgacgaacctggtgaactacctcaaggaccgcctgcaccagggcagcaaagccgccgcgaacggcgtcaccaactggatgggcacgagcgccatcacgccgctcgtcgccgccttcctcgccgacgccttcctcggaagatactggaccattcggn

SEQ ID NO: 24850 - protein, 96 aa, Zea mays
  misc_feature: Ceres CLONE 1396204-F
MEMEAVESHGGAGRRTPKRDRGISWACVFILASNCFQFIAYFAVSTNLVNYLKDRLHQGSKAAANGVTNWMGTSAITPLVAAFLADAFLGRYWTIR

SEQ ID NO: 24851 - DNA, 648 bp, Zea mays
  misc_feature: Ceres CLONE 1396205-F
  misc_feature: Encodes the peptide sequence at SEQ ID NO. 24852
aaagctggagctccccgcggtggcggccgctctagaactagtggatcccccgggctgcaggaattcgcacgagaccattacctagaacatcctaatcgaaaaaacaacaacaacaacccgcacaacggcacgattctcctcctccgtccgcgtagctctcggtttcggcgatgtcggggcgcggcaagggcggcaaggggctgggcaagggcggcgccaagcgccaccgcaaggtgctgcgcgacaacatccagggcatcacgaagccggcgatccgtaggctggccaggaggggcggcgtcaagcgcatttctgggctcatctacgaggagacccgcggcgtgctcaagatcttcctcgagaacgtcatccgcgacgccgtcacctacaccgagcacgcccccgcagaccgtcaccggcatggatgtcgtctacgcgctcaagccgcagggcccacgtcctacgggtttccgggggtaggccgcctcccttctgaatgcttgatgggacgcccggggccccgtttggggcctaattgggcggcccaccgggaagttgggccgaatcttccctttcgggggggttcccgttctaaccccctttgggggaaaaattttcccgggtataaaaaagggaaacaccccccgt

SEQ ID NO: 24852 - protein, 159 aa, Zea mays
  misc_feature: Ceres CLONE 1396205-F
MSGRGKGGKGLGKGGAKRHRKVLRDNIQGITKPAIRRLARRGGVKRISGLIYEETRGVLKIFLENVIRDAVTYTEHAPADRHRHGCRLRAQAAGPTSYGFPGVGRLPSECLMGRPGPRLGPNWAAHREVGPNLPFRGGSRSNPLWGKNFPGYKKGKHPP

SEQ ID NO: 24853 - DNA, 683 bp, Zea mays
  misc_feature: Ceres CLONE 1396210-F
  misc_feature: Translation starting site: 338
  misc_feature (345)..(345): n is a, c, t, g, unknown, or other
  misc_feature (411)..(411): n is a, c, t, g, unknown, or other
  misc_feature (467)..(467): n is a, c, t, g, unknown, or other
  misc_feature (616)..(616): n is a, c, t, g, unknown, or other
  misc_feature (623)..(623): n is a, c, t, g, unknown, or other
tccccgcggtggcggccgctctataactagtggatcccccgggctgcaggaattcgcacgagaccattacctagaacatcctaatcgaaaaatcgatcccagccccaggccatggcgacgaggtggaggaggtcgctgctctgggtcgccgtcgtccagttcctgaccctgtgcgtcgccgagcatctcgtagtggaagcatacaaaaagtcctacattgtgtatctgggatcacatgcatatggccgtgatgcgtcggcggaggagcatgctcgcgcaacccagtctcaccaccacctcctggcatcgatcctcggcggcgacgaccaccaccaccatgagacnggcgcggcagtccatcttctactcctacaccaagagcagcatcaatggcttcgcggcgcacctggnaggagtcggtcgcgcagcagatcgcggagcaccctggaggtgggtggcggtgctgnagagcaagatgctcaagctgaacaccacgcggtcctgggacttcatggacctggagcgcgacggtcacgtcctccctgggctcatctggaaccacgctaggttcgggacaggacgtcatcatcgccagtctcgaacagcggagtgtggncccgagntccacagcttccaggacgacggcggggcagtggcagctttcggtggaagggctcctgtca

SEQ ID NO: 24854 - DNA, 650 bp, Zea mays
  misc_feature: Ceres CLONE 1396213-F
  misc_feature: Encodes the peptide sequence at SEQ ID NO. 24855
gctctcgaactagtggatcccccgggctgcaggaattcgcacgagaccattacaacatcctaatcgaacaacatcgatcactcgcgtgtctaggtttcctctctcaccatagcgcccgctctgtcgcccttcgttcacctctccttcctctcgtccctgcctgccagggagaggggaagtcagaggcacgaagtggcgcagagcagacgcccgtgaaccattgtagctgtccctgtcgtcgtcgtcgtcaacgaacccacacaaggaaaggatggagaagaagccgaccatcctcatgaacaggtacgagctcgggcgcacgctcgggcagggcaccttcgccaaggtgtaccacggtcggaacctcgcgtccggcgagagcgtggccatcaaggtcatcgacaaggagaaggtgatgcgcgtcggcatgatcgaccagatcgagcgcgagatctccgtcatgcgcctcgtccgccaccccaacgtcgtgcagctgcacgaggtgatggccagcaagagcaagattacttcgccaatggagtacgtccgggacggcgagctcttcgcccgcgtcgcccgcggacgggctcaaggaggacgcccgcgagaaggtacttccaccaggtcgtcggcgccgtcgacttctgcca

SEQ ID NO: 24855 - protein, 126 aa, Zea mays
  misc_feature: Ceres CLONE 1396213-F
  misc_feature: SWISSPROT Homolog: EC 2.7.11.1 Non-specific serine/threonine protein kinase
MEKKPTILMNRYELGRTLGQGTFAKVYHGRNLASGESVAIKVIDKEKVMRVGMIDQIEREISVMRLVRHPNVVQLHEVMASKSKITSPMEYVRDGELFARVARGRAQGGRPREGTSTRSSAPSTSA

SEQ ID NO: 24856 - DNA, 684 bp, Zea mays
  misc_feature: Ceres CLONE 1396214-F
  misc_feature (337)..(337): n is a, c, t, g, unknown, or other
  misc_feature (338)..(338): n is a, c, t, g, unknown, or other
  misc_feature (588)..(588): n is a, c, t, g, unknown, or other
  misc_feature (598)..(598): n is a, c, t, g, unknown, or other
  misc_feature (607)..(607): n is a, c, t, g, unknown, or other
  misc_feature (653)..(653): n is a, c, t, g, unknown, or other
  misc_feature (656)..(656): n is a, c, t, g, unknown, or other
  misc_feature (669)..(669): n is a, c, t, g, unknown, or other
  misc_feature (670)..(670): n is a, c, t, g, unknown, or other
  misc_feature (672)..(672): n is a, c, t, g, unknown, or other
ggagctccccgcggtggcggccgctctagaactagtggatcccccgggctgcaggaattcgcacgagaccattacctagaacatcctaatcgaaaaatcgcagaaattctccgcaacttcacagcgtatcatcgttttccatcgctcctactcctatcatccagaaaatctgagcggtattgatggcgcccaaggcggagaagaagccggcggcgaagaaggtggcggaggaggagccctcggagaaggcggctccggcggagaaggcccccgcggggaagaaggccaaggcggagaagcggctacctgcgggcaagtccgccggcaaggagggcgnncgacaagaaggggaggaagaaggcgaagaagagcgtggagacctacaagatctacatcttcaaggtcctgaagcaggtgcaccccgacatcggcatctcctccaaggccatgtccatcatgaactccttcatcaacgacatcttcgagaaggctcgccgcggaggccgccaagctcgcccggtacaacaagaagcccaccatcaccctcccgcgagatccagacctccgtccgccctcgtcctccccggngagctcgccnagacgcccnttctcggaggggtacaagggcgtcaccaagttcacctcgtcttagncgncttggagaaaaanngnttcctttgttgt

SEQ ID NO: 24857 - DNA, 663 bp, Zea mays
  misc_feature: Ceres CLONE 1396215-F
  misc_feature: Encodes the peptide sequence at SEQ ID NO. 24858
  misc_feature (565)..(565): n is a, c, t, g, unknown, or other
  misc_feature (567)..(567): n is a, c, t, g, unknown, or other
  misc_feature (644)..(644): n is a, c, t, g, unknown, or other
  misc_feature (663)..(663): n is a, c, t, g, unknown, or other
tccccgcggtggcggccgctctagaactagtggatcccccgggctgcaggaattcgcacgagaccattacctagaacatcctaatcgaaaacctcactctgtctcttcctcagtcccggcatcagcgctcaaaccctaacacgccacgcgatcccgatgcgcaggggtctgggcagcgaggcatcgttgcgccggcggcgcgggccggcgcggctttgggtggcagtggcggcgctggtggtcggcaccgtgtgcctcttctcctcctcttcggtcggcctgttgggcgcctcttacagggtccaggatgttgatgtaaataagttgtggagaactgcagattcaaatggttggagagcatcttctgcaccacgcacctactggcctcccccaccaactgaatctgagagcaatggctacttgcgcgtccggtgcaatggtggcttgaaccaacacgtagtgcaatatggtaatggctgttgtgctgcacggatcatgaatgctacactggtgctgccagaattagacacaaattcattctggcatgatgaaagtggctttgtangnaatttatgatgttcccactttcatcagacactggaatatgacgtccggatttgtatgagcattcctgaaacactacnaatggaaagaccaagatgn

SEQ ID NO: 24858 - protein, 139 aa, Zea mays
  misc_feature: Ceres CLONE 1396215-F
  misc_feature (137)..(137): Xaa is any aa, unknown, or other
MRRGLGSEASLRRRRGPARLWVAVAALVVGTVCLFSSSSVGLLGASYRVQDVDVNKLWRTADSNGWRASSAPRTYWPPPPTESESNGYLRVRCNGGLNQHVVQYGNGCCAARIMNATLVLPELDTNSFWHDESGFVXNL

SEQ ID NO: 24859 - DNA, 862 bp, Zea mays
  misc_feature: Ceres CLONE 1396216-F
  misc_feature (13)..(13): n is a, c, t, g, unknown, or other
  misc_feature (14)..(14): n is a, c, t, g, unknown, or other
  misc_feature (862)..(862): n is a, c, t, g, unknown, or other
tggtttttcctcnntcctccttccccctcccccccccgggcccccgccctaacctctgccgctccccgcggtggcggccgctctagaactagtggatcccccgggctgcatgaattcgcacgagaccattacctagaacatcctaatcgaaaaaaaacgactggctgtccgaacggggacgtctggttcctctcattccccttccacctcggtctctctctctctcctcccactgctcgccctctctctcttacgcgcgcgtgacaacctccctccctccactgcgcgcggcgcggtagcagcagcggcagcacccaccgactgatcgccggtggtcggggcgtgggcgatctgatgcggccgcgccggtgatggcagcgcaatccggtcgctgacgggggaagtagcgagcgaacgaccaattcccactaggtctctagacgctgaggagtggagtgtgaggcgacccgaagtgcgcgcgcttcttaataattggagtggttaaggcaacacgcagaatggatgtcttccccacacaccataccaccatccccctatattaccccccgggcgccaccctttcatagttcattattatttccaccaaccagaccttttctcgccccgtctccgtcgcatgtgccaaccccctggcgcccccacctcctgctgtatcaacccactcgtcacatgccttaccccggggcgccgtgtacagttctactgcatctatcgcaccgcgctccccgccgccaccccctcggcactccgctacacgccccagccaccgcccccgaacccccacctaccgtcccccctcccccgatccccccccgccccctcccccccccaacacactcgn

SEQ ID NO: 24860 - DNA, 670 bp, Zea mays
  misc_feature: Ceres CLONE 1396217-F
  misc_feature: Encodes the peptide sequence at SEQ ID NO. 24861
tccccgcggtggcggccgctctagaactagtggatcccccgggctgcaggaattcgcacgagaccattacctagaacatcctaaaaaaaatcgatcagtcgcgtgtctaggtttcctctctcaccatagcgcccgctctgtcgcccttcgttcacctctccttcctctcgtccctgcctgccagggagaggggaagtcagaggcacggagtggcgcagagcagacgcccgtgaaccattgtagctgtccctgtcgtcgtcgtcgtcaacgaacccacacaaggaaaggatggagaagaagccgaccatcctcatgaacaggtacgagctcgggcgcacgctcgggcagggcaccttcgccaaggtgtaccacggccggaacctcgcgtccggcgagagcgtggccatcaaggtcatcgacaaggagaaggtgatgcgcgtcggcatgatcgaccagatcaagcgcgagatctccgtcatgcgcctcgtccgccaccccaacgtcgtgcagctgcacgaggtgatggccagcaagagcaagatatacttcgccatggagtacgtccggggcggcgagctctttgcccgcgtcgcccgcggccgggtcaaggaggacgccgggagaaggtacttcaccagcttgggcggggccgtccaattctgccaaggcg

SEQ ID NO: 24861 - protein, 127 aa, Zea mays
  misc_feature: Ceres CLONE 1396217-F
  misc_feature (12)..(127): Pfam Name: Pkinase Pfam Description: Protein kinase domain
  misc_feature: SWISSPROT Homolog: EC 2.7.11.1 Non-specific serine/threonine protein kinase
MEKKPTILMNRYELGRTLGQGTFAKVYHGRNLASGESVAIKVIDKEKVMRVGMIDQIKREISVMRLVRHPNVVQLHEVMASKSKIYFAMEYVRGGELFARVARGRVKEDAGRRYFTSLGGAVQFCQG

SEQ ID NO: 24862 - DNA, 713 bp, Zea mays
  misc_feature: Ceres CLONE 1396219-F
  misc_feature: Encodes the peptide sequence at SEQ ID NO. 24863
  misc_feature (15)..(15): n is a, c, t, g, unknown, or other
  misc_feature (16)..(16): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
cccccctcccccccnnccnnnntttatttatttnnntggttgcccgggcccccaaagctggaactccccgcggtggcggccgctctagaactagtggatcccccgggctgcaggaattcgcacgagaccattacctagaacatcctaatcgaaaactcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggggtcggtgctccaagaccggtgtcgacggtctcccgccggggcctccggtttggccggcggtggcgaacctgttccaggtgatcctgaagcgactgcccttcatgtacgtgctgcgcgaccgtccgaaagaaagaaggcgccttcttcgcgaggtcgaggagggaaagcaccctgattgcgctaacaagaaggatccgccgcgacgatgtcatcgtggaaccagctctcgatgacgagcgacttgacccggggacgccccagccggccgtagctgccgcgcgaggagctgccgctgctctcctcctgcctcccctccgcgcggttcaccaacgcggaaggaatctgcaccggagagcacccccccccaaatat

SEQ ID NO: 24863 - protein, 97 aa, Zea mays
  misc_feature: Ceres CLONE 1396219-F
MDVNDVLLVVLAAALAAMWWGRCSKTGVDGLPPGPPVWPAVANLFQVILKRLPFMYVLRDRPKERRRLLREVEEGKHPDCANKKDPPRRCHRGTSSR

SEQ ID NO: 24864 - DNA, 678 bp, Zea mays
  misc_feature: Ceres CLONE 1396220-F
  misc_feature: Encodes the peptide sequence at SEQ ID NO. 24865
  misc_feature (678)..(678): n is a, c, t, g, unknown, or other
ccccgcggtggcggccgctcttcaactagtggatcccccgggctgcaggtattcgcacgagaccattacctagaacatcctaatcgaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcggtgtcgacggcctcccgccggggcctccgggttggccggtggtggggaacctgtttccaggcgatgctgcaccgacggcccttcaagaacgtggtgggcgccctccggcagaactacgcccccatcaccaccagcgatctgacacatgcaaccctcctcctggcctctctccccacccccccctctggtgttgcccccaacccaccgcccccgcgtctatagaccgtcactctccacccccaccactcaacccatcacaataatcaccactgcccccccctcctctcctcatctttcccccattcacctccaacaccacctctcccctccttccccctctcccaatctttcctatctccaacttatttgttttcattcn

SEQ ID NO: 24865 - protein, 114 aa, Zea mays
  misc_feature: Ceres CLONE 1396220-F
MDVNDVLLVVLAAALAAMWWRRCSKTGGVDGLPPGPPGWPVVGNLFPGDAAPTALQERGGRPPAELRPHHHQRSDTCNPPPGLSPHPPLWCCPQPTAPASIDRHSPPPPLNPSQ

SEQ ID NO: 24866 - DNA, 672 bp, Zea mays
  misc_feature: Ceres CLONE 1396221-F
  misc_feature: Encodes the peptide sequence at SEQ ID NO. 24867
  misc_feature (508)..(508): n is a, c, t, g, unknown, or other
tacccgcggtggcggccgctctagaactagtggatcccccgggctgcaggaattcgcacgagaccattacctagaacatcctaatcgaaaatccaagaagagcacgcccactcctccggctcttcttctccaccggcaccagtccaccacctcctgccaccgcgcggccccaaccaaccacaccgcagcgcagcaatggcgggcaacggcgccatcgtggagagcgacccgctgaactggggcgcggcggcggcggagctggccgggagccacctggacgaggtgaagcgcatggtggcgcaggcccggcagcccgtggtgaagatcgagggctccaccctccgcgtcggccaggtggccgccgtcgcctccgccaaggacgcgtccggcgtcgctgtcgagctcgacgaggaggcccgcccccgcgtcaaggccagcagcgagtggatcctcgactgcatcgcccacgggggcgacatctacggcgtcaccaccgggcttcggcggnacctcccacgccgaaacaaggacgggcccgcgctccagggcgagctgctcaagcatctcaacgccggaatcctcggcaccggcagcggagggcacacgctggccggccgaagtcacccgcgcggtcgatgcggttgataatcaaaaccctcctcgagggctacc

SEQ ID NO: 24867 - protein, 149 aa, Zea mays
  misc_feature: Ceres CLONE 1396221-F
  misc_feature: SWISSPROT Homolog: EC 4.3.1.5 Phenylalanine ammonia-lyase
  misc_feature (105)..(105): Xaa is any aa, unknown, or other
MAGNGAIVESDPLNWGAAAAELAGSHLDEVKRMVAQARQPVVKIEGSTLRVGQVAAVASAKDASGVAVELDEEARPRVKASSEWILDCIAHGGDIYGVTTGLRRXLPRRNKDGPALQGELLKHLNAGILGTGSGGHTLAGRSHPRGRCG

SEQ ID NO: 24868 - DNA, 760 bp, Zea mays
  misc_feature: Ceres CLONE 1396222-F
  misc_feature: Pfam Name: MBD Pfam Description: Methyl-CpG binding domain
  misc_feature (238)..(238): n is a, c, t, g, unknown, or other
  misc_feature (305)..(305): n is a, c, t, g, unknown, or other
  misc_feature (306)..(306): n is a, c, t, g, unknown, or other
  misc_feature (314)..(314): n is a, c, t, g, unknown, or other
  misc_feature (352)..(352): n is a, c, t, g, unknown, or other
  misc_feature (368)..(368): n is a, c, t, g, unknown, or other
  misc_feature (439)..(439): n is a, c, t, g, unknown, or other
  misc_feature (688)..(688): n is a, c, t, g, unknown, or other
tggagctccccgcggtggcggccgctctagaatagtggatcccccgggctgcaggaattcgcacgagaccattacctagaacatctaatcaaaaaattgaaattcccacgcgcccgtcgtttgccaccttccccaccagcaccaagcggcgagagcgggacggggcagagcaagagctagggataaccctcgcccaccatggcgacgcccggcgagcagcaggcaccggctgcggcgnagtaggtcgtgtccgtcgagatgcctgcacccgacgggtggaccaagaagttactccccagagaggnngaagatcngagattgtttttgtttcgcaactggcgagggaaataangaaacagaggcactangccaatacctaagggcacacctgggaggcctgctgcttcaaatttgattggggaactggtgataccccaangcgttctgctcgcattaacaagaaaggccaggttttttgatagcccaaaggggggaaaaaacccgaaaccgaaaaggaactccgggggaagaaagggtaggcagggaaaaaaaggaaccccctggaaatgaaaaaaccaaagaggtttaaacgggccgggccccccccagggaaatggccaaaagggaaacggccggggaaaataaccccgggtaaaaaggggaaggaaacccacacggaaacgggggncccctgaaaggggggaaaaaagggggggaaatcctccggccccgcgcacaagggaaaaaaaaaaaaaaaaaa

SEQ ID NO: 24869 - DNA, 697 bp, Zea mays
  misc_feature: Ceres CLONE 1396223-F
  misc_feature: Encodes the peptide sequence at SEQ ID NO. 24870
  misc_feature (382)..(382): n is a, c, t, g, unknown, or other
  misc_feature (436)..(436): n is a, c, t, g, unknown, or other
  misc_feature (437)..(437): n is a, c, t, g, unknown, or other
  misc_feature (491)..(491): n is a, c, t, g, unknown, or other
  misc_feature (496)..(496): n is a, c, t, g, unknown, or other
  misc_feature (538)..(538): n is a, c, t, g, unknown, or other
aagctggagctccccgcggtggcggccgctctagaactagtggatcccccgggctgcaggaattcgcacgagaccattacctagaacatcctaatcgaaaaattgttcgcgtcgtccgccttctctctctctctaacccactgccagccacctctgcgaccgtcgcgaccactcgccaagtaaattttcttccgcccacctgactacgcctcgacctcggcctcggcgccgcctccgtccgccggacgcggcagccatggcgccagcggtggggctcaagcgctccgccacgcagaccatcactctgccgccgcccgacacgcggctggctgtgcgcgatgtcatgcgctccacgatcccgtcgcagcccgccgtggcgccngcgtccacggagaggcaggcgccccgcgcggcgttgcaggggttctgtgcctgnnaggagtgaccggaggcgtgaactacgtgtgggacgtgggccgcaaagggaagancaggncggggcctccccgctgggccgcgtcagggccgggcgctgcanccccgcttcccctgccgaggaataatgcattcatagaacaaaggggggccggaagggttcagaagtggtacccttcaatggactaacggccgggggggtttaaaattctttggggggcaaatgggagttttaacaaaaaacttggggaggtctgggggg

SEQ ID NO: 24870 - protein, 62 aa, Zea mays
  misc_feature: Ceres CLONE 1396223-F
  misc_feature (60)..(60): Xaa is any aa, unknown, or other
  misc_feature (61)..(61): Xaa is any aa, unknown, or other
MAPAVGLKRSATQTITLPPPDTRLAVRDVMRSTIPSQPAVAPASTERQAPRAALQGFCAXXE

SEQ ID NO: 24871 - DNA, 728 bp, Zea mays
  misc_feature: Ceres CLONE 1396225-F
  misc_feature: Translation starting site: 155
  misc_feature (388)..(388): n is a, c, t, g, unknown, or other
  misc_feature (392)..(392): n is a, c, t, g, unknown, or other
  misc_feature (393)..(393): n is a, c, t, g, unknown, or other
  misc_feature (425)..(425): n is a, c, t, g, unknown, or other
  misc_feature (438)..(438): n is a, c, t, g, unknown, or other
  misc_feature (522)..(522): n is a, c, t, g, unknown, or other
  misc_feature (523)..(523): n is a, c, t, g, unknown, or other
  misc_feature (553)..(553): n is a, c, t, g, unknown, or other
aagctggagctccccgcggtggcggccgctctagaactagtggatcccccgggctgcaggaattcgcacgagaccattacctagaacatcctaatcgaaaaattcctgtctgtgcgcgcgcgcgcgtggcgccggccgagcggccgttgacccgatgaccggcgcggcggccgtcgatcccccggtgcctcggccgcggcggctcacggtcctcccgctcatcgcgctcatcttctacgacgtctcgggaggccccttcgcatcgaggactcggtccgcacgggcggcggcgcgctgctcccgatccttggcttcatcgtcctcccagtcctctggtcgctcccggaggcgctggtcacgggcgagctcgcatcggctttccccaccnacgnncggtacgtgggcctgggtgtccgccgccttcngccccggcgtggngttcctcgtcgggttctcccagtgggcgtcggggacgctcgacacgcgctctaaccggtggtgttctcgatactccgctccggnngggggggttggggcttgccgccgcggccgntttggttgggggtcttcggggttcacggccgggtcactactcaaaattaacggggggttcccaatcgtcggctttttcgggggtgggggtccccggggttttggtttccccgttcctcgggttaccgggggtcgggggcccccaagatcgccccggtcccggtggtttcgcatcg

SEQ ID NO: 24872 - DNA, 795 bp, Zea mays
  misc_feature: Ceres CLONE 1396226-F
  misc_feature: Encodes the peptide sequence at SEQ ID NO. 24873
aaagctggagctccccgcggtggcggccgctctagaactagtggatcccccgggctgcaggaattcgcacgagaccattacctagaacatcctaatcaaaaacatttcctctctctctttctctaactccgggtccctctctcctctctctattctctccatccttgcttctgggaagctcatcagccatggacgatgccactgcagaggaagaagcttccatgttcgagaccagccatgtcctcggcgccctgctggcctcctcgccgttgctggcgcgcgcctgggaccgctgcacagccgcctccgccgcagcgccgtggttcgttcacgccgaagacggcggaaaggtgtacgtgggggttctctgggctgcaggctggcgcttacggggccaggcgcggtggtggcccggtgacggatcccaacatctttgccgccggtggatcccccgctggccaccccgccggggcgtaatgtttccccaccgtttggtccgcccacgaaaccccaatcccggcccgcttacccggggaaagcccgcttgcctgagcaaggcacttttccccctcaaaatggttttccccgaaaacctctcgccgccaacccctgaattttctaaaagggtttctggaatccaaaaccagggggacaagggcaggggccggtttcacgcggccaatctccccttgggggggggcgcgctgggggcgcctctatgcgccgcttaaattacccgccgggtttctaacccggcaaaggctctccacccgcgtccccccctggggctggagg

SEQ ID NO: 24873 - protein, 180 aa, Zea mays
  misc_feature: Ceres CLONE 1396226-F
MDDATAEEEASMFETSHVLGALLASSPLLARAWDRCTAASAAAPWFVHAEDGGKVYVGVLWAAGWRLRGQARWWPGDGSQHLCRRWIPRWPPRRGVMFPHRLVRPRNPNPGPLTRGKPACLSKALFPLKMVFPENLSPPTPEFSKRVSGIQNQGDKGRGRFHAANLPLGGGALGAPLCAA

SEQ ID NO: 24874 - DNA, 745 bp, Zea mays
  misc_feature: Ceres CLONE 1396228-F
  misc_feature: Encodes the peptide sequence at SEQ ID NO. 24875
  misc_feature (216)..(216): n is a, c, t, g, unknown, or other
  misc_feature (507)..(507): n is a, c, t, g, unknown, or other
  misc_feature (508)..(508): n is a, c, t, g, unknown, or other
  misc_feature (585)..(585): n is a, c, t, g, unknown, or other
  misc_feature (609)..(609): n is a, c, t, g, unknown, or other
caaagctggagctccccgcggtggcggccgctctagaactagtggatcccccgggctgcaggaattcgcacgagaccattacctagaacatcctaatcgaaaagctctagcgaaggcacagccgccgctgtttcttcatcttcctcgcagcgccggcgctccatcttactctccctcccttactagcgcttgacacgcaggtgacggcggcagcgnacggcgctcaggctcgggctcttagtgacggcatcagcggcttcccctcccgcctcttgccagtcccatcgcgccctcgcctcgggtcctctgcacaccgtccagtgaccttgcgtgatggactggataaagttttgcagcgattttactgcaagtgatgggaaacagcatgcattgcttgataatcttaatcaggaattgtcccagaagtctgtactattgggtgatggttttaaactgtcagctgctgataatgatgtgtttgcaactggtcatccttttgtgatccgnngtagtgacagcgagttgcagaaatatccacatgtactggcgtggatggactacattcagaacactggtgggtgctgntacactttgcaaaagataaggtgncaagtctgactttgatccaccttctcatccaaggaagctgaataaaaagatgctgaatcagtcaaagaagcattcccgacaaaactgtgcagtcaatgaggtgctaaaacccaaaagcccgaatgaacttgggacc

SEQ ID NO: 24875 - protein, 94 aa, Zea mays
  misc_feature: Ceres CLONE 1396228-F
  misc_feature (59)..(59): Xaa is any aa, unknown, or other
  misc_feature (84)..(84): Xaa is any aa, unknown, or other
  misc_feature (92)..(92): Xaa is any aa, unknown, or other
MDWIKFCSDFTASDGKQHALLDNLNQELSQKSVLLGDGFKLSAADNDVFATGHPFVIRXSDSELQKYPHVLAWMDYIQNTGGCXYTLQKIRXQV

SEQ ID NO: 24876 - DNA, 667 bp, Zea mays
  misc_feature: Ceres CLONE 1396231-F
  misc_feature: Encodes the peptide sequence at SEQ ID NO. 24877
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (649)..(649): n is a, c, t, g, unknown, or other
aaagctggagctccccgcggtggcggccgctctagaactagtggatcccccgggctgcaggaattcgcacgagaccattacctagaacatcctaatcgaaaaattgttcgcgtcgtccgccttctctctctctctaacccactgccagccacctctgcgaccgtcgcgaccactcgccaagtaaattttcttccgcccacctgactacgcctcgacctcggcctcggcgccgcctccgtccgccggacgcggcagccatggcgccagcggtggggctcaagcgctccgccacgcagaccatcactctgccgccgcccgacacgcggctggctgtgcgcgatgtcatgcgctccacgatcccgtcgcagcccgccgtggcgccggcgtccacggagaggcaggcgcccgccgcggcgttgcaggggttcctgtgcctgtaggaggtgcacggtaggcggtggagctacgtgctgtacggtgnnngccgcgaaggggagtagcaggggcggggccgtccccgctgtggccgccgtcaggcccgtgacgctgcagtccgcgcttccggctgccgaggagataatgtcatcataagatcatatgggtggcctgaaggtttccagacagtgttactccttcatatgaacatacngggcctggaagggtctga

SEQ ID NO: 24877 - protein, 60 aa, Zea mays
  misc_feature: Ceres CLONE 1396231-F
MAPAVGLKRSATQTITLPPPDTRLAVRDVMRSTIPSQPAVAPASTERQAPAAALQGFLCL

SEQ ID NO: 24878 - DNA, 699 bp, Zea mays
  misc_feature: Ceres CLONE 1396234-F
  misc_feature: Encodes the peptide sequence at SEQ ID NO. 24879
  misc_feature (412)..(412): n is a, c, t, g, unknown, or other
  misc_feature (413)..(413): n is a, c, t, g, unknown, or other
  misc_feature (475)..(475): n is a, c, t, g, unknown, or other
ggagctccccgcggtggcggccgctctagaactagtggatcccccgggctgcaggaattcgcacgagaccattacctagaacatcctaatcgaaaaatcagctagcactagcagcgccgtcactgttcgaagagatcagcgcagcgaactcgcagccgagagatcgatcgaggccggccggggccgagatgggcagcgtcggcgtcggttgcggctcgccggacgaggagcagcagaccgagggcagtggccctctgccgccgccggctgtctgcgtcacggggtccaccggctacgtcggctcctggctcgtccgcacgctgctgcggcgaggctaccgcgtccacgccaccgccagggacacaggcaaggccttgcaggtgctccgcccggtcgtggaaagaagggaggnnaccggctcagggtgttcagggcccgacatggggcggaggaagggagcctcccacgccgccgncacgggaatgcgtgggcgctccttccccgtcgcgggcctccatgggacctcccacgtatcaccccgcccatcaagacaaacttcccaggaggaacggtgggggccaagcatgcttggagcccgcccccgagggagaaccatcaagggggctgggggtcctggcgtcccgccccggggaccgagcggcccgctttattctcccggccgcgcgcacgcccggttta

SEQ ID NO: 24879 - protein, 170 aa, Zea mays
  misc_feature: Ceres CLONE 1396234-F
  misc_feature: SWISSPROT Homolog: EC 1.1.1.219 Dihydrokaempferol 4-reductase
  misc_feature (75)..(75): Xaa is any aa, unknown, or other
  misc_feature (96)..(96): Xaa is any aa, unknown, or other
MGSVGVGCGSPDEEQQTEGSGPLPPPAVCVTGSTGYVGSWLVRTLLRRGYRVHATARDTGKALQVLRPVVERREXTGSGCSGPDMGRRKGASHAAXTGMRGRSFPVAGLHGTSHVSPRPSRQTSQEERWGPSMLGARPRGRTIKGAGGPGVPPRGPSGPLYSPGRAHARF

SEQ ID NO: 24880 - DNA, 742 bp, Zea mays
  misc_feature: Ceres CLONE 1396240-F
  misc_feature (196)..(196): n is a, c, t, g, unknown, or other
  misc_feature (255)..(255): n is a, c, t, g, unknown, or other
  misc_feature (272)..(272): n is a, c, t, g, unknown, or other
  misc_feature (277)..(277): n is a, c, t, g, unknown, or other
  misc_feature (308)..(308): n is a, c, t, g, unknown, or other
  misc_feature (349)..(349): n is a, c, t, g, unknown, or other
aagctggagctccccgcggtggcggccgctctagaatagtggatcccccgggctgcaggaattcgcacgagaccattacctagaacatcctaatcgaaaaacgccacgccacatcgcgtgcgagccccaaccgtcgccggcctcccaattaagccgcccccgcggcgcgatccggtgtccaccgctgctccgccgnaggaggtgaaggggaaagaaaaggagggggacacagggggatgctagaggcgaaagcgnccgtcgcgggcttcggngcggncggggcgggggggcacatccacggtcaccgngggtgggcggggccgctggtggcctccggccctgttttcgnggttcctcatcaacgggggggtttttttttcccccctcccgggggggtgttattctccttttccgcggttcccctccgggggctctcggggaagccttttttgggggaagccaaatttccccccaaaaaaggggggccagaaaagccccccacggggggggcccgggcccaaaaaaaccaaaaccaatttccgggtttccggggggaaaaaaaacccccctttgtgcccaaaagttaaagggggtttttcccccccggaaaaaaaaaaaaagcgggaggattttaaacccccaaggcccccccccgccgagaggggggaaaaaatttcttttgtgattatcggggggaccccctttatttttgagtttcccaaaaaaagaaggggggcccccc

SEQ ID NO: 24881 - DNA, 745 bp, Zea mays
  misc_feature: Ceres CLONE 1396242-F
  misc_feature: Translation starting site: 253
  misc_feature (300)..(300): n is a, c, t, g, unknown, or other
  misc_feature (376)..(376): n is a, c, t, g, unknown, or other
  misc_feature (377)..(377): n is a, c, t, g, unknown, or other
  misc_feature (606)..(606): n is a, c, t, g, unknown, or other
  misc_feature (607)..(607): n is a, c, t, g, unknown, or other
  misc_feature (630)..(630): n is a, c, t, g, unknown, or other
  misc_feature (689)..(689): n is a, c, t, g, unknown, or other
  misc_feature (691)..(691): n is a, c, t, g, unknown, or other
atagctggagctccccgcggtggcggccgctctagaactagtggatcccccgggctgcaggaattcgcacgagaccattacctagaacatcctaatcgaaaaattacccccaggccccagcgtgcgtggtctccttcctctcgtggcgacgaccgagcggccgtcgctgcctacgtgcccagtcctgttcgtcccttcgccggcgacggccacgacctggttataggcaaagtttgtcctgaactgttcatcatggtggaaggctgggtattctctgctttgttagtggtgtttctagcngtcacaacaccttgcgagtcattctacttgccaggtagttatatgcacacatatcagcaaggtgaagtaataaggnncgaaggtgaactctctcacttccattgagacagaactacccttcagttactacagccttccatactgtcgtcccagagatggggttaagaagagtgctgaaaacttaggcgagcttctgatgggtgatcaaatagataattctccgtaccgtttccgtgaaatgtcaacgaatctctgtatctgtgtactaccaccccacttgacgaggctaatgtaaagctctcagcnngcggtagccatgatctataccangtgaacatgattcttgatatcttcccggggagaggtcacagagcagatggattaccatncnggggacaggctatcagttggtatatccagaaggccctcttatgctacatcacaa

SEQ ID NO: 24882 - DNA, 713 bp, Zea mays
  misc_feature: Ceres CLONE 1396245-F
  misc_feature (224)..(224): n is a, c, t, g, unknown, or other
  misc_feature (227)..(227): n is a, c, t, g, unknown, or other
  misc_feature (228)..(228): n is a, c, t, g, unknown, or other
  misc_feature (258)..(258): n is a, c, t, g, unknown, or other
aaagctggagctccccgcggtggcggccgctctagaactagtggatcccccgggctgcaggaattcgcacgagaccattacctagaacatcctaatcaaaaaagttccatatccaacacacacagcaacgctcgctcggcactgtcactagctagttgctctactagaggggcggtatagagctgcctgcaatcccgcgctgaaaagggagatcgggagcgacnatnnaggcgtttgctcctggctttcttgcggggncctggccctgtgtggaactgggggcaacccggaaagggggaactttttaccaggaaacaaaattacctgggggcaattgcccccgacaggaatgggaaggggggggggggttttaaccttaaactggaccccccattccggtttctgggtttaaaaaaaaaaaaaggaaccctgtgcgccaaaaaacaacttttgaaaaaaggggggggggggagaaatcccctggggggggggcccaccctttttccttgggttcccgggggggggggccccaaaaattattttttttttcttttggtaaaaaaagggggggggggctttcacgtgggttacacaaaggtttttccccgggaaggggcccggccaaaaaaaaagaatcccccccctgggtgggaccaaaaaaggggtgttgcaaccaaaaaatttcgggggaggcccaccccggggtatttctt

SEQ ID NO: 24883 - DNA, 677 bp, Zea mays
  misc_feature: Ceres CLONE 1396246-F
  misc_feature: Encodes the peptide sequence at SEQ ID NO. 24884
  misc_feature (294)..(294): n is a, c, t, g, unknown, or other
  misc_feature (479)..(479): n is a, c, t, g, unknown, or other
  misc_feature (522)..(522): n is a, c, t, g, unknown, or other
tccccgcggtggcggccgctctagaactagtggatcccccgggctgcaggaattcgcacgagaccattacctagaacatcctaatcaaaaaaatatccccacctgctagccgagtattcagacctctccgatctccactctcctctcgcaccaccaaaaaaccgtccccaccgttcgccatgagctccgaagccgaatgctcagctccagccgccgccgcgccgtatggcacgtgtgtcgtcagtgtgcagatcgacacgaccgcgccgttcgagtccgtgcggaagggcatgnaccgattacgaggcagcgccgcctggagctacgacctcgtcatgcgcatgcctcgcgccctgcaagaaacatgaacactctgaccaagctgcagaggccatcaacgccgaggagcatgctgcacagctagagaacgagctggcagttaaagagagggagactcttgatgctgctcaggagctggnagcaacaaagagatcctagcagagctggaactgaagatacggnaaggagccactgaacatcccctgaagagctgctgaccaggttttctgaggcggtagctcacagcagaacctgaaacaccacattggttggggggggggaaatggaaggggaaagaaaaccctttcgggtttgggtccgggggaatcccgacaggg

SEQ ID NO: 24884 - protein, 62 aa, Zea mays
  misc_feature: Ceres CLONE 1396246-F
  misc_feature (39)..(39): Xaa is any aa, unknown, or other
MSSEAECSAPAAAAPYGTCVVSVQIDTTAPFESVRKGMXRLRGSAAWSYDLVMRMPRALQET

SEQ ID NO: 24885 - DNA, 714 bp, Zea mays
  misc_feature: Ceres CLONE 1396249-F
  misc_feature (383)..(383): n is a, c, t, g, unknown, or other
  misc_feature (384)..(384): n is a, c, t, g, unknown, or other
  misc_feature (403)..(403): n is a, c, t, g, unknown, or other
  misc_feature (404)..(404): n is a, c, t, g, unknown, or other
  misc_feature (483)..(483): n is a, c, t, g, unknown, or other
  misc_feature (484)..(484): n is a, c, t, g, unknown, or other
  misc_feature (497)..(497): n is a, c, t, g, unknown, or other
  misc_feature (550)..(550): n is a, c, t, g, unknown, or other
  misc_feature (551)..(551): n is a, c, t, g, unknown, or other
  misc_feature (569)..(569): n is a, c, t, g, unknown, or other
tccccgcggtggcggccgctctagaactagtggatcccccgggctgcaggaattcgcacgagaccattacctagaacatcctaatcgaaaaggccagcgtttcaacagtaatctctctgtgcctgcgacgacgactaggtgggttaccgccgtcgcgccgccgccgccgccgccgtcatactacaggtgcgaggccttcatcggtatcttaacaggcgacgaacaccaaccaggtaacttcgtcggtatcttcacttcaccgacggcgacgagcacgaactcgaaccttttttttccccaaaaattagccccctccctgccctgcggaccctgccccagtctgcactctacgatggcggcgcctccggccacggctcccgcgnncctcccggtgtctctccgnntgccaaagtcgtgctggacctgctgagcgagctcccagcttcgtttggccgtctcggcgccttctactgacctccgggnnaaagtaggagcgnaatccttcagcgccggggggccaaggtggccacttggccgtgcagagagccgnnaacttggtggatgtgggnagccaaaaagggccggggaaagctcaaggaatggctcgctttgtccccggaaaaaaagggtttcacggtggggaaggggcccaaggccttttgggcgctccaggaacccaagagtgcggggggaaaggttggtttttcaaaaacg

SEQ ID NO: 24886 - DNA, 736 bp, Zea mays
  misc_feature: Ceres CLONE 1396250-F
  misc_feature: Encodes the peptide sequence at SEQ ID NO. 24887
  misc_feature (393)..(393): n is a, c, t, g, unknown, or other
tggagctccccgcggtggcggccgctctagaactagtggatcccccgggctgcaggaattcgcacgagaccattacctagaacatcctaatcgaaaaaccagctttccccttctctccggtccgggaatcggaagctcagggcagaagccatggggcagacgcatcttttgttgctcgcttgtttctgggtcctgtcaacatgctccttgctacttgatgcttcctccgatggactgttaagaatcaacctgaacaagaagagactggacaaggaagctttgactgctgcgaaattggcgaagaaggagagccaccttcgaaggtctgtgggtgctgaccagtatctcagtgcctcaactgatgacatagtccctttggacactacctggacnaccagtacttttggaagatcagcatcggcacgccacacagaacttcacagtgatattcgaactggagctcccacctggtgggtcccctcatccagggctactttttcgatgggcgggtacttacccacggatcccaggcacccaggtccaaactttaaccaagaaggggggaacctggccaaaaaactatagggtcggggaaaaccgttgcttcttagaggggaaaaattgggttgggtggaacacctggggggggcaacacaaatttttcgggggaaactcggaaaccccccctttctcttttttgggggaattggggggaatttttgggccccgatttcct

SEQ ID NO: 24887 - protein, 144 aa, Zea mays
  misc_feature: Ceres CLONE 1396250-F
MGQTHLLLLACFWVLSTCSLLLDASSDGLLRINLNKKRLDKEALTAAKLAKKESHLRRSVGADQYLSASTDDIVPLDTTWTTSTFGRSASARHTELHSDIRTGAPTWWVPSSRATFSMGGYLPTDPRHPGPNFNQEGGNLAKKL

SEQ ID NO: 24888 - DNA, 812 bp, Zea mays
  misc_feature: Ceres CLONE 1396251-F
  misc_feature: Encodes the peptide sequence at SEQ ID NO. 24889
  misc_feature (15)..(15): n is a, c, t, g, unknown, or other
ggccccccccccccncccccccgatccccgcgggtttttcgaccgggaaaactggagctccaccgcggtggcggccgctctagaactagtggatcccccgggctgcaggaattcgcacgagaccattacctagaacatcctaatcgaaaaagagcagccgacaactctctaccgtccgagaccccaagcaccagcgcggcggcggcggcggcggcgaccatggctgtcgggaagaacaagaggatctccaagggaaagaagtttaagatctgttccacagatcacgcgtgcgcgctcgcgaatcgggggttcacacatagcttcgtcgttttgaatttgatgtactaatggagtctaagggtgggaagaagtctagcagtagtcgttccatgatgtatgaaggtccccttgctacagcaattgaggacgttcgacctgccgggaggcgcgaaaaagctcccaggcctgctgcttactccaactggcgcaaaggagccatccctgatatccccttttgggctccccgggttctaaataggcttagggtttttctgtttccgaaacctttcagatttcttaaccacacccccctcggagctggctgttttccctggacaaacgcgacccagtctcccccaaggtcttggccttcccatgggaggccctcccctcccctccaatccaacggggggggtggggggtttccgggagcaccccgggtcgccaaagggcgggggccccttcccccgggtgtcttgaagccgctcccacccacacgcccaccttacacccccgccggcgcaggcggaagg

SEQ ID NO: 24889 - protein, 155 aa, Zea mays
  misc_feature: Ceres CLONE 1396251-F
  misc_feature (1)..(51): Pfam Name: AdoMetDC_leader Pfam Description: S-adenosyl-l-methionine decarboxylase leader peptide
MESKGGKKSSSSRSMMYEGPLATAIEDVRPAGRREKAPRPAAYSNWRKGAIPDIPFWAPRVLNRLRVFLFPKPFRFLNHTPLGAGCFPWTNATQSPPRSWPSHGRPSPPLQSNGGGGGFPGAPRVAKGRGPLPPGVLKPLPPTRPPYTPAGAGGR

SEQ ID NO: 24890 - DNA, 675 bp, Zea mays
  misc_feature: Ceres CLONE 1396252-F
  misc_feature: Encodes the peptide sequence at SEQ ID NO. 24891
  misc_feature (440)..(440): n is a, c, t, g, unknown, or other
  misc_feature (441)..(441): n is a, c, t, g, unknown, or other
  misc_feature (446)..(446): n is a, c, t, g, unknown, or other
  misc_feature (479)..(479): n is a, c, t, g, unknown, or other
  misc_feature (501)..(501): n is a, c, t, g, unknown, or other
  misc_feature (632)..(632): n is a, c, t, g, unknown, or other
tggagctccccgcggtggcggccgctctagaactagtggatcccccgggctgcaggaattcgcacgagaccattacctagaacatcctaaaaaaaaaacggttaaacccatggccgctaatcgacgccgccgcctcggcggtcgcgccgcccccaccccggcgagtggctcaactccgcttcttcagcactcgcagacccggaatcctatccctaactgccaccagctgctccccctcccctccgcccccggtcgctgcggaggtgcctgcggcgccacaggaagcgaagtcgaagccgaggccacggcggtacccgaagcagtaccccggcgagtcggtgggcgttgctgaggagatgcgctttgtcgccatgcgcctgcgtaaccccaagcgcaccaccataaaagacaagtcggggacggaggacgcggacgccggnngcggngggtgtcggagggcgaggctgaggaggacgacnggcggcggcgtgaaggaggaancacgaggaggaggatgagggcgagctcgaggaaaggggaatggtgccagccaatgggagggggttcgtgccgatacctgggtggacagcaggctcgtcttcggaccatccaaaggcgggtccggggcgaantccaccgatgtccgcctggggagtcacagttctcatccccatt

SEQ ID NO: 24891 - protein, 53 aa, Zea mays
  misc_feature: Ceres CLONE 1396252-F
  misc_feature (29)..(29): Xaa is any aa, unknown, or other
  misc_feature (49)..(49): Xaa is any aa, unknown, or other
MRFVAMRLRNPKRTTIKDKSGTEDADAGXGGCRRARLRRTTGGGVKEEXRGGG

SEQ ID NO: 24892 - DNA, 832 bp, Zea mays
  misc_feature: Ceres CLONE 1396261-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (47)..(47): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
nnnnnnnnnnnnnnnnnnnnnnnnnnnnnnccactaccccaactcantagcnnnnnggannntcaaagctgggactccccgcggtggcggccgctctagaactagtggatcccccgggctgcaggaattcgcacgagaccattacctagaacatcctaatcgaaaaacagactacagagcgtagagcgagtgggtatcggacacttctctggcaattgcagattatctccgaatctgtatgaactgactgccgcggtctattccgtctgaagaccctcctcctacctaattatttttctctgtcgtgacgtgaaatccccagcgcgcagcttcttgatccgttccggctgatcccgtggaccggactttggggttgggggaggccctctgtctccatggatgaggcagaagggctggttgttgcaagaaggagggtgggaggcggggaaccaaagaaagctcctccctccttccactttccacagggatgggttcgcccttttaccccaggtggatgggattctggttgaatggccaaagggggcgccccctggccgttaaaaggggggcacttaaccaggggaaaatttgggaaaaggccatggtttttttttccctccccaaagggaaaatggaaatggtctggcgaaaaggggttgggccctaacctaccgggaaattggccaaaaaaacaccctaggtttccttttatttgtggaaaggggaaaacctttccttcctaaaggccaaccccttcggaggggttgcaaaaaaaaatgggttacacccctttgggccaagggggaaaatgggctattcctccccctccccg

SEQ ID NO: 24893 - DNA, 702 bp, Zea mays
  misc_feature: Ceres CLONE 1396262-F
  misc_feature: Translation starting site: 405
  misc_feature: SWISSPROT Homolog: EC 2.3.1.74 Naringenin-chalcone synthase
aaagctggagctccccgcggtggcggccgctctagaactagtggatcccccgggctgcaggaattcgcacgagaccattacctagaacatcctaatcgaaaaattaagactagctaactagcgtgaaagagctcctccgacgactactagctctcgcttgctccgacgacccctgccggccgcctctggtacaacgtacgagaggaagagagacgatcgatggccggcgcaccgtgaccgtggacgaggtgaggaaggccagcgcgcgaccggccccgccaccgtgctggcccatcggacggcgacgcccgccaactgcgtgtaccaggccgactacccggactactacttccggatcaccaagagcgaccacctcaccgaccttcaaggagaagttcaagaggatgtgcgaaaagtcgatgatcccggaagcggtacatgcacctggacggaggagttccctgtcggagaacccgagcatgggcgcgaaactggcggccggccctggaccgggggaaggaaggggtgggtaaccgagttcccaaacttggggaaagggcccccatcaaaaagagattaaggggggggggccacgcccaagccgggaatacaccacccgggcgttttgcgacgacgtcggggtgggcacaatgctggggcgacaagaacccaccggcggtcgggcggcgggcacggggccgg

SEQ ID NO: 24894 - DNA, 788 bp, Zea mays
  misc_feature: Ceres CLONE 1396263-F
  misc_feature (15)..(15): n is a, c, t, g, unknown, or other
  misc_feature (20)..(20): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
tgtttcccccccacnccccnccccaccctcccccccataaatcacnnnncccacaactggcgctccccgcggtggcggccgctctagaactagtggatcccccgggctgcaggaattcgcacgagaccattacctagaacatcctaatcgaaaagcattgcattgcataaacctctcgtgggaagtgcaaacaccaaatccgcaatctatctatctatcagccattcaggcctgcaggctgcacttctctccactgcacactagagcgagctgccacaagacaaggacacaatgccacccatacccaagagaggcgagcatctcctgggcctcctaattgtcggaatgcgctgccaccgccggcaccgccgccggcaccgtcaccttctaccccgtccgcgtagtccgccgccgccgagcactcgcacgccaccgcctgtacccggagctctgcctgtcaaccattcgcggacatccgggcacctaaacaaaaagcccgcttcccggaacgtcatctggggcggccgtgaaacccgaaccgagcgcagagatggtaccccccatcccaagccacttgctctaattatccggtagggaaaggtcccctgaacggagaagggaacgccccgtggtcaattcacacacccggcctccgaacctatatcgccccccaactaagagaaaaacacattccgatgccaaaatacccccgctaacttgggcgggtctccacccccccgcgaaaacgaagtttaaattaacccaaccacaccccatcgctacccccc

SEQ ID NO: 24895 - DNA, 669 bp, Zea mays
  misc_feature: Ceres CLONE 1396264-F
  misc_feature: Encodes the peptide sequence at SEQ ID NO. 24896
tccccgcggtggcggccgctctagaactagtggatcccccgggctgcaggaattcgtacgagaccattacctagaacatcctaagaaaaaaggaattctgccttcttctctcatcttcctgctcaacatcagtagcagctttagctgtagcagcgccaccggccaccgccacgctatggccaccacgttgcacaagcccctgggggcgatcaccgttgacgacctcgccgcggaggcgcctgggtcggacgccaccgcgctccacgcagcgctccggcgcgcgctcgactcgcacggacccaccgaagtgtggggcgagctctgccggtccgtgctctgtccgtctgtccccttcgccgtccaccggatgctctactacggttgcttcgccgtgttcccgactcccacgccgccgcctggacgcccgaccccaaggaggctgtcttgaacaatgtcggccgtgtcctcgaggcgcgtgataggaacttcatcgaggacacgtacaaggatcccatcaccagtttcccagaccatccacgagtgctccgcgagaaacccagaggggtacctggaacatggtaattcgatgatacgagatcattgatgacgcgaacccgctgcctgcatctgacatagcgaccctgtgtactgtgaggagttacgtgccta

SEQ ID NO: 24896 - protein, 90 aa, Zea mays
  misc_feature: Ceres CLONE 1396264-F
MATTLHKPLGAITVDDLAAEAPGSDATALHAALRRALDSHGPTEVWGELCRSVLCPSVPFAVHRMLYYGCFAVFPTPTPPPGRPTPRRLS

SEQ ID NO: 24897 - DNA, 731 bp, Zea mays
  misc_feature: Ceres CLONE 1396266-F
  misc_feature: Encodes the peptide sequence at SEQ ID NO. 24898
  misc_feature (271)..(271): n is a, c, t, g, unknown, or other
  misc_feature (281)..(281): n is a, c, t, g, unknown, or other
  misc_feature (355)..(355): n is a, c, t, g, unknown, or other
  misc_feature (456)..(456): n is a, c, t, g, unknown, or other
gctggagctccccgcggtggcggccgctctagaactagtggatcccccgggctgcaggaattcgcacgagaccattacctagaacatcctaaaaaaaaaaatcacacacccacagagcagagagggggagaggctccaaaccctagccacacacgacgcaacgcaacgcaacgcaacgccgatggggtgcgcgcaggctaagtgctgcctaccgcggcacccgaggaggggctccgacgctgacgccgttggcggaggcgccacgctcggncgcgccgcgntgcccggctccgggctggtgctggagtacgccgcgctggctgtggctgggctgtacacggactcacaggccggnagtcccagacgcgcatcttgacgccacgtacttcgggtaggacccggacctcaccttctcgctgggttcgaatgcatgggatcggctctacggcctggggntggttttgggggggtagggttcccggggccttttggctttttttctttatggaaaggggggggacccaagggtgctgttccccagagggatgtttgggtccccaggataaatgggaatttttttcaaaaggtctcctttttctctgggggacccgttttctcaagggccctcatagcccggggggttccccccggcaacacgggggtttccccctcccccgcggcccacaatggggggggggaggggggaaatattttccagaaaaaacgtgggg

SEQ ID NO: 24898 - protein, 64 aa, Zea mays
  misc_feature: Ceres CLONE 1396266-F
  misc_feature (34)..(34): Xaa is any aa, unknown, or other
MGCAQAKCCLPRHPRRGSDADAVGGGATLGRAAXPGSGLVLEYAALAVAGLYTDSQAGSPRRAS

SEQ ID NO: 24899 - DNA, 872 bp, Zea mays
  misc_feature: Ceres CLONE 1396267-F
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (336)..(336): n is a, c, t, g, unknown, or other
  misc_feature (337)..(337): n is a, c, t, g, unknown, or other
  misc_feature (340)..(340): n is a, c, t, g, unknown, or other
tttttcccnnnnnnnccccggtccgccctgcaccgagtgtgtttttttcaaagctggaactcaccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctgcctgccatgtgnntgncgtcggtgctcaagaaccggcgggtgtcgacggcctccccgcggggccctcccgggttggaccggtggtcgggaaaaccgtttccagggggatcttggaagggacggacccttttttggacaaagggatgcccgaaccttccgaacaaaaaaccaaccacaaccaatcatctccaaaattctgtaacaggaataaatacccccccgaccgagcgggcgagaaaccccgggtgcgggtaacctcttatccgccacaaaaaagcgcgtataggtggattactatgctctcgcccaacaggtataacaccctgcgcttccacccgctacccatcccgccctcacccaacaccccccccccttctttgtttaccgggaagactcctaatctcgccatacatgtgacgatccattgatggataccaacttaaatgaatatattaacaaaaacctccaacaactcccaaccgaacccaacaccccacgccgcccgccgacgcggggtcggggaaccgtccgtaacactccacacaaat

SEQ ID NO: 24900 - DNA, 672 bp, Zea mays
  misc_feature: Ceres CLONE 1396268-F
  misc_feature (295)..(295): n is a, c, t, g, unknown, or other
  misc_feature (296)..(296): n is a, c, t, g, unknown, or other
  misc_feature (329)..(329): n is a, c, t, g, unknown, or other
  misc_feature (377)..(377): n is a, c, t, g, unknown, or other
  misc_feature (403)..(403): n is a, c, t, g, unknown, or other
  misc_feature (417)..(417): n is a, c, t, g, unknown, or other
  misc_feature (418)..(418): n is a, c, t, g, unknown, or other
  misc_feature (630)..(630): n is a, c, t, g, unknown, or other
ggagctccccgcggtggcggccgctctagaactagtggatcccccgggctgcaggaattcgcacgagaccattacctagaacatcctaatcgaaaaaacgcgcctacgcttcgtcaacaccggaaccgcccccaccccgccccgagcgccaattgcaccgccgctcccggccaaaccggccaagtcaacggcgcatccacttctccttaccatcccggaggtaatcttgcgccgattcggtgccgatttgcgccatccgcgaccggaggctccgccgggtcttgtgttcttgcgnngcgggggctcaggacaacctggcctctgcttgnatggattcggggcgttcggcgcctccagctcgcgatctttcctggcgntttcgtcgaccgctggtcaacctggnccgtcggtcccggnngctcttcacctccgtgctgcctggccacgtcgctttagtcaagtcttggccaagaatttagctatctccggtcaaaaggcttaacgaattcttggatgggtggctccttggaggagagaacccgggtccctgtttccgctcttgggccccagaatgtctgaaaacaaaccgctccctcctccccgggaaaggggttccggggccccttgggnttggccccccccgaacccgtcccagaaaaaatctttgcgccg

SEQ ID NO: 24901 - DNA, 678 bp, Zea mays
  misc_feature: Ceres CLONE 1396269-F
  misc_feature (497)..(497): n is a, c, t, g, unknown, or other
tccccgcggtggcggccgctctagaactagtggatcccccgggctgcaggaattcgcacgagaccattacctagaacatcctaatcaaaaaaaatctggaatcctttcacgccgccactctcccctttttccttctctcttcgtcgttgtggctcctgccttcctgcctcggcgcatcgactcgcggagagggacagcacagcgcctcctccccatcctttctccattcccagatcgaaggtccataaaaaaccatccttttgcatctgattgagcactgtctttgtgcaagagaacaatttagttgtacatacaaacaaaaagaagtgggagtatttttcagagtttattagaagagactgtttcgaggacccaggtcagagaaaggcgagaagctttagcagcggcaatggtctggtcaatggacccgcaggtgaccgtcacggcgactgggtgtcagccgtggtggcgctgatgaagctgtgtggcctgggcgntgatcggcctgctctcgcccaacccggcgggttccaggtcggggcccagggccaactttcaagctcctgaggaaagttcgtctttcgggttctttcttccctggccctcatcttcgcaaccttgggggaaaggcgggccaccttagaaaacgcccccgcggacgggggggggccacccccg

SEQ ID NO: 24902 - DNA, 737 bp, Zea mays
  misc_feature: Ceres CLONE 1396272-F
aagctggagctccccgcggtggcggccgctctagaactagtggatcccccgggctgcaggaattcgcacgagaccattacctagaacatcctaatcgaaaaacattccatcggtcgtgaaaagaaaaagggaaacaaaccaagctagagaaaagaagaaggtactacatactagctagctagcttagctatgggcaccatcgtcgacgctgacgtcgggttcgcggtgaagaggacgagcaggtcgctggtgccgcctgcgtcggcgacgccgcgggagacgctgcggctgtcggtgatcgaccgcgtggcggggctgcgccacctggtgcggtcgctgcacgtgttcgccgcgggcggcgacaagaagcggcagcaggcgacggcgacgccggccaaggcgctgcgggaggcgctggggaagacgctggcggactactacccgttccgcggggcgggtccccggcgcccgcccccccaaggccgcgcccccaacagcaccgcgccgcccccccccctcccgcctcccccccccactactcgcccggccgccgctacgcacccccccggccgccttaccatggcctcttgcgccctctccgctcggcctggcactaacacgacgtcttgccccctcgcccgcggccccagccaccccaccccccgctccgtgcgtcgccccctccccctcccccccctcaccacaaccctttcaccctcatacccccccctccaccc

SEQ ID NO: 24903 - DNA, 638 bp, Zea mays
  misc_feature: Ceres CLONE 1396273-F
  misc_feature: Encodes the peptide sequence at SEQ ID NO. 24904
  misc_feature (328)..(328): n is a, c, t, g, unknown, or other
  misc_feature (351)..(351): n is a, c, t, g, unknown, or other
  misc_feature (516)..(516): n is a, c, t, g, unknown, or other
  misc_feature (527)..(527): n is a, c, t, g, unknown, or other
tacccgcggtggcggccgctctagaactagtggatcccccgggctgcaggaattcgcacgagaccattacctagaacatcctaatcgaaaaattctctcagtctctctccatccaccacccgacccgatagtgtcctagacgccgctaccgccgccaaccaaccactcttctcctacgccgccgccgccgccgatcccgtcgcgatgagccacgacaccggcgccggcgtggagtccctctcgctggacctgctggcccacgcgctggcggccgtgcgcgacccgcgggaccgcaagtcgtgccgcctcgccagccgcgccttcgcgncgcgccgaggccgcgtcccgcgncgccgcgcggggtgctgcgccgggacgggctgccgcgggcgctgcgcgccttcccggcgctgtcctcgctcgacctctccgcgtgcgcggggctcgacgacgcctccctcgccgccgcgctgcccgaggagccgctgcccgtccgccggtgcgctgggggggggnccaaggggggnccaatgggccgagccgaaagccgttaggcggtggtgaccgaagggccgaggacaggaacgctttgggggcccggacactgggccttggagatgtgcagactaccctggacg

SEQ ID NO: 24904 - protein, 119 aa, Zea mays
  misc_feature: Ceres CLONE 1396273-F
  misc_feature (42)..(42): Xaa is any aa, unknown, or other
  misc_feature (108)..(108): Xaa is any aa, unknown, or other
MSHDTGAGVESLSLDLLAHALAAVRDPRDRKSCRLASRAFAXRRGRVPRRRAGCCAGTGCRGRCAPSRRCPRSTSPRARGSTTPPSPPRCPRSRCPSAGALGGGPRGXQWAEPKAVRRW

SEQ ID NO: 24905 - DNA, 719 bp, Zea mays
  misc_feature: Ceres CLONE 1396274-F
aaagctggagctccccgcggtggcggccgctctagaactagtggatcccccgggctgcaggaattcgcacgagaccattacctagaacatcctaatcgaaaagccatcgccatttgcgatttctttcgaggaaaaagggaagcaagcgcggaaatactccacagataccactcacctaccgctccgatccggccaccaagcgcaaccaatatctcgctccctttctctttctccgtctccctcctccgcacagcgcacgcgcaggaggccgctgccgggaggcccatctctatctctctccgctggatcctccggcctctcgcggtccggtggagcggagatccggccgctcgggcgtcggctgcttcctcgttctgccggagcaagaagctggcatcccgccatgtcgtcaccgatgccctcccctactctgaaggacatctctccacgcctacaggcccctgcatctcaaaggaatgggaggtcatatgcattgccttggaagctttcatggggccccgccttggttggcccccggggggttccacgctaggaacaaaaaaaagggtaagggcgggggccatccccacaatattcccatccacccaaatcctgggaatttccagggaaaactaggggtggggggggggtgggaaaaaaggggcccgcaacaaacctttctgtgccccttggtggtgcccccaccctcccggccacgg

SEQ ID NO: 24906 - DNA, 691 bp, Zea mays
  misc_feature: Ceres CLONE 1396275-F
  misc_feature: Encodes the peptide sequence at SEQ ID NO. 24907
  misc_feature (305)..(305): n is a, c, t, g, unknown, or other
  misc_feature (691)..(691): n is a, c, t, g, unknown, or other
aaagctggagctccccgcggtggcggccgctctagaactagtggatcccccgggctgcaggaattcgcacgagcccattacctagaacatcctaatcgaaaaatctccagcccccactccctttccccgtcccgagctcgagcgcggacgcacgcacaggcacagtcgcacactgacacgaacgcggcgaatcccagcgtcggcgaaatctgcggccttttctctcctctgcaggccgtgggcagtggcgccgccgcgcgatggggtcggtgtccctgaacgtggcgtcatcccggcgcggcggncggcgcctggcgtggctgtgctcgtccgcgctgctcaacctgctcgtgctgctctccctcctctccaccaacctcctggcgctccgcgcctttctctccccccgcgcgcccccgtgctcggacgcgtgaacgacaagctgtactgcatacttcaaaaaccacctcctcgcaaatgctctcgtcccgggttcttatatactcgccctcatttcaaacaaatggtaagtgcgcacagaacatgcgcgcaattttcacatatctaacagacaccagaccggatcggcgtcgaccccttctttacactctccctttatttacgggaaaacctccgtggcgctctgacacctctctacactcctgtcactttccctgatcccccccgtgcn

SEQ ID NO: 24907 - protein, 57 aa, Zea mays
  misc_feature: Ceres CLONE 1396275-F
MGSVSLNVASSRRGGRRLAWLCSSALLNLLVLLSLLSTNLLALRAFLSPRAPPCSDA

SEQ ID NO: 24908 - DNA, 847 bp, Zea mays
  misc_feature: Ceres CLONE 1396277-F
  misc_feature: Translation starting site: 754
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (30)..(30): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
tttcccccccctccccnnnnccctgccgtntgnnnnnngccctnnnnccacagtggagctccccgcggtggcggccgctctagaactagtggatcccccgggctgcaggaattcgcacgagaccattacctagaacatcctaatcgaaaaaaaatccccaatctccgcgctttccttccgccccacactcgtccactcaccccctctttgctctgcctcgccgcgccgcagagcagaggatggagcccccacgccctctcctcgccgccgtcttcctcgccgcgggggttctgctcctcctttctccggcagaggcggggacggtggccgtgaactacggccgcgtggcgaacaacctgcccaacccagggggggtggggccgctgcttcaagcatcagggcgcctccccaacccacccctgtacgcagccggaccgcatccgtggctggcccccccctcccgaaacacccattcccacaggatcacccgtccgccaaccacccccaaacagcccaccacccaccacaaaccccaccccaccccccgtcataccaccacccggccccgtccccgcaccaccaaacgaaccccccctcaccatacacacccccccactctccccgcaccaaccccacaccgctccacccccccgccaccctcccccccccctcctggtcccgactcacacacagaaccctaacacgaggtacgctcccgcttcaactcctcaacccccgcaatacgtgcgaataatggataaacgcacagagcgtgagcgcaggagcgcatggcacgccgcgggccccaacccccgcgtattattccggtcccacgcccaacagaccg

SEQ ID NO: 24909 - DNA, 767 bp, Zea mays
  misc_feature: Ceres CLONE 1396279-F
  misc_feature (13)..(13): n is a, c, t, g, unknown, or other
tgttccccctctnttttttacccacaaaacgagaacgccgtcgcgacccccccccatagctcccgcgcgggccccgctctagaactagtgtatcccccgggctgcaggaattcgcacgagaccattacctagaacatcctaataaaactgtcccgccgagttcggagcgcagcgcaaggcggggggaggagcaagaagccgccggcctccctcctccggctcaccaccaggcttactccgcaccgcgctgccacgggtaggagcggcgtcaaattcgggattcccaagcggcttcagcccggaggttcagccaaagctattttctaagaaaaatgccgccaatgatggtggcgatgactgccgagagcaagacagcatattaccccgtggagaagaagcagggctggtctattcagttaccaaaacttccggtttcccttgggattcccaggaagaaaaagggttttctccctgaatgctgcaagggtcctggacctttcccctaggggggcctggtttggtaaccgggggctcctataaaggggggaaaagggggccccccaagcaagggagccccccgagaccggggtcggcccagggcatttttaaaagactccccttctcctgggactcttagtggcaagaaactctgcgcggcccttgactgaccctaacgccgggaaccacgggcgtatttatgatgcctctgcacaccgagagagaaaagcgcgaggggataaaggcggtggtgactgaactgaacggcc

SEQ ID NO: 24910 - DNA, 771 bp, Zea mays
  misc_feature: Ceres CLONE 1396280-F
  misc_feature: Translation starting site: 257
  misc_feature (443)..(443): n is a, c, t, g, unknown, or other
  misc_feature (552)..(552): n is a, c, t, g, unknown, or other
  misc_feature (556)..(556): n is a, c, t, g, unknown, or other
  misc_feature (570)..(570): n is a, c, t, g, unknown, or other
  misc_feature (581)..(581): n is a, c, t, g, unknown, or other
caaagctggagctccccgcggtggcggccgctctagaactagtggatcccccgggctgcaggatttcgcacgagaccatttacctagaacatcctaatcgaaaactcatttttctctctcctgcgccgcgacgtccctcgccttcgccgccgaatccgagactccgatctcgggttcaccgcagcgcacagagcagccccgactcccggcccgatccgcgcttcttcctcttccgtcgcttcagtcattggcaggaatggcacctgagggttctcagttcgatgctaagcactatgattctaagatgcaggagctgctgagcaccggtgagactgaggagttcttcacttcatatgatgaagtttttgagagttttgatgatatgggcctccaagagaatcttctgagaggatttatgcttatggttttgagaagccatctgncattcagcagagaggaattgttcccttctgcaagggtcttcatgtcattcagcaagcacaatctggtacaggaaagacagcaccttcttgtttctgggatcttgcacanctgnactatgggcctggntgatgcccagnccctggtccttgctcccacccgtgagcttgacagaaaatcgagaaagtctgcgcgcgcttgagaaatacctttggggggtaagccctgccttggggggaaaggaactcccgtcgtgggaccaagaattcttggaggggggggcaattttttttttggaacccccccggcggcgggttttaaattgctgct

SEQ ID NO: 24911 - DNA, 651 bp, Zea mays
  misc_feature: Ceres CLONE 1396282-F
  misc_feature: Encodes the peptide sequence at SEQ ID NO. 24912
  misc_feature (321)..(321): n is a, c, t, g, unknown, or other
tggagctccccgcggtggcggccgctctagaactagtggatcccccgggctgcaggaattcgcacgagaccattacctagaacatcctaatcgaaaagcatctcgcattctcgccggtgctgctgcaattaacgccgcctccggccaaccacccgaaacctacctccgccgccgtcgtcgccaccgtcaacatggcgagccaaggggagccctcggcctctgcttccgatccgaaggagaagaaggacttctcgacggcgatcctggagaggaaaaagtcaccgaaccgccttgtcgtcgacgaggccaccaacgacgatnactccgtcgtcgctctgcaccctgacaccatggagaggctgcagctcttccgcggcgacaccgtgctcctcaagggtaagaagaggaaagacactatttgcattgtccttgcggacgaaacctgtgaggagccaaaggttcggatgaacaaggttgtccgccagaacctaagggtgaggcttggtgatgtggtttctgtccaccagtgccaggatgtgaaatatggggaagcgtgtccacattcttccaattgatgatacagttgaaggcattacagggaacctgtttgatgccttcttgaaacatatttcctagaagcatacaggccgt

SEQ ID NO: 24912 - protein, 127 aa, Zea mays
  misc_feature: Ceres CLONE 1396282-F
  misc_feature (30)..(116): Pfam Name: CDC48_N Pfam Description: Cell division protein 48 (CDC48), N-terminal domain
  misc_feature (44)..(44): Xaa is any aa, unknown, or other
MASQGEPSASASDPKEKKDFSTAILERKKSPNRLVVDEATNDDXSVVALHPDTMERLQLFRGDTVLLKGKKRKDTICIVLADETCEEPKVRMNKVVRQNLRVRLGDVVSVHQCQDVKYGEACPHSSN

SEQ ID NO: 24913 - DNA, 643 bp, Zea mays
  misc_feature: Ceres CLONE 1396284-F
  misc_feature: Encodes the peptide sequence at SEQ ID NO. 24914
  misc_feature (141)..(141): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (340)..(340): n is a, c, t, g, unknown, or other
  misc_feature (341)..(341): n is a, c, t, g, unknown, or other
  misc_feature (346)..(346): n is a, c, t, g, unknown, or other
  misc_feature (347)..(347): n is a, c, t, g, unknown, or other
  misc_feature (349)..(349): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
aagctggagctccccgcggtggcggccgctctagaactagtggatcccccgggctgcaggaattcgcacgagaccattacctagaacttcctaatcgaaaaacctagctcaccgctcactcacaagcacgcttgcgaaacnacagacgcagagacccgcgcacagatcgaagcggaggatgaaggtggaggtggtggagacgacgctggtgccgccgagcgaggcgacgccgcggcacgcgctgtggctgtccaacctggacctggcggtgcccaaaacccacaccccgctcgtctactactacccgaggcccgccgggcgccggcgccggnnnaggagnnaaagnnanannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24914 - protein, 53 aa, Zea mays
  misc_feature: Ceres CLONE 1396284-F
  misc_feature: SWISSPROT Homolog: EC 2.3.1.144 Anthranilate N-benzoyltransferase
  misc_feature (52)..(52): Xaa is any aa, unknown, or other
MKVEVVETTLVPPSEATPRHALWLSNLDLAVPKTHTPLVYYYPRPAGRRRRXR

SEQ ID NO: 24915 - DNA, 704 bp, Zea mays
  misc_feature: Ceres CLONE 1396285-F
  misc_feature: Encodes the peptide sequence at SEQ ID NO. 24916
  misc_feature (631)..(631): n is a, c, t, g, unknown, or other
tggagctccccgcggtggcggccgctctagaactagtggatcccccgggctgcaggaattcgcacgagaccattacctagaacatcctaatcaaaaatcttcctctgcgcttcgcccacacgctccagccgcttcaccgcgccgccaccgccaccgcgaggatgccgttcaagaggttcgtggagatcgggcgcgtggccctggtgaactacgggaaggactatggccgtctcgtcgtcatcgtagatgtggtcgaccagaacagggcacttgtggatgcccctgatatggtcaggtgccaggtgaacttcaagcggctctcacttactgacatcaagattgacatcaaacgtgtccccaagaagacaaccctgatcaaggcgatggaggaagctgatgtgaagaccaagtgggagaacagctcatggggcaagaagctgattgtccagaagaggagagcatcgctcaatgactttgataggttcaaagtcatgcttgcgaagattaaagagggggtggtgctatcaggcaagagctcgccaagctttaagaaggcgtccacaggcttaaggagtctcttttccgtgaaatgtcatggttagagtttttttggtttatgagttggatcagnaaattcgatttgaagcgttgtcaaagcccagagtttaccaatatgtttccctgtggaacccatttcaaacttt

SEQ ID NO: 24916 - protein, 146 aa, Zea mays
  misc_feature: Ceres CLONE 1396285-F
  misc_feature (44)..(120): Pfam Name: Ribosomal_L14e Pfam Description: Ribosomal protein L14
MPFKRFVEIGRVALVNYGKDYGRLVVIVDVVDQNRALVDAPDMVRCQVNFKRLSLTDIKIDIKRVPKKTTLIKAMEEADVKTKWENSSWGKKLIVQKRRASLNDFDRFKVMLAKIKEGVVLSGKSSPSFKKASTGLRSLFSVKCHG

SEQ ID NO: 24917 - DNA, 754 bp, Zea mays
  misc_feature: Ceres CLONE 1396287-F
  misc_feature: Encodes the peptide sequence at SEQ ID NO. 24918
  misc_feature (30)..(30): n is a, c, t, g, unknown, or other
  misc_feature (34)..(34): n is a, c, t, g, unknown, or other
  misc_feature (35)..(35): n is a, c, t, g, unknown, or other
  misc_feature (39)..(39): n is a, c, t, g, unknown, or other
  misc_feature (40)..(40): n is a, c, t, g, unknown, or other
gggttttcccccccccccccgccgccgggngcgnnaaanntaaaaatataaaaaaactggagctccccgcggtggcggacgctctagaatagtggatcccccgggctgcaggaattcgcacgagaccattacctagaacatcctaatcgaaaaaggccgcagctactccacggcgacggccgccatgagagccctcctctccctctcccgtctcgcccgacggcttccagcttctctcagccctgtaagggcgccgacaacattactcctccggcacatccatgcggatgccccctccgcgccgccatctcatgactcgacgcccttcgtctcccgcatcctcaaatcggagccgtgcctgaccccgaacgacgagtcggagccggcatccggatcgaccctcgaagagttcctcgcgcggtttcgtggctgccttcccgcccgcgactggaggctgcctttccccaccatggaccgggaacgggctccacaaaaagctccccccccgtcggcggaaaaccggggttgggcccccctccccgggaacccaaccgggggggcgccaaaggctattggaattccaaggacaaactcctgggcgggcccccgaagggggagggtccagccgccctccgcggggggggagaataatagcgccgccggggaaataaggggtccgaccgccggaacctttccgccacaaactctcttagttgggcggggacgggtggtaacggtccccctttcacccctg

SEQ ID NO: 24918 - protein, 95 aa, Zea mays
  misc_feature: Ceres CLONE 1396287-F
MDRERAPQKAPPPSAENRGWAPLPGNPTGGAPKAIGIPRTNSWAGPRRGRVQPPSAGGENNSAAGEIRGPTAGTFPPQTLLVGRGRVVTVPLSPL

SEQ ID NO: 24919 - DNA, 700 bp, Zea mays
  misc_feature: Ceres CLONE 1396292-F
  misc_feature: Encodes the peptide sequence at SEQ ID NO. 24920
  misc_feature (395)..(395): n is a, c, t, g, unknown, or other
  misc_feature (396)..(396): n is a, c, t, g, unknown, or other
  misc_feature (422)..(422): n is a, c, t, g, unknown, or other
  misc_feature (423)..(423): n is a, c, t, g, unknown, or other
  misc_feature (427)..(427): n is a, c, t, g, unknown, or other
  misc_feature (430)..(430): n is a, c, t, g, unknown, or other
  misc_feature (431)..(431): n is a, c, t, g, unknown, or other
  misc_feature (436)..(436): n is a, c, t, g, unknown, or other
  misc_feature (445)..(445): n is a, c, t, g, unknown, or other
  misc_feature (461)..(461): n is a, c, t, g, unknown, or other
  misc_feature (466)..(466): n is a, c, t, g, unknown, or other
  misc_feature (534)..(534): n is a, c, t, g, unknown, or other
  misc_feature (631)..(631): n is a, c, t, g, unknown, or other
  misc_feature (632)..(632): n is a, c, t, g, unknown, or other
  misc_feature (637)..(637): n is a, c, t, g, unknown, or other
aaagctggagctccccgcggtggcggccgctctagaactagtggatcccccgggctgcaggaattcgcacgagaccattacctagaacatcctaatcgaaaacccaagggtcggctaggtctaggtggtctccaagctttccgcctttccacgccaccattctccccacccgcgcgcctcagcaatccccatccagcatcgccgtttcgccgcggcaccgacacctcgccggccatgggcgcgtcctcctcgactggcaacccgtccccagaggcgcacgagcagcgggagcaggagactctcgcctccgccgccctctccctcccgctcctccgcgccgccttctcccgctccgccgccaacgcgctgccggatggcctcgcgccgccgcccgnnctctttcgtctggccgaatccccggnngcgncgnncgcgnacttcaggnaatccctcgggggggntcggncccgccatccgctcccaatctttcgccacggagcttgccgggggaaagaagggggccccccggggggnccaatcccccaggggggtaacccgttgctggccggggggggggggcccccgctcgttcaatggttcctcccggggaaaactttccccctgggccganncctanaaccctggtggggggaaattccaaggggaaagggcggggataaaaactaaaaggcacggttag

SEQ ID NO: 24920 - protein, 150 aa, Zea mays
  misc_feature: Ceres CLONE 1396292-F
  misc_feature (54)..(54): Xaa is any aa, unknown, or other
  misc_feature (63)..(63): Xaa is any aa, unknown, or other
  misc_feature (65)..(65): Xaa is any aa, unknown, or other
  misc_feature (66)..(66): Xaa is any aa, unknown, or other
  misc_feature (68)..(68): Xaa is any aa, unknown, or other
  misc_feature (71)..(71): Xaa is any aa, unknown, or other
  misc_feature (76)..(76): Xaa is any aa, unknown, or other
  misc_feature (78)..(78): Xaa is any aa, unknown, or other
  misc_feature (133)..(133): Xaa is any aa, unknown, or other
  misc_feature (135)..(135): Xaa is any aa, unknown, or other
MGASSSTGNPSPEAHEQREQETLASAALSLPLLRAAFSRSAANALPDGLAPPPXLFRLAESPXAXXAXFRXSLGGXRXRHPLPIFRHGACRGKEGGPPGGPIPQGGNPLLAGGGGPPLVQWFLPGKTFPLGRXLXPWWGEIPRGKGGDKN

SEQ ID NO: 24921 - DNA, 687 bp, Zea mays
  misc_feature: Ceres CLONE 1396293-F
tccccgcggtggcggccgctctagaactagtggatcccccgggctgcaggaattcgcacgagaccattacctagaacatcctaatcgaaaaagatcacagtcgcacagcgcccgctgctacgcacgccgccgtctacccccactcccccagcacgtgcgtgcacgcgcaggtgctcgaggacttctcccccgtttccgcccacatccgccgacctgcctcgccattccgccgcgccttcgcatcggccgcgcgcccggcccttctcgttctaccccggtacgactcgacggtggtcgtggtcgccgaaggtgcgcctccgaggcgccaggtggttcgtttgctgtttgcgcgatcgccgaaggagtctgtgcaagctgtgctggctaagggtttgggggttcggattcagtggagatgctgcgtcaggaggcagctagagatgaccggaccgctcgtccgaggctgtgtgcgagctgccactgccggagagcagcctagggccttaccaagtttgcctgagaaacaacgagattttccttgcagaggccgggccatatttggcaccacgaagaaaaaccactgcctccttagcaatattccctaacttcttgtcccccatggctggaactttccgtatcatttgctggccctcctcctccttgtacattaaatacccccgacacatg

SEQ ID NO: 24922 - DNA, 710 bp, Zea mays
  misc_feature: Ceres CLONE 1396294-F
  misc_feature: Encodes the peptide sequence at SEQ ID NO. 24923
  misc_feature (295)..(295): n is a, c, t, g, unknown, or other
  misc_feature (328)..(328): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
cgctctagaactagtggatcccccgggctgcaggaattcgcacgagaccattacctagaacatcctaatcgaaaacccccacagaaccgtctccccagcccggcgcctcacggtcgcaatttattgcttgcgcaccgcctcgccgctttggcgtggggcgtttgcctgtgtggcgctgggcatgtgccgtgcccgtggcttgcttcgtcgtgctcactagtcacgagagagggaggaggctctgcttctgctgccgcttcttcttctcctgctgctcttccggagataagcaggnggccgggacagctgactagctgagaggcatggngatggacgccggcggcggcaagctgccgtacagctacgccggccagcaggacggcgtaaagctggtgaagagcgtcagccgcgtggagccgcgcaggttcggcctgcgcctcgtgcggcttctcgtcgcactgcgctactctccacgcaagtcgacgctcagatgcatgacagcgacgtcagcaggtgggcaggtctgagggccccaccaccgaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24923 - protein, 67 aa, Zea mays
  misc_feature: Ceres CLONE 1396294-F
  misc_feature (2)..(2): Xaa is any aa, unknown, or other
MXMDAGGGKLPYSYAGQQDGVKLVKSVSRVEPRRFGLRLVRLLVALRYSPRKSTLRCMTATSAGGQV

SEQ ID NO: 24924 - DNA, 674 bp, Zea mays
  misc_feature: Ceres CLONE 1396295-F
  misc_feature: Encodes the peptide sequence at SEQ ID NO. 24925
  misc_feature (344)..(344): n is a, c, t, g, unknown, or other
  misc_feature (345)..(345): n is a, c, t, g, unknown, or other
tagctggagctccccgcggtggcggccgctctagaactagtggatcccccgggctgcaggaattcgcacgagaccattacctagaacatcctaatcgaaaaaacgccgcctactccgcgctcctccaaaccaaactgaaccctatcctagcacgagtgcacgacggtggcagcaggagatggtggggacggcggaaggcggcgcggagagggcggtgcggcggtgggtggacgccgccggcgggcgcctggtcctggacggcgggctggccacggagctcgaggccaacggcgccgacctcaacgacccgctctggagcgccaagtgcctcctctcctccccgnnactcatccggaaggtccatatggactacctagaagccggggcgaacattataatcacagcatcgtatcaggctactatcccagggtttgaatcaaagggcttttcaaaagacaaagtgaaaactttgtaacaaagagtgttcagattgcactgaaaagcccgggagattgtcttgaaaggacattttggagaaatccactcctatacgggatcttattctggttggagcaactctggggaagtatgggggctatcttggtggtgggtccgagaaacgggggaatagggggaagggggaacaaaagaggtcccggaagggctttctcggg

SEQ ID NO: 24925 - protein, 98 aa, Zea mays
  misc_feature: Ceres CLONE 1396295-F
  misc_feature: SWISSPROT Homolog: EC 2.1.1.10 Homocysteine S-methyltransferase
  misc_feature (56)..(56): Xaa is any aa, unknown, or other
MVGTAEGGAERAVRRWVDAAGGRLVLDGGLATELEANGADLNDPLWSAKCLLSSPXLIRKVHMDYLEAGANIIITASYQATIPGFESKGFSKDKVKTL

SEQ ID NO: 24926 - DNA, 688 bp, Zea mays
  misc_feature: Ceres CLONE 1396297-F
  misc_feature: Encodes the peptide sequence at SEQ ID NO. 24927
tccccgcggtggcggccgctctagaactagtggatcccccgggctgcaggaattcgcacgagaccattacctagaacatcctaatcgaaaaacttctcgttctcgccgatccagtgccactacactacaatactgctgcgcgctagcggtagcgctcgcgctcccactcgcaccacagcacgccaccgctgctgccggctcctccccgcgctcgcattgcgatttgcgacctagcgcgagggtaccgggggtggtgcgcgtgctccgtgatccgggaagcgccgcgagatggccgggggcggaggcggcggtgccgcgccgaagcacgacgacttcacgccgcaccccgtcaaggaccagctccctggggtctcctactgcatcaccagccctcccccgtggcctgaagccgttcttcttgggttccaacattatctggtcatgcttggtaccactgtgatcataccaactgcacttgttccacaaatgggaggaaaccatgaggacaaagcagtggttatccaaacattgctgttcggtgcaggtatcaacaccctccctgcagaatttcttttgctaccatgcccgcctgcagtcgatccgccggctacatacaccctttgcaccggccaaccattttcaatcccccctaccccgcacccccacctaaaggaaacctaatcccacc

SEQ ID NO: 24927 - protein, 130 aa, Zea mays
  misc_feature: Ceres CLONE 1396297-F
MAGGGGGGAAPKHDDFTPHPVKDQLPGVSYCITSPPPWPEAVLLGFQHYLVMLGTTVIIPTALVPQMGGNHEDKAVVIQTLLFGAGINTLPAEFLLLPCPPAVDPPATYTLCTGQPFSIPPTPHPHLKET

SEQ ID NO: 24928 - DNA, 637 bp, Zea mays
  misc_feature: Ceres CLONE 1396298-F
  misc_feature: Encodes the peptide sequence at SEQ ID NO. 24929
  misc_feature (189)..(189): n is a, c, t, g, unknown, or other
  misc_feature (295)..(295): n is a, c, t, g, unknown, or other
  misc_feature (352)..(352): n is a, c, t, g, unknown, or other
  misc_feature (353)..(353): n is a, c, t, g, unknown, or other
  misc_feature (355)..(355): n is a, c, t, g, unknown, or other
  misc_feature (383)..(383): n is a, c, t, g, unknown, or other
  misc_feature (399)..(399): n is a, c, t, g, unknown, or other
  misc_feature (400)..(400): n is a, c, t, g, unknown, or other
  misc_feature (408)..(408): n is a, c, t, g, unknown, or other
  misc_feature (409)..(409): n is a, c, t, g, unknown, or other
  misc_feature (425)..(425): n is a, c, t, g, unknown, or other
  misc_feature (440)..(440): n is a, c, t, g, unknown, or other
  misc_feature (445)..(445): n is a, c, t, g, unknown, or other
  misc_feature (463)..(463): n is a, c, t, g, unknown, or other
tccccgcggtggcggccgctctagaactagtggatcccccgggctgcaggaattcgcacgagaccattacctagaacatcctaatcgaaaacagagaccaaccacctgcggcggcgatggggatcggtgagcacttcgagggcgtgaagcagcactgggcgagcaacttcgccttcctcgactactacnagaaggtctacggccgcgccgagcccctccccaagtggtccgacgccgacgtcgacgagttcatcgcctccgacccggtctacgggccccagctcaaggccctgcngggagtcgaggaagttcgcgcttgtcggggcctttcgcgggcgcgccccacctcggnngncgtcgcgctcaagtactccaaggcgcgncacggcgtcgtgtggnncgaccggnntcggggcgatcacggncgcccggggtggggntcccnagggggcggagcactggnacccagtctacaagatggacaagcagggggcccaccctaggttcatctaatgggggggaggacaagggcctcaggacagaaaagctgaaccatggtaaaattgaagggtggctatttgggccttcccggtttgacaaaacattgagggccataaacgggaacccttatttggtg

SEQ ID NO: 24929 - protein, 128 aa, Zea mays
  misc_feature: Ceres CLONE 1396298-F
  misc_feature (25)..(25): Xaa is any aa, unknown, or other
  misc_feature (60)..(60): Xaa is any aa, unknown, or other
  misc_feature (79)..(79): Xaa is any aa, unknown, or other
  misc_feature (80)..(80): Xaa is any aa, unknown, or other
  misc_feature (95)..(95): Xaa is any aa, unknown, or other
  misc_feature (98)..(98): Xaa is any aa, unknown, or other
  misc_feature (110)..(110): Xaa is any aa, unknown, or other
  misc_feature (116)..(116): Xaa is any aa, unknown, or other
MGIGEHFEGVKQHWASNFAFLDYYXKVYGRAEPLPKWSDADVDEFIASDPVYGPQLKALXGVEEVRACRGLSRARPTSXXVALKYSKARHGVVWXDRXRGDHGRPGWGSXGGGALXPSLQDGQAGGPP

SEQ ID NO: 24930 - DNA, 630 bp, Zea mays
  misc_feature: Ceres CLONE 1396299-F
  misc_feature: Encodes the peptide sequence at SEQ ID NO. 24931
  misc_feature (355)..(355): n is a, c, t, g, unknown, or other
  misc_feature (496)..(496): n is a, c, t, g, unknown, or other
  misc_feature (520)..(520): n is a, c, t, g, unknown, or other
  misc_feature (521)..(521): n is a, c, t, g, unknown, or other
gctctagaactagtggatcccccgggctgcaggaattcgcacgagaccattacctagaacatcctaatcgaaaaattaattaacaaagagaagacttcttccttcctcgtcgtctccagcccattccaattcttgattccatcgccccaccatccacaactcccctaatccttccaacctcctcgtcgtccagtccaccacctccacgcgcaatggccagcggctaggcggcaccaaccagatcacaaggattcgtttcatccggcagcgcagctctagagcctccatgggcagctacgcgtacaagtactgtatgtgcttcacgcgcaagttccgatccccggacgcccagcgnccgccggacgtccgcgccgcccacctctccttcgcctctgacgcccatgccctccgccgctctgttcgccggcgtcccagggcgagcccccccggccgacgtcgaacgcatcctcgcatgggtttttccggggggcacagnccatggaatcgccccgctcgtcannaaggttcggccggggggatccacgcccacggctcggaagaatttcttcggctttcctctttctcccccggacctcaaaccaacccattgggggaaccaggttcaccaag

SEQ ID NO: 24931 - protein, 114 aa, Zea mays
  misc_feature: Ceres CLONE 1396299-F
  misc_feature (70)..(70): Xaa is any aa, unknown, or other
  misc_feature (78)..(78): Xaa is any aa, unknown, or other
  misc_feature (79)..(79): Xaa is any aa, unknown, or other
MGSYAYKYCMCFTRKFRSPDAQRPPDVRAAHLSFASDAHALRRSVRRRPRASPPGRRRTHPRMGFSGGHXPWNRPARXXGSAGGIHAHGSEEFLRLSSFSPGPQTNPLGEPGSP

SEQ ID NO: 24932 - DNA, 772 bp, Zea mays
  misc_feature: Ceres CLONE 1396300-F
  misc_feature: Encodes the peptide sequence at SEQ ID NO. 24933
  misc_feature (12)..(12): n is a, c, t, g, unknown, or other
  misc_feature (38)..(38): n is a, c, t, g, unknown, or other
ttgggtcccctnccctccccccaaaccttttatttaanaaatcacacacgcgcaaagctggagctccccgcggtggaggccgctctataatagtggatcccccgggctgcaggaattcgcacgagaccattacctagaacatcctaatcaaaaaatccccatcaaacccccggacatttctggtcgcaccctcctccggccctcccagccgctaagccctctggaaccttcgagagctcgatcggatcggagcccctgccatggccgacgaggcgaaggcgaagggtaatgcggcgttctcagccggccgcttcgaggaggcggcgcggcacttcacggacgccatcgcgctcgccccgggcaaccacgtcctctactccaaccggtccggcggcgctcgcctcactccaaccgctactccgaacgctctcgccgacgcgaaaaagaccgtcgagctcaagcctgactgggccaaaggctactcccgcctcggggcggcgcactcaggcctccgggaacgcgcccagcggcgtctccgaaaaaaaaaaagggtccttgcgctcaaccccccacaacgaaggtctccaagggcggaagctcgaggaacccccaagaaaggctgccgccgccccgggacgggagcctaggagacctttcggagattccaagagccactcatgagcaaaaaatatccatacgccccgcgttaacgcgtcccaaacccaaataaccacccaccagatgagtcccgcgccacccgccgacccgacag

SEQ ID NO: 24933 - protein, 128 aa, Zea mays
  misc_feature: Ceres CLONE 1396300-F
  misc_feature (2)..(35): Pfam Name: TPR_2 Pfam Description: Tetratricopeptide repeat
  misc_feature: SWISSPROT Homolog: EC 3.1.3.16 Phosphoprotein phosphatase
MADEAKAKGNAAFSAGRFEEAARHFTDAIALAPGNHVLYSNRSGGARLTPTATPNALADAKKTVELKPDWAKGYSRLGAAHSGLRERAQRRLRKKKRVLALNPPQRRSPRAEARGTPKKGCRRPGTGA

SEQ ID NO: 24934 - DNA, 745 bp, Zea mays
  misc_feature: Ceres CLONE 1396301-F
  misc_feature (401)..(401): n is a, c, t, g, unknown, or other
  misc_feature (402)..(402): n is a, c, t, g, unknown, or other
gctggagctccccgcggtggcggccgctctagaactagtggatcccccgggctgcaggaattcgcacgagaccattacctagaacatcctaacgaaaaattccaccgccgcacacctcctgtcttccttcaccttcgcgctccgccgccgccgtcgattcgtgctgctctcacccctaacctgtccaacatcgccggggagggaagcagcagaagaagctccccttacctccggctatcgcctgaggataaagtggggtctgtaggggagtcttaggggggagcaaaagggataggatagggagagatgaagcaaatcatttcttcgtcccgctttcgccctgcttacgtccccgctactaaccccctagatcatctgtcttttctcgtttctaatcgacnntctctcgtttttatgctatcaagtatgaggttgaaccgcttcaaaagcttcctaccaaaattagggaaaaaaaaaactggtcccaggttagcttggtgaaaaattagcccccggggccggtttaattcgctaaaaatgggtggaaaaaacggaaagttatgggggaaaaggtgaaaaaaaaaaaaaacctccaaaaaaaaggggaaccccgtgtatattgggtgggggtttttcccccctgaatggccccaaagtggcaaggtttgggggtgggggttcccttttaaaaaacccggggggaaaattggtggcccctaaaaaaaaagggggtggaaaaaataaa

SEQ ID NO: 24935 - DNA, 753 bp, Zea mays
  misc_feature: Ceres CLONE 1396305-F
  misc_feature: Encodes the peptide sequence at SEQ ID NO. 24936
  misc_feature (1)..(1): n is a, c, t, g, unknown, or other
  misc_feature (753)..(753): n is a, c, t, g, unknown, or other
nccccccccccccccccccccccacccattaatttttacaaaatcttttaacactgccgctccccgcggtggcggccgctctagaactagtggatcccccgggctgcaggaattcgcacgagaccattacctagaacatcctaatcgaaaaaaactcgattgcagctcgtgcaccacacacggacacgaatcctcctccggtcctccctctgggaaaccaggactacctcggatcagatgcagtgcctaccctgcggaccgtccaccaacgcgcccgctgcgcatgccgcggccaggagcgtcagccgtcggagggttgtcgtcgagggcgtcacctcggcaacccacgacagcgaggaagcgcctccaaggtcaatgagggcaacaggtgaccgtggtgcaatgtcaggcaaaaccttatggctcgtgtcaaagaggaagcttattgctttgtcagccttttgtcttagcttacattcttcaaggtactttccagcatttgctttgggtgatacgtctgtcaaaatcgaggatgtgactcctaagatttttccatctggggccattatttccaactgaagaaacggattgcagagctatttgaaataaatacttactcagttgtgaaacatttttgatgcaacactacggccgcagcttaaggttaaccgggggtcgggggagatcctggaaaggaaaaaggtcccacggcggaagcaggagtgcacaaatatccgtccactgttatttacn

SEQ ID NO: 24936 - protein, 113 aa, Zea mays
  misc_feature: Ceres CLONE 1396305-F
MQCLPCGPSTNAPAAHAAARSVSRRRVVVEGVTSATHDSEEAPPRSMRATGDRGAMSGKTLWLVSKRKLIALSAFCLSLHSSRYFPAFALGDTSVKIEDVTPKIFPSGAIISN

SEQ ID NO: 24937 - DNA, 777 bp, Zea mays
  misc_feature: Ceres CLONE 1396307-F
  misc_feature: Translation starting site: 186
  misc_feature: SWISSPROT Homolog: EC 3.4.22.34 Legumain
  misc_feature (13)..(13): n is a, c, t, g, unknown, or other
  misc_feature (21)..(21): n is a, c, t, g, unknown, or other
  misc_feature (22)..(22): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (58)..(58): n is a, c, t, g, unknown, or other
ttatccccaccanaacaaaannacaaacaccgactnnnncctcnnnnnccatagtggnactccccgcggtggcggccgctctagtatagtggatcccccgggctgcaggaattcgcacgagaccattacctagaacatcctaatggaaaaactctcgcttccttccctccctccctcccacgcaaatggtggccgctcgcctccgcctcgcgctgctactctccgtctgcctctgctccgcgtgggcgcgcccacgcctcgagacggccatccgcctgccgtcgcagcgcgcggcggcggccgacgaaacggacgacggcgccgtcgggaccccgctgggctgtgctcatcgcaggctccagcggctactacaactaccgccaccaggcggacatctgccatgcataccagattcatgaaagaagggcggactcaaggatgagaacatcattgtccttcatgtacgatgacatcgcgcatagcccggagaatccgaaggcctggtgtcatcaatcaaccatccccagaggcgcagacgccaaatgttggagctgccaaaggattacactgtctcaaaacgcccacgtaaacaatattctttggctgctctggtaagaaaaacaaaaattgataaataagagaagtaaaacaaaaaaaaacaatagaaatactgatccccccaacctccataactccccccgtacatcaacacacccacgcccaccacccccccccgcgccctcaaaaatggtatcgggttaaaaaaacaacaaacag

SEQ ID NO: 24938 - DNA, 571 bp, Zea mays
  misc_feature: Ceres CLONE 1396315-F
  misc_feature (264)..(264): n is a, c, t, g, unknown, or other
tccccgcggtggcggccgctctagaactagtggatcccccgggctgcaggaattcgcacgagaccattacctagaacatcctaatcgaaaaatgtaaaccacactccactccagcactgaacacttgattgattcagagggtaactagctagctgaatcacaatgaatcctaccaagttccgtccgaccagtacccacgacacgacggtgacgacgacgaacgctgagcgctcctgtgtgcaacagacaacgatgcgtctgacntgtgccaaccctccctgtttccatccctggtgggaggacctacccccctggatgggaaaattgggggcccacctttcccggggggggagcccttccccggggggccgggggggggaacccggggggggccccccccaaaaggggggtttctttttgggggggcccccccccacgggggggggggttcccccttttgggtggggggcgcggaatatcttttttttggggggggcccccccccggggggggggggggggaaacacacccccccccccccagaaaaagagtcggaatccttggttttttc

SEQ ID NO: 24939 - DNA, 638 bp, Zea mays
  misc_feature: Ceres CLONE 1396316-F
  misc_feature: Translation starting site: 150
  misc_feature: Pfam Name: UEV Pfam Description: UEV domain
  misc_feature (380)..(380): n is a, c, t, g, unknown, or other
tggagctccccgcggtggcggccgctctagaactagtggatcccccgggctgcaggaattcgcacgagaccattacctagaacatcctaatcgaaaaagtttgttcaactacatacgcaaatcggaatcgaaaccctatctcggatccgatggctcgttcgccgccgccttcttcgtcggccggcggcgcgcagtacgcgcagcagttcctcaacacggcgctctcccagcgggggccgtccgcgctgccgtacgccgaggacgtcaagtggctcatccgcaaccacctgggtggcgctgggcgaaggctttcccctccctccatccaaggccggcctcttcaaccacaaagacgggcggggcgttcacctcctccaggncgacggggacatccccatccacagggcgggggctcctacaacttccccgccgtatctgggttggcgagccctaaccggggtccccgccggttgttttcctttcgccgaaccgagaattgggcatcaagccccaccacggccttggtaaaaggtccgggctcgttgccaaggggccctacctccgttccgggggtttcccctcccccaacctgggaacctggccgaatccctttcggacctattgggcctcaacccgcc

SEQ ID NO: 24940 - DNA, 689 bp, Zea mays
  misc_feature: Ceres CLONE 1396317-F
  misc_feature: Encodes the peptide sequence at SEQ ID NO. 24941
aagctggagctccccgcggtggcggccgctctagaactagtggatcccccgggctgcaggaattcgcacgagaccattacctagaacatcctaatcgaaaagtaggctgcagcaacccgctcccccgctcacaccgaaatttgaaatcctcctcccagtctcgtccttcgaacgaagcaacagccgccgcgccatggagaagatctccgtcgccgtccgcttccgccctcccaacctggtggccgctaacacctccccagccagttccggcggaggcggcgaccgcgagtggcgtatcgatgacacccgcgtttccctcctccaccgcgccgccggccccatcaccggtgcctccttcgccttcgaccacgtcttcgacggtgcggcgaacaacgagcggatctatgggcacggtcgtccgggaactcatttgggcgccgtcgtcggcggattcaacggcaccgccttcgcctacggccagaccagcagcgggaagacattcaccatgaacggctccgacgccgacccgggcatcattccccgcgcgggcccgcgacgtcttcgacaccgtgcgccaggctgacgaccgcgagtcctccatccgggggtcctacatggagacttacaacaaggaaatcacgacctcttgacccttgaaggccaaaagctgaaaattctcgagagcttcg

SEQ ID NO: 24941 - protein, 129 aa, Zea mays
  misc_feature: Ceres CLONE 1396317-F
MEKISVAVRFRPPNLVAANTSPASSGGGGDREWRIDDTRVSLLHRAAGPITGASFAFDHVFDGAANNERIYGHGRPGTHLGAVVGGFNGTAFAYGQTSSGKTFTMNGSDADPGIIPRAGPRRLRHRAPG

SEQ ID NO: 24942 - DNA, 718 bp, Zea mays
  misc_feature: Ceres CLONE 1396323-F
  misc_feature: Encodes the peptide sequence at SEQ ID NO. 24943
  misc_feature (408)..(408): n is a, c, t, g, unknown, or other
  misc_feature (409)..(409): n is a, c, t, g, unknown, or other
  misc_feature (414)..(414): n is a, c, t, g, unknown, or other
  misc_feature (420)..(420): n is a, c, t, g, unknown, or other
  misc_feature (424)..(424): n is a, c, t, g, unknown, or other
  misc_feature (428)..(428): n is a, c, t, g, unknown, or other
  misc_feature (517)..(517): n is a, c, t, g, unknown, or other
  misc_feature (550)..(550): n is a, c, t, g, unknown, or other
  misc_feature (594)..(594): n is a, c, t, g, unknown, or other
  misc_feature (668)..(668): n is a, c, t, g, unknown, or other
tggagctccccgcggtggcggccgctctagaactagtggatcccccgggctgcaggaattcgcacgagaccattacctagaacatcctaatcgaaaagtggttgttctcgaccagaatcttctgcagagcacgaacgccgagatctccatcgcgtcggggcaccgggagaagcccgacgcgttcgacctcttccgaggttcctccctgggcgatactgagcccggcgttcacggagcactgggtggccgcgccggaacacctgccccggacgctgctcatgtacttcagcaactcgctcgaggccaaggagttctacttccagacggtcatggccaactccccacgcttcaggaacagcactgtcaaccacagcctccgggtcaacgtggccgcgccgcccgcgccgnnaaagncgcggncaancagnggcggaacgacgcactggggccggggggggcgcgccctttcgccgggggggttccgaaaaggacaagggggcttcctgaaaagggttanaacgaaggaggggcttgcggcgccccccttganacctattcccccccggccgaagggctgccccggttgtttttccnaattaggggcggcggggggagtttccttcccccctcctttctcatacattagagttccgctccaacactcttcnccccccccgacccgccgccccgcccctcgcgcgcgggaaaaaataagaac

SEQ ID NO: 24943 - protein, 146 aa, Zea mays
  misc_feature: Ceres CLONE 1396323-F
  misc_feature (44)..(44): Xaa is any aa, unknown, or other
  misc_feature (46)..(46): Xaa is any aa, unknown, or other
  misc_feature (48)..(48): Xaa is any aa, unknown, or other
  misc_feature (49)..(49): Xaa is any aa, unknown, or other
  misc_feature (50)..(50): Xaa is any aa, unknown, or other
  misc_feature (80)..(80): Xaa is any aa, unknown, or other
  misc_feature (91)..(91): Xaa is any aa, unknown, or other
  misc_feature (106)..(106): Xaa is any aa, unknown, or other
MYFSNSLEAKEFYFQTVMANSPRFRNSTVNHSLRVNVAAPPAPXKXRXXXGGTTHWGRGGRALSPGGFRKGQGGFLKRVXTKEGLAAPPLXPIPPRPKGCPGCFSXLGAAGGVSFPPPFSYIRVPLQHSSPPPTRRPAPRAREKIR

SEQ ID NO: 24944 - DNA, 655 bp, Zea mays
  misc_feature: Ceres CLONE 1396324-F
  misc_feature: Encodes the peptide sequence at SEQ ID NO. 24945
tccccgcggtggcggccgctctagaactagtggatcccccgggctgcaggaattcgcacgagaccattacctagaacatcctaatcgaaaaggttcttcctagcgtctccccgttcttctctccgtagtagctaacagtatagtgtggcctcgcatggagactttccctcctcgctggccccgcatctggcccggattaaccgccttgggctccctccccagattgccccacccaccgtcagcctcgtcaggtatgtctcgtgttccctaaccttgacgcttctcccttctcggcgcctgcttcgttggttgccttcagcggacgccgccgattcggctctcctgttcggcgccctccccagattgccccacccaccgtcagcctcgtcaggtatgtctagtgttccctaaccttgacgcttctcccttctccgcgcctgcttcgttggttgccttcagcggacgccgccgattccggtctcctgttcggggccgtgtcttgcgacagacaatgctacctttctcggagtacatggaattaaaaagggggggttgggcccctgcttttttatatgggaacctaaaggattggggggccctttaaaccgtctcctccccaccaggagacaaaccctcccagggttttttaacacag

SEQ ID NO: 24945 - protein, 30 aa, Zea mays
  misc_feature: Ceres CLONE 1396324-F
MLPFSEYMELKRGGWAPAFLYGNLKDWGAL

SEQ ID NO: 24946 - DNA, 683 bp, Zea mays
  misc_feature: Ceres CLONE 1396325-F
  misc_feature (296)..(296): n is a, c, t, g, unknown, or other
  misc_feature (336)..(336): n is a, c, t, g, unknown, or other
  misc_feature (372)..(372): n is a, c, t, g, unknown, or other
  misc_feature (373)..(373): n is a, c, t, g, unknown, or other
  misc_feature (386)..(386): n is a, c, t, g, unknown, or other
  misc_feature (392)..(392): n is a, c, t, g, unknown, or other
aagctggagctccccgcggtggcggccgctctagaactagtggatcccccgggctgcaggaattcgcacgagaccattacctagaacatcctaatcaaaagatcttatgcttccatctctgaggctgccgccagccaccggccagcgtcgttcgctttgtagcagtccagctctgcgcccggcgccgcagccccgcatcgcgcacaggcacaacttctacggttctgccgctgatcgccgcacgtggccgcgccgccgcctccctcacccgagctcgaccgcgcttctcagctcgncgcctcgacggtcgctgcctcgacacctcccccgcgtggncatcagccgggagcagagagccctggtccttggagnngggcgggttacgngggggngcggccccccggcccccttggggacgggcctccccgggggatcccctccccgggtttggcccccgggggtgggcccccgcgcctggccggggcgggccgctcccgctttgtccccccccccccccgggttttcgctccggggccccccgcgccccctggggcttctctcccttttgtgttttgcttttccccccctctcctccttctcccccccctccccggtgtcgccgggccgccgcgggctcctttccccccgcttcttttctcctcgttttgcccccccgttctttc

SEQ ID NO: 24947 - DNA, 682 bp, Zea mays
  misc_feature: Ceres CLONE 1396326-F
  misc_feature: Encodes the peptide sequence at SEQ ID NO. 24948
  misc_feature (445)..(445): n is a, c, t, g, unknown, or other
  misc_feature (520)..(520): n is a, c, t, g, unknown, or other
  misc_feature (542)..(542): n is a, c, t, g, unknown, or other
aagctggagctccccgcggtggcggccgctctagaactagtggatcccccgggctgcaggaattcgcacgagaccattacctagaacatcttaatcgaaaaaccgcgaaggcacacagccgccgtatcttttacttgcgctcggcacgcaggcgacggctgcggcgctcaggttggggttctcatcgacggcgtcagcggcttcccctcccgcctctcgccagtcgcttcgcgccctcgcctccggtcctccgcacactggccggtgaccctgcatagtattatctgattttcctggaggccacattttaaggactgaggttacaatggcagatgccagccctagaacagaaacatcaacagatgatactgacgacaataacgggcttgaaccaggcagaaggtgggtcttgttgcttctgactccagtgacagatccaaagacnaaacatggagatcaaaagacattgcgtcgccttgctcaaaatcgtgagggctgcaggaagagcgacttaaggagnaaggcatatgttcaacagttgnaagaatagcaggctaaaacttacccaactagagcaagagctgcaaagagctcgtcagcagggattttttataaccaaggtccggtggatcagtccacttcatggagggaaaatggggcattggcctttgatatgaagaaa

SEQ ID NO: 24948 - protein, 74 aa, Zea mays
  misc_feature: Ceres CLONE 1396326-F
  misc_feature (65)..(65): Xaa is any aa, unknown, or other
  misc_feature (73)..(73): Xaa is any aa, unknown, or other
MADASPRTETSTDDTDDNNGLEPGRRWVLLLLTPVTDPKTKHGDQKTLRRLAQNREGCRKSDLRXKAYVQQLXE

SEQ ID NO: 24949 - DNA, 653 bp, Zea mays
  misc_feature: Ceres CLONE 1396327-F
  misc_feature: Encodes the peptide sequence at SEQ ID NO. 24950
  misc_feature (245)..(245): n is a, c, t, g, unknown, or other
  misc_feature (271)..(271): n is a, c, t, g, unknown, or other
  misc_feature (297)..(297): n is a, c, t, g, unknown, or other
  misc_feature (367)..(367): n is a, c, t, g, unknown, or other
  misc_feature (391)..(391): n is a, c, t, g, unknown, or other
  misc_feature (392)..(392): n is a, c, t, g, unknown, or other
  misc_feature (397)..(397): n is a, c, t, g, unknown, or other
  misc_feature (402)..(402): n is a, c, t, g, unknown, or other
tccccgcggtggcggccgctctagaactagtggatcccccgggctgcaggaattcgcacgagaccattacctagaacatcctaatcgaaaaaaatcgaattcgccatgggcatggctgctccgcgcgcgccgctgcctctcccccaactgctgctcctcctcgttgccgcgctcctcgccgccgctcccctccctagggcggccagggcggacgagttcgacgtccgccgccacctctccaccgntcaccaggtatgatggttggccaggnagtccagtagtgtcatctccatgccngtcatcccagacgggtggcgtgtcattcaccctcatttagtggcaagacatgggactcgcgctcctaccnagaagcgcatcaggagctgataannatggncagtncgactggaagcccttctgaaagaggcaatcagggtccttgatagtgattctctgaagaaaatccctcctgaattaaaggtggaatcccgctggaaggtaagactaaaaggggggagctgaataaggaaagggaaaaggatctttaaaatttcctacaaaagggggggggggggttcaagaacttattggaggccaaaatccccctggggtgtattcaaaaaaagaaccccggtttcccgggaaataagaag

SEQ ID NO: 24950 - protein, 50 aa, Zea mays
  misc_feature: Ceres CLONE 1396327-F
  misc_feature (47)..(47): Xaa is any aa, unknown, or other
MGMAAPRAPLPLPQLLLLLVAALLAAAPLPRAARADEFDVRRHLSTXHQV

SEQ ID NO: 24951 - DNA, 737 bp, Zea mays
  misc_feature: Ceres CLONE 1396331-F
  misc_feature: Encodes the peptide sequence at SEQ ID NO. 24952
  misc_feature (721)..(721): n is a, c, t, g, unknown, or other
catagctggagctccccgcggtggcggccgctctagaacaagtggattcccccgggctgcaggaattcgcacgagaccattacctagaacatcctaatcgaaaaaatttccagacggcagtccactggtttttgcttgcatatcctttgtttaggccagagttgagttgtgttccaacttccaagtcttgggttgcggaatcgccggcctcgctcaatcgatggaaaaccataatccattacattctcagattgctgaagtgaaaatggacatctcagcatcagcttctgttgcatcagggaacaaattctgcaagggtggtgcctgtgatttctctgattccagtaactcctcgaaagatgccaaggacagatccacgggggtgagggaagcttataatcgcagtgatcctttgcatcatattcatgacggtggaagtggtcgggggcatcaaagcaaacagtcttgccatcttaactgatgcggcgcaccttctttctgatgtggcagcattttgcatatcgttattctctctctgggctgctggagggaaagcacaccgcagcagtcatatgggttcctccggattgaaattcttggggcctgggccccattcagttcaaatggtactgtggggaaactggaatatgaggctttggaaggtcataacgagagggggatgtgcaggctccccctgtttttggggccctttgaatgtttnccaattaaaagggggg

SEQ ID NO: 24952 - protein, 104 aa, Zea mays
  misc_feature: Ceres CLONE 1396331-F
  misc_feature (99)..(99): Xaa is any aa, unknown, or other
MTVEVVGGIKANSLAILTDAAHLLSDVAAFCISLFSLWAAGGKAHRSSHMGSSGLKFLGPGPHSVQMVLWGNWNMRLWKVITRGGCAGSPCFWGPLNVXQLKGG

SEQ ID NO: 24953 - DNA, 724 bp, Zea mays
  misc_feature: Ceres CLONE 1396333-F
  misc_feature: Translation starting site: 454
  misc_feature (349)..(349): n is a, c, t, g, unknown, or other
  misc_feature (364)..(364): n is a, c, t, g, unknown, or other
tggagctccccgcggtggcggccgcttctagaacttagtggatcccccgggctgcaggaattcgcacgagaccattacctaagaacatcctaatcgaaaaagactccatcgagttggtctttggtcgtgcttcgtgctgacgcttcgcgcgggtccgaggtcaggcggcagcagcacggagtagcaccagggcgaccgcccaggttatcgtcggccgccggcggcgacctgtaccccggcgagaagatgcatctgagcgaacgaggggatcgagggtctgcgattcgcggtgacgggcgggcagggcttcgtcggagctgccctcagcctcgagctgctccgccgcggngcccgcgaggtccgntccctcgatctccgcgcctcctcctcctggtcccagcagctcctcgacgccggggtccgaattatcccagggggacataagaaagaaggatgatgtggcgagggcttttccggggaggggactggggtttccaccttggctctaaggcatgcaaggaaagaaaagggggaaaccgggaaaacggacaagggaaaaaaaaggggcccgggagggattggccccttccctagaaaaggggccaaaggtttggttataaacccatacatgggggttttgggaggaacgcttttccccgggaatggggggtgtccaattttccaaggagaaccgggggtttgttatgggcgaggagaatatttg

SEQ ID NO: 24954 - DNA, 732 bp, Zea mays
  misc_feature: Ceres CLONE 1396338-F
  misc_feature: Encodes the peptide sequence at SEQ ID NO. 24955
  misc_feature (625)..(625): n is a, c, t, g, unknown, or other
aaagctggagctccccgcggtggcggccgctctagaactagtggatcccccgggctgcaggaattcgcacgagaccattacctagaacatcctaatcgaaaacttccgtccttggcaaccaggcccaggcatcgtttcaccgctattcctcctgccccatctcctcccgatccatccgagcccaaaccctagtccagccagatctccgccgccgccggcgagagcacggcatcagatccgccgcgatggcgttccgccgcatcttatccacagcggtgcgccgccgctcggccatcgccgcggtagcggccgggaacgcgcgcgaggcctccacggccgtcgccgcggcgcccggagtgctagcccccgacgcgacctcggtgcgcgctcccgtgatgccgtacgatcgcatcgccgaagccgttaacgccaggctccggcgggttgagcacccagacccgcgcttcctccgctatgcaagtcccgtgccggcccacgccgaccacacgttcatccttgcggcgccggagactcggttcaccacgctgcccaacggcctgcgcgtggccacggagtcgtccctcgccgcgcgcacggatacggggggtgtgatctccgatgcggncagcaggtacgagaacgaggaggcgggccgaagtcccaattttgtcaagcacatgctgttcaagggcacaggatagtgtaccgcctcgcagctggaacaagaaaatt

SEQ ID NO: 24955 - protein, 151 aa, Zea mays
  misc_feature: Ceres CLONE 1396338-F
  misc_feature: SWISSPROT Homolog: EC 3.4.24.64 Mitochondrial processing peptidase
  misc_feature (127)..(127): Xaa is any aa, unknown, or other
MAFRRILSTAVRRRSAIAAVAAGNAREASTAVAAAPGVLAPDATSVRAPVMPYDRIAEAVNARLRRVEHPDPRFLRYASPVPAHADHTFILAAPETRFTTLPNGLRVATESSLAARTDTGGVISDAXSRYENEEAGRSPNFVKHMLFKGTG

SEQ ID NO: 24956 - DNA, 757 bp, Zea mays
  misc_feature: Ceres CLONE 1396344-F
  misc_feature (204)..(204): n is a, c, t, g, unknown, or other
  misc_feature (465)..(465): n is a, c, t, g, unknown, or other
  misc_feature (503)..(503): n is a, c, t, g, unknown, or other
  misc_feature (504)..(504): n is a, c, t, g, unknown, or other
  misc_feature (535)..(535): n is a, c, t, g, unknown, or other
aagctggagctccccgcggtggcggccgctctagaactagtggatcccccgggctgcaggaattcgcacgagaccattacctagaacatcctaatcgaaaagcgaccgcgactcggatcggatctctctcctgtgtagagccatgctgtgctgtgctggtagtagcagcagcagtagcaatgagtagtccagtccacagctccnagaacacgtggccgtcctttccttgcctctccctatcggtattcggtaacgcagggggagggcgccaccggctttaaccatggcctgtcgcttttgcctcgtctggtcggctggtccctctgctctatcccatcccccttgagcaggctgttgagcaagctgaactcatacgaacctcgatttctttccgtccggcgtttttttttctctcagtttctgaggtatttctccccctttctttcttccctccctcccagtagnatcttcactggctcggggatttgaacaaaaggccgtgnntcaaagctgggtgtgtccgttcaattgtgcngaaaagaaagccaggtgttatgttgtgaagtagtgaaagctacccagggaggctggctctcgcctcgcgaggatgggatctcgaagttcgggagggggcctgaggctccccaagagagaatccgggaagaccaccttgctgctgcgacaaaaaacccgggggggtggggtaaaggggacctcagaatctcccccgttggaagggaacagaagccccttcgcc

SEQ ID NO: 24957 - DNA, 731 bp, Zea mays
  misc_feature: Ceres CLONE 1396345-F
  misc_feature: Encodes the peptide sequence at SEQ ID NO. 24958
gctctagaactagtggatcccccgggctgcaggaattcgcacgagaccattacctagaacatcctaatcaaaaaatgtgatgtgagcctggcagcctgctgcctgcccgcgtccccgggactagttcagttgcttcactgtgacggcgcactggccctgcgtgccgcgtgcgcgctgcagcagtgcgatagcgagcagatggacgactccacggacatgaccgtcgacttcctccgtgcgcggatgctctccgagcggtccgtctccccgcgccgcccaagagcgtgcgcacgaactcgccaagagggtcggcggaactgaaagaacaagaccacgccggggaacgcagccaaagaggaaggggggaaaggccaaccccccaggtggctccccagttcccccaatccccgggtttttggaacctatcttccggggggggggccgcccaatccaaaagggttcaaaaaaacacaaccgtggcaagacgggggggtccccaaaatgttaccctctccagccccgggggaattaaaaaacaaggggtgcaaatcccatcccccgtatccgcctagaaaaacgggggggacaccagaacacggcgggggtgggggtaacccggcagaaacaaaaaaggggggggtggggggggggggggggacaaaagggggggggaaaaccgccgcaacacaaaacaatccaaataggggacaaccgggggggcggggggcggg

SEQ ID NO: 24958 - protein, 40 aa, Zea mays
  misc_feature: Ceres CLONE 1396345-F
MDDSTDMTVDFLRARMLSERSVSPRRPRACARTRQEGRRN

SEQ ID NO: 24959 - DNA, 764 bp, Zea mays
  misc_feature: Ceres CLONE 1396348-F
  misc_feature: Encodes the peptide sequence at SEQ ID NO. 24960
  misc_feature (37)..(37): n is a, c, t, g, unknown, or other
  misc_feature (38)..(38): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (51)..(51): n is a, c, t, g, unknown, or other
tgtcccccccctttttttttctttatctcacccacannccccccccnnntnaaaagctggcactccccgcggtggcggccgctctagaatagtggattccccgggctgcaggaattcgcacgagaccattacctagaacatcctaatcaaaaaatcccaaatagttactccactcccctcacccctcccgactcccgtgctctctctctctctctctctcggatccgaattgccagcgcaccagtcgagctcgcgggaactcgccggcaccggcgatggcctccgccctactggccggacagggcggggcgcgccaccacggctggggggagacgcgcgccccactcgcgcccatacctcccaaccctaaccccagccagccccacccgcgcgccgacgggtccaagtccaagccgcgggcggcagcctcctcgccggcggccggatacgtgacgttccgcccggcgtccctgggcccgcgcgaggcccgcgcgctccgggaccgcctcgcgggggagctcacccaggtgcgcgccctccttctcccgcaacggaaacctggcagcaggagggcccggccgcccgcgggggctccctcgtagagtccgcgaaaagcggtgcggtgtagatactccacccaggttgcgcaaggaacaaaccaaaacgtgcgcatacaaccgccccccactgaaagctcatgaaagacatgaatctccaaagaaatatacaaacaccccaaaataaaactacaaatatgaaaaccg

SEQ ID NO: 24960 - protein, 108 aa, Zea mays
  misc_feature: Ceres CLONE 1396348-F
MASALLAGQGGARHHGWGETRAPLAPIPPNPNPSQPHPRADGSKSKPRAAASSPAAGYVTFRPASLGPREARALRDRLAGELTQVRALLLPQRKPGSRRARPPAGAPS

SEQ ID NO: 24961 - DNA, 708 bp, Zea mays
  misc_feature: Ceres CLONE 1396350-F
  misc_feature: Encodes the peptide sequence at SEQ ID NO. 24962
  misc_feature (397)..(397): n is a, c, t, g, unknown, or other
  misc_feature (409)..(409): n is a, c, t, g, unknown, or other
  misc_feature (421)..(421): n is a, c, t, g, unknown, or other
  misc_feature (449)..(449): n is a, c, t, g, unknown, or other
acccgcggtggcggccgctctagaactagtggatcccccgggctgcaggaattcgcacgagaccattacctagaacatcctaatcaaaaattgtagagcagtgcgacagagttccccgatcgaagcagattgaggtccactgtgctgtactgctgtgcgtcaatcatggaagcaatccaccttgcctacgtgctcgtcttcctcttgcccatcctcctcctccgtctccggcgccgcgggcctcctccagtcaagcggccacgaacaacgacggcccactgcccgcaccccagcccggtcctgggcaacaccctccacttcatccgcaaccgccgccgcttcttcgactggtacgcggacatgctccgcgccgcgccgtcgtgcataaaaaaaaggngtgggggccccnttgggcgcgggncacgcccggcacaaccgccagccccggncgaacgtcgacccacctcctgcgctcccagcttcgacaagtaacggccaagggcgcgcttcttccgcgacgcccaccggggatctccatcgggcgacggggctcttccgcccgccgagggcccgcctctggagccctccaaggggaagcttggcggtccaaaagcctttctcgtcccgtttggttcccgccgggttaaccgaacgggggtccttcgaaggtgcaacctggggccgccctttttcctggccgttcctgga

SEQ ID NO: 24962 - protein, 108 aa, Zea mays
  misc_feature: Ceres CLONE 1396350-F
  misc_feature (78)..(78): Xaa is any aa, unknown, or other
  misc_feature (82)..(82): Xaa is any aa, unknown, or other
  misc_feature (86)..(86): Xaa is any aa, unknown, or other
  misc_feature (95)..(95): Xaa is any aa, unknown, or other
MEAIHLAYVLVFLLPILLLRLRRRGPPPVKRPRTTTAHCPHPSPVLGNTLHFIRNRRRFFDWYADMLRAAPSCIKKRXGGPXGRGXRPAQPPAPXERRPTSCAPSFDK

SEQ ID NO: 24963 - DNA, 818 bp, Zea mays
  misc_feature: Ceres CLONE 1396354-F
  misc_feature: Encodes the peptide sequence at SEQ ID NO. 24964
  misc_feature (19)..(19): n is a, c, t, g, unknown, or other
  misc_feature (29)..(29): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
ttccccccccccccccccngccccccctntnnnggtccggcccccctcaaagctggtagctccaccgcggtggcggccgctctagaactagtggatcccccgggctgcaggaattcgcacgagaccattacctagaacatcctaatcgaaaaaatttggatgtggactagatgcttaaggtgtgaacgtgaaagtggggtccccagatcatcacgaagggtgataatgtcagctgaagcacactacctttcatttgggaagttccttgaacttagtttttcaagccactcaaccgctagaaggctgccaatatgcgggcattcactcaatacggattgtctgcgctttttttgggttgggctccaaagttgcaatgttccagtattcctcagtcgaaatttacaatgcctgcaaaccacagcctactcttgagattcacaaccccgatatgcacaaagatgcccccaaggttgctggccctccgtgtttcgtggctctggattggttgagccttcaatgagaggctgattccagcttaatataggaggggaacaaggcttttggataatttcttttttgcttaatttggtgcaaacatattaaagggggaaccaaggtttatttaaagggaaaaatcctttgtacacaaccaagaaggtcccctaccacaagatggaaaacgatattttggggaattcctccccaaggggggggaggtttcaatggagataagcggaattcttgttcaacctttgtgggagaagctaacaaatttccaagaatctggtaatgcctccacgctaacatagggttgtgtg

SEQ ID NO: 24964 - protein, 90 aa, Zea mays; identical to SEQ ID NO: 11994
  misc_feature: Ceres CLONE 1396354-F

SEQ ID NO: 24965 - DNA, 662 bp, Zea mays
  misc_feature: Ceres CLONE 1396355-F
  misc_feature (308)..(308): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (340)..(340): n is a, c, t, g, unknown, or other
  misc_feature (355)..(355): n is a, c, t, g, unknown, or other
tccccgcggtggcggccgctctagaactagtggatcccccgggctgcaggaattcgcacgagaccattacctagaacatcctaatcgaaaaacttccccatcccgcttgctccgtgccgtggtctccgaggtcggggttcctttccgatttgatccgcccagctggaaaacgaaaatcgctgatgggttttggaaggaaagtcgtcatttcttggtgaggtttccgtttctggatcgactggctgatcgatcgtactaccgccatgggcgtcgtcgtgcatcccggccggcggcatccggctgcgganctggaagatggtcaagggcgnnngcgcgccgncgccgccccgccggngcactcaggggcgtctccacgctctcggaggcgtccactcgtcccagcctcctcggcgtcgtgggaggcgctgtcgttaagggcccgggcaaggccggaaagcggccagccagaaggacaagaggggggggggctgcccgggtcatggaccctccgttgtccccgtgggaggggatgggggggaaccgggagcgggtgccctcggattcctgtggttgtggtgttgtttggccctgttccctgtgggtaccaccgtccggctgcggcccccagtcccggcgtccccaccgcctccgcacccacgtac

SEQ ID NO: 24966 - DNA, 640 bp, Zea mays
  misc_feature: Ceres CLONE 1396359-F
  misc_feature (247)..(247): n is a, c, t, g, unknown, or other
  misc_feature (338)..(338): n is a, c, t, g, unknown, or other
  misc_feature (339)..(339): n is a, c, t, g, unknown, or other
  misc_feature (424)..(424): n is a, c, t, g, unknown, or other
  misc_feature (425)..(425): n is a, c, t, g, unknown, or other
  misc_feature (533)..(533): n is a, c, t, g, unknown, or other
  misc_feature (565)..(565): n is a, c, t, g, unknown, or other
  misc_feature (566)..(566): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (573)..(573): n is a, c, t, g, unknown, or other
cgctctagaactagtggatcccccgggctgcaggaattcgcacgagaccattacctagaacatcctaatcgaaaaaggaaaaggagccgaggaagccctcccctctcgccgcagccgcaccaccagaccgacaaccggccggcttccctcgcccccggcgaggagtgaagacaagccgacaaggcaaaaccatcgcctgtacggtatccaaccgccgtcccgccgcaaacaaggggatagggcgggnagagggggatctcgctttcgctccgctgccgcatgcgcaccgcccctcctcatgacaccaactagggcaccaccagcccccttctcgcgannctccgcgcggtgactctgctgagcatctaacccttatagggcgaacccatggatgtaacttcgaccgctgcccctccgcttcagnngggggggtaggtgtaacacgggcatgtccgcggatacatcaaggggcctggtgctcgcgctctcctccagcctcttcatcggcgcagcttcttattcaagaagaaggnactcaagaaggccatctcgcgtaaaaaaaagnngnnnttnggggaatatcttattatatgagctttttggggggggtggatgataaaatgattgtggtgaaaaattg

SEQ ID NO: 24967 - DNA, 636 bp, Zea mays
  misc_feature: Ceres CLONE 1396361-F
  misc_feature: Encodes the peptide sequence at SEQ ID NO. 24968
  misc_feature (212)..(212): n is a, c, t, g, unknown, or other
  misc_feature (221)..(221): n is a, c, t, g, unknown, or other
  misc_feature (260)..(260): n is a, c, t, g, unknown, or other
  misc_feature (263)..(263): n is a, c, t, g, unknown, or other
  misc_feature (264)..(264): n is a, c, t, g, unknown, or other
  misc_feature (277)..(277): n is a, c, t, g, unknown, or other
  misc_feature (281)..(281): n is a, c, t, g, unknown, or other
  misc_feature (283)..(283): n is a, c, t, g, unknown, or other
  misc_feature (285)..(285): n is a, c, t, g, unknown, or other
  misc_feature (288)..(288): n is a, c, t, g, unknown, or other
  misc_feature (294)..(294): n is a, c, t, g, unknown, or other
  misc_feature (299)..(299): n is a, c, t, g, unknown, or other
  misc_feature (322)..(322): n is a, c, t, g, unknown, or other
  misc_feature (334)..(334): n is a, c, t, g, unknown, or other
  misc_feature (581)..(581): n is a, c, t, g, unknown, or other
aagctggagctccccgcggtggcggccgctctagaactagtggatcccccgggctgcaggaattcgcacgagaccattacctagaacatcctaatcgaaaaacgcgaccactctgatacaggtcaccagcggtgggccccactacccagacgggtcctggttcctccccctccaagccggctctgaaatttgaggcccatagccccgtcggnccccatcgncacgccgccggccacgccccagaagaccccgcccggcgncgnncgctcccgttccntcgngngnagncctcgntcggncgcccggggtcgagcccgttcgntcctctccccangttggaaagtttagggggggctccttggatgagaattgcggtaaagggggttttctccgggtttgtccgggaggggtttgcttggaagggaaggatatggattttgggtggcccccgggttcgggggcccacgggggggggtcctcacccaaaagaaaaaacggtggtcctggggcaaaaatataacccccctttttattttctaagcccccacccgcgggcggccccacactccaagtggtggggngccctccgtcgctcccaaaatgaggccaggaggagtggctgaaacgctttttcca

SEQ ID NO: 24968 - protein, 86 aa, Zea mays
  misc_feature: Ceres CLONE 1396361-F
MRIAVKGVFSGFVREGFAWKGRIWILGGPRVRGPTGGGPHPKEKTVVLGQKYNPPFYFLSPHPRAAPHSKWWGALRRSQNEARRSG

SEQ ID NO: 24969 - DNA, 584 bp, Zea mays
  misc_feature: Ceres CLONE 1396363-F
aaagctggagctccccgcggtggcggccgctctagaactagtggatcccccgggctgcaggaattcgcacgagaccattacctagaacatcctaatcgaaaagtgtatcgcggaattttttgggttctcgggctccgccgcgatcccatccccatccccgccttgccgttgccgttgccggcccccccggttctcccggagctttctttctggccggcgcagtagagaagcaagacagaattgcggcggcgcctgcccgcgcaaaggaataatcagcactgtttgccaaaggcagctcctgacgcatggctagtacttaaggatactttatgtgcagaccatgaagatagatgacgaaaggccttacaaactcatattttcatgatcttgcatctaacgcaggcctaaattaaactgggaggctgaaaaaaagtatccaagggtgagcagataaaatggtgaccaaccattcatctgaagtagctttgggaaggttagcatctgaatggaggaaaattcggaaaaccctttggggtataccccttgaaaggggtgtgtaaaaaaaaaacggcaaaacccaattt

SEQ ID NO: 24970 - DNA, 674 bp, Zea mays
  misc_feature: Ceres CLONE 1396366-F
  misc_feature: Encodes the peptide sequence at SEQ ID NO. 24971
  misc_feature (358)..(358): n is a, c, t, g, unknown, or other
  misc_feature (397)..(397): n is a, c, t, g, unknown, or other
  misc_feature (609)..(609): n is a, c, t, g, unknown, or other
  misc_feature (610)..(610): n is a, c, t, g, unknown, or other
tccccgcggtggcggccgctctagaactagtggatcccccgggctgcaggaattcgcacgagaccattacctagaacatcctaaaaaaaaaggaattctgccttcttctctcatcttcctgctcaacatcagtagcagctttagctgtagcagcgccaccggccaccgccacgccatggccaccacgttgcacaagcccctgggggcgatcaccgttgacgacctcgccgcggcggcgcctggggtcggacgccaccgcgctccacgcagcgctccggcgcgcgctcgactcgacggaccccaccgaagtgtggggcgagtcctgccggtccgtgctctggtccgtctgtccccttcngcgtccaccggatgtctaactacggttgctttccccggnttcccgtctcccacgccgccgcctggacggccgacccccaaggagggtgtcttggacaatgcccccccgggtcctcgaggggcggtgggaaggaacttcctcgggggacgcggaacaagggatcccatcaccaggttcccagaacctccacaagttctcccaacgagaacccagaaggcgtacgggaaaatgggaatctgaggaatatgggnnacccaatttaggggaaaggccttccttgcatcgggaaaaaacaccctccctaaccccgggggga

SEQ ID NO: 24971 - protein, 140 aa, Zea mays
  misc_feature: Ceres CLONE 1396366-F
MATTLHKPLGAITVDDLAAAAPGVGRHRAPRSAPARARLDGPHRSVGRVLPVRALVRLSPSASTGCLTTVAFPGFPSPTPPPGRPTPKEGVLDNAPPGPRGAVGRNFLGGRGTRDPITRFPEPPQVLPTRTQKAYGKMGI

SEQ ID NO: 24972 - DNA, 666 bp, Zea mays
  misc_feature: Ceres CLONE 1396367-F
  misc_feature: Encodes the peptide sequence at SEQ ID NO. 24973
  misc_feature (432)..(432): n is a, c, t, g, unknown, or other
tggagctccccgcggtggcggccgctctagaactagtggatcccccgggctgcaggaattcgcacgagaccattacctagaacatcctaatcgaaaaatcttctctcacgccgccgccgccctttccagggttccaccgagggtgttccataagggtgttccatctacgatggagcaccgcgcggcggcgccagatgtgatcgtccaggtgaactccgcagccgtggcggccgtggacgagagaatctcgacgtgtcagatcaccgaggaggaaggcggcatcgtcggccacgagcaggtccccgtcggctgcctcgcccgccggaccttcagccagtcgtacagaacgaggccccgcaaccctctggagttcaccggggtggcagctggcgctgctggcgtaccagtcgctgggccgtggtgtactgggancattcgggacgtcgccgctctatacctttctcgtctttcgcgcttccggaccccgggaaccgccgacatccttcggaatcttcaaccttctccctctggacactcaacgctcgtcagcctccggtcaagtacgttcttcatcgtgttcccacttaaataaccaatggaggaaggtgtcccccttttgacctgggactctccctcctggtgtgaccccgccaatttttagggggt

SEQ ID NO: 24973 - protein, 140 aa, Zea mays
  misc_feature: Ceres CLONE 1396367-F
  misc_feature (88)..(88): Xaa is any aa, unknown, or other
MEHRAAAPDVIVQVNSAAVAAVDERISTCQITEEEGGIVGHEQVPVGCLARRTFSQSYRTRPRNPLEFTGVAAGAAGVPVAGPWCTGXIRDVAALYLSRLSRFRTPGTADILRNLQPSPSGHSTLVSLRSSTFFIVFPLK

SEQ ID NO: 24974 - DNA, 783 bp, Zea mays
  misc_feature: Ceres CLONE 1396371-F
  misc_feature (21)..(21): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
ggggcccccccaaacaacaanaaaaaaaaaaannnngnnntccccccccctcatagctggactccaccgcggtggcggccgctctagaactagtggctcccccgggctgcaggaattcgcacgagatcattacctagaacatcctaatcaaaaactccgccacctctccacccaacaacaaaacaagcctaatgggtaatggcttcctcagttcctctccatctcacgccactgcgctgccctagaaccttcgccgccgcccctctttaggattaccgtgtccccgatcgccccctggcacgcccgccccgatcgcctcctggcacgcccgcccggatcctgcaccgaaattccgtggggaattccggacccaatcgaaatcgaaccgcctccctgcgtgctcccctgatcaagaaattctcacgccgcgcgaaacgcacgccctgaggcggtttggatccctccggggggggttcctggcgcccccaatttgcctgggcgtggaatgggggccaccccaaaccaccccccttggaacgccggaaagaaaaaaagccccctcctaaagggccggggtccccccaaaacaacggcgccccggcaaaagggggcgcccccatccctccggaaaatctcgaacctttcggggggttttcttggggccctgcccgtccataaggtgtgaccccccaaaggaccaaaaggccccccactttggagccccccaccctgcggggagggttttggctcttaaaaaaaaaaacacccaagggatggggtttg

SEQ ID NO: 24975 - DNA, 655 bp, Zea mays
  misc_feature: Ceres CLONE 1396375-F
  misc_feature: Encodes the peptide sequence at SEQ ID NO. 24976
  misc_feature (159)..(159): n is a, c, t, g, unknown, or other
gctctagaactagtggatcccccgggctgcaggaattcgcacgagaccattacctagaacatcctaatcgaaaagtaagagaggattttgctaggtttttgcccccaaccgcccaactgcgcgtgctcctgccgacctcccacccctccactccccggnggttggcggctgtctcgccgaagcgacccagccgatatggcgaagggcgacgacgcgctggcgcggaagcgcaaccgtgtgcgccgcaagcgcctccgtagcagcgagaacgctgtttccgcgcgtgtcgcggcgatcatcgccctccagcaccgccgcaagtcggggaagcgccgcgcctgcgagggcatgtgcttctcgctccccacgcccgacgacccgttcaacgagcggcatggcaggaagcacaagctcgatgacgagccggccgacgacacagcccgcgacgccgctgaggacagcggcaaccccaagaggaagggcgcgaacaccaaaaagcagcagccggtggcaaaatatggcccccgaggcggagtcgaaaggcggttcccagaaaggaacacgggtggcggaggtgcccccggggaactccaaccgggcggcccaagttccctggggggcctgtctcaacgcttttccgggatggggggggcgc

SEQ ID NO: 24976 - protein, 153 aa, Zea mays
  misc_feature: Ceres CLONE 1396375-F
MAKGDDALARKRNRVRRKRLRSSENAVSARVAAIIALQHRRKSGKRRACEGMCFSLPTPDDPFNERHGRKHKLDDEPADDTARDAAEDSGNPKRKGANTKKQQPVAKYGPRGGVERRFPERNTGGGGAPGELQPGGPSSLGGLSQRFSGMGGA

SEQ ID NO: 24977 - DNA, 644 bp, Zea mays
  misc_feature: Ceres CLONE 1396377-F
  misc_feature: Encodes the peptide sequence at SEQ ID NO. 24978
  misc_feature (367)..(367): n is a, c, t, g, unknown, or other
  misc_feature (382)..(382): n is a, c, t, g, unknown, or other
tcaccgcggtggcggccgctctagaactagtggatcccccgggctgcaggaattcgcacgagaccattacctagaacatcctaatcaaaaaaacaaccgatcgcccacgcaaacctctcctcaactcgatcaaaccggggacggaaaaggcccaccaaaatcccccaaaatttcgtacctcctcagccccagcaatctcgaatcccgatgctcacagcctccaccgaatccctggcggtcgtcatcagcgcatgagctttcttcgctcgctagcggactccttctcatcgctgctcttctcgtcgggaggcggggcggtgtccatggacgcggcgggggcggccccgtcgccggcggcggtggtggnggagccgcgtggcgntgaacctcagggggtacttcgacctcgccaaagaggagatcgacaaggccgtgcgcgctgaaggagtgggggctccccgacgaggccaccgcgcactaccgcaacgcgatgcgggtcatgctcgaggccaagggcgggcgccgtccccgatgccgtctcctccagggagagggggccaggtcagggtgtaccagaagaaaaatggacaagcggcagggcccagggccgaggaaagggtcaaaagggcctgaccaaagaaagc

SEQ ID NO: 24978 - protein, 63 aa, Zea mays
  misc_feature: Ceres CLONE 1396377-F
  misc_feature (39)..(39): Xaa is any aa, unknown, or other
  misc_feature (44)..(44): Xaa is any aa, unknown, or other
MSFLRSLADSFSSLLFSSGGGAVSMDAAGAAPSPAAVVXEPRGXEPQGVLRPRQRGDRQGRAR

SEQ ID NO: 24979 - DNA, 642 bp, Zea mays
  misc_feature: Ceres CLONE 1396379-F
  misc_feature: Encodes the peptide sequence at SEQ ID NO. 24980
  misc_feature (109)..(109): n is a, c, t, g, unknown, or other
ggcggccgctctagaactagtggatcccccgggctgcaggaattcgcacgagaccattacctagaacatcctaatcaaaaacaccgcggcccacgctgcgtaggactcncccgactccgacggcgtccgcccgcgtcgcgtggcacgcccacgccacgccggccgccgcgaggaaagaacaccgggtacttccccttcccttacgctccagtttcacaagtcgcgagccgtgcgtcgcgtcgacgcgagttccgcgtgagggagcaggcagttgcagttggaggcggtgacgaaaccctaggacttgagttccagcgcacggctcgggtcctcctcaccgttcccggcgatggaacggcggcaggagctttgcaggaacttccagcgcggcagctgcaagtacggatcacactgcaggtttgtgcacgcctcctctcaacagcagcagcaggcgagccccagcccgtttgggttccgtttaagaaagtagcaacaagctcaacgcacaaaactgtggctccccacggttgggccgggcaccacctcagcaaaaaccccaacccactttgtatctgggggtgacagggacaccggatggtaaatacaaatgaatgatatttgaaaataaacaaggatttccga

SEQ ID NO: 24980 - protein, 46 aa, Zea mays
  misc_feature: Ceres CLONE 1396379-F
  misc_feature (3)..(28): Pfam Name: zf-CCCH Pfam Description: Zinc finger C-x8-C-x5-C-x3-H type (and similar)
MERRQELCRNFQRGSCKYGSHCRFVHASSQQQQQASPSPFGFRLRK

SEQ ID NO: 24981 - DNA, 703 bp, Zea mays
  misc_feature: Ceres CLONE 1396381-F
  misc_feature: Encodes the peptide sequence at SEQ ID NO. 24982
  misc_feature (280)..(280): n is a, c, t, g, unknown, or other
  misc_feature (378)..(378): n is a, c, t, g, unknown, or other
  misc_feature (383)..(383): n is a, c, t, g, unknown, or other
  misc_feature (465)..(465): n is a, c, t, g, unknown, or other
tggagctccccgcggtggcggccgctctagaactagtggatcccccgggctgcaggaattcgcacgagaccattacctagaacatcctaatcgaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccnactcttccgatgcgctggacaagatcagggtcgagagtctcactgacaagagcaagctcgatgcgcagcctgagcttttcatccaccttgtcccagancaggncacgaacacgctctccatcatcgacagcggcatcggaatgaccaagtccgaccttgtcaacaacctcggtaccatcgccagntcccgggaccaggaggtcatgaaagccccttgctgccgggcgctgatgtgtccaatgattggcccagttccggcgcggttttctactcttgcctacctcgtcggcggaagggaggtggtcgtggaccccaaggccacaacgataaccaagcagtcccgtgtgggaagccccaaggggggggggtcctttcactgttactccgggacccctcaaggggaacaactttgggaggggccac

SEQ ID NO: 24982 - protein, 179 aa, Zea mays
  misc_feature: Ceres CLONE 1396381-F
  misc_feature (39)..(39): Xaa is any aa, unknown, or other
  misc_feature (71)..(71): Xaa is any aa, unknown, or other
  misc_feature (73)..(73): Xaa is any aa, unknown, or other
  misc_feature (100)..(100): Xaa is any aa, unknown, or other
MASETETFAFQAEINQLLSLIINTFYSNKEIFLRELISXSSDALDKIRVESLTDKSKLDAQPELFIHLVPXQXTNTLSIIDSGIGMTKSDLVNNLGTIAXSRDQEVMKAPCCRALMCPMIGPVPARFSTLAYLVGGREVVVDPKATTITKQSRVGSPKGGGSFHCYSGTPQGEQLWEGP

SEQ ID NO: 24983 - DNA, 660 bp, Zea mays
  misc_feature: Ceres CLONE 1396383-F
  misc_feature: Encodes the peptide sequence at SEQ ID NO. 24984
  misc_feature (226)..(226): n is a, c, t, g, unknown, or other
  misc_feature (233)..(233): n is a, c, t, g, unknown, or other
  misc_feature (234)..(234): n is a, c, t, g, unknown, or other
  misc_feature (236)..(236): n is a, c, t, g, unknown, or other
  misc_feature (237)..(237): n is a, c, t, g, unknown, or other
  misc_feature (243)..(243): n is a, c, t, g, unknown, or other
  misc_feature (266)..(266): n is a, c, t, g, unknown, or other
tccccgcggtggcggccgctctagaactagtggatcccccgggctgcaggaattcgcacgagaccattacctagaacatcctaatcaaaaaacggtttgcgtataaataagtagtcagtcgctcatcttgttccttgtgaacatcgcagtgctgtagcctccttcgtcttgagcgagcatggagatgtcagccatggaggaagccctcccaaggccgatggagagnaggaagnnanncctcanaaccattccgttcatcatcttanacgagatattcgagaaggtggccacgttcgggctgtcggccaacatgatcctgtacctcaccgagcggtatctcatgaccaacgcctttgccaccgtcgtcctctacttctgggatgccttctccaacttcctgccatctttaggcgccgtggtcgccgaccccccccttggccggttccgggatattacccttcggcttcctggctcatccccttccggaaatcgtcttgctttgctcgatcacgatccttccctggtacaaccatcaccccgcattagcccttctaatctgccttttacttgtcttgtattcattgttgatacaaatcggcgcgcccctctacgcgcgaaccgagaaaccgccgaccgttagaaaatcatctactaattcca

SEQ ID NO: 24984 - protein, 153 aa, Zea mays
  misc_feature: Ceres CLONE 1396383-F
  misc_feature (16)..(16): Xaa is any aa, unknown, or other
  misc_feature (19)..(19): Xaa is any aa, unknown, or other
  misc_feature (20)..(20): Xaa is any aa, unknown, or other
  misc_feature (22)..(22): Xaa is any aa, unknown, or other
  misc_feature (30)..(30): Xaa is any aa, unknown, or other
MEMSAMEEALPRPMEXRKXXLXTIPFIILXEIFEKVATFGLSANMILYLTERYLMTNAFATVVLYFWDAFSNFLPSLGAVVADPPLGRFRDITLRLPGSSPSGNRLALLDHDPSLVQPSPRISPSNLPFTCLVFIVDTNRRAPLRANRETADR

SEQ ID NO: 24985 - DNA, 708 bp, Zea mays
  misc_feature: Ceres CLONE 1396384-F
  misc_feature (614)..(614): n is a, c, t, g, unknown, or other
  misc_feature (615)..(615): n is a, c, t, g, unknown, or other
aagctggagctcaccgcggtggcggccgctctagaatagtggatcccccgggctgcaggaattcgcacgagaccattacctagaacatcctaatcaaaaagtgagtagtgactcgtctggtctcccctctctcgttcgtctggtcctcccgtccagaggcgttctctctccctccccctttcctctggtcatcgcacccgtctccccgctctgactccgcccgcgccgccgactcccggcacggccccaggtttcatctccgccgccgcgccgcctcgctccgatcgacccccgaaacgccggaaacccgtgggcttcgcgaggttgcctctcttcgtccaagaggtagataacataacagtgcgacagttgaaattgcagagagaaaggggggcatttgggtcgctgtatgaatggggaagggccccaatttcgctggcatgattggagggcatgacaatggtggggatttctgcgaaatggcatactaccggaaagctcggtgagggtcaaaaaatgacgggaagacacccttataagaatgcagacccagaacacatggggggttcccattgaatgggctggggaacaaaagaaaggtaaaggaagctggnnaatcccaaaaatagggaggctcaatcccccctgggcctcaaggggaaccgggggttgggaaataaaccccgggcgggggggaaacaaaatttt

SEQ ID NO: 24986 - DNA, 695 bp, Zea mays
  misc_feature: Ceres CLONE 1396391-F
  misc_feature: Encodes the peptide sequence at SEQ ID NO. 24987
  misc_feature (208)..(208): n is a, c, t, g, unknown, or other
  misc_feature (227)..(227): n is a, c, t, g, unknown, or other
tggagctccccgcggtggcggccgctctagaatagtggatcccccgggctgcaggaattcgcacgagaccattacctagaacatcctaaaaaaaaagcagtccaaacacgcaacgcaacactcgccttcccctcccaaccctccgaaccgaagcagcaaagctagacgatgacgctgacgatcccggacgaggtgcgcgccaaggcgnaggtgtacgtgggcgacgncgcggggcaagagaagacgcggctgctcctccaggaagacgggccctcccgagcgggcttgctccccgctgcgggacatcatcgaagtgcggctacgtggaggaaaacgggcttccgggggggttcccggaaccgcccccaaggggggacccattaattttccccaaaggccgggccgcccagggggcctaacggggccccaagggggttccccggggggccccaaaaaaaggggccccgtttaaaaaaaaaaataaacgggggggttaaaaggacaaaaaaaaaaaaaatttcttgttgtggggggcccccccccccccccaaaaaatatttggggggaaaaaaaccaccccccccccgcggggggggggaaacccccccccccggggggggggccccccctgggggggggttgtttcccccacaaaaattttttcccccccacgaggggggtttttcttttaaggg

SEQ ID NO: 24987 - protein, 71 aa, Zea mays
  misc_feature: Ceres CLONE 1396391-F
  misc_feature (14)..(14): Xaa is any aa, unknown, or other
  misc_feature (20)..(20): Xaa is any aa, unknown, or other
MTLTIPDEVRAKAXVYVGDXAGQEKTRLLLQEDGPSRAGLLPAAGHHRSAATWRKTGFRGGSRNRPQGGTH

SEQ ID NO: 24988 - DNA, 664 bp, Zea mays
  misc_feature: Ceres CLONE 1396392-F
  misc_feature: Encodes the peptide sequence at SEQ ID NO. 24989
  misc_feature (300)..(300): n is a, c, t, g, unknown, or other
  misc_feature (322)..(322): n is a, c, t, g, unknown, or other
  misc_feature (323)..(323): n is a, c, t, g, unknown, or other
  misc_feature (329)..(329): n is a, c, t, g, unknown, or other
  misc_feature (371)..(371): n is a, c, t, g, unknown, or other
  misc_feature (450)..(450): n is a, c, t, g, unknown, or other
  misc_feature (496)..(496): n is a, c, t, g, unknown, or other
  misc_feature (551)..(551): n is a, c, t, g, unknown, or other
  misc_feature (556)..(556): n is a, c, t, g, unknown, or other
  misc_feature (664)..(664): n is a, c, t, g, unknown, or other
gctctagaactagtggatcccccgggctgcaggaattcgcacgagaccattacctagaacatcctaatcgaaaaaatcaactcgtttctctccgattgctcctccgagtccgagactccgttctctcccgcatccaccgccgtctcatccccaatccgagcaacgcctcccctcgcctccaaaaccctacccctcctgtcaccggcgggggcatgaaccggtgatcgcttacctggtctcgtctgtctgcgcacgcgcgaggtcagtgagtgagcattgcggtggtccgatcgcccgcgnggggccatggcgtctgtggcgnnatcggncggcggggcaaagcgcggggccggtgggttgagacttacttncagacccccgaggggcggcacaagctgcagtacgagaagacgcactcccccgccgtcgtgcactacaacccacacggcnagaccgtcgcccagatgacggtggcatatttgaaggagaagcagcnaggcagggttccacgcctttcacaccaagtgctggtagtgggatgcggtctgcanctgcnagactgcttggcactgggaatggtagccggacacttagcttcggagcatggtaccagcagtctgcctcaggaagcagccgcatgggtggaggtattggtgtgtcaccn

SEQ ID NO: 24989 - protein, 42 aa, Zea mays
  misc_feature: Ceres CLONE 1396392-F
  misc_feature (5)..(5): Xaa is any aa, unknown, or other
MRSAXARLLGTGNGSRTLSFGAWYQQSASGSSRMGGGIGVSP

SEQ ID NO: 24990 - DNA, 671 bp, Zea mays
  misc_feature: Ceres CLONE 1396395-F
  misc_feature: Encodes the peptide sequence at SEQ ID NO. 24991
  misc_feature (560)..(560): n is a, c, t, g, unknown, or other
  misc_feature (671)..(671): n is a, c, t, g, unknown, or other
aagctggagctccccgcggtggcggccgctctagaactagtggatcccccgggctgcaggaattcgcacgagaccattacctagaacatcctaatcgaaaagaagcatctcttctccccccttcccaatcgggctgcggcatatccccttctccgtcctcccgcctgccgccatgtcttcgccttcgccctcgccgccggcgccggcggaagaggagggccgggcgccgaccaagtacgtgctgatcaccggcggcgtcgtcagcggcctcggcaagggcgtcaccgccagcagcatcggcgtcgtcctcaaggcctgcgggctccgcgtcacttgcatcaagatcgatccatacttgaacacagatgctggtacaatgtccccccttgagcatggcgaggtgtttgttcttgatgatggtggagagttgacttggatttggggaatatgagcgtttcatagatggtactctgacaggggataacacattaccactggaaagatatacagtctgtcattgagaaggagagaggggtgattatcttgaaagactggacagntatcctcatgcactgatgaataaacagtggatacagcatgtcttcggttctgtggatggcaactcgtcagctgatgtttgggtattgattgggagcactgtagtgatatgn

SEQ ID NO: 24991 - protein, 92 aa, Zea mays
  misc_feature: Ceres CLONE 1396395-F
  misc_feature (20)..(93): Pfam Name: CTP_synth_N Pfam Description: CTP synthase N-terminus
  misc_feature: SWISSPROT Homolog: EC 6.3.4.2 CTP synthase
MSSPSPSPPAPAEEEGRAPTKYVLITGGVVSGLGKGVTASSIGVVLKACGLRVTCIKIDPYLNTDAGTMSPLEHGEVFVLDDGGELTWIWGI

SEQ ID NO: 24992 - DNA, 739 bp, Zea mays
  misc_feature: Ceres CLONE 1396398-F
  misc_feature (9)..(9): n is a, c, t, g, unknown, or other
  misc_feature (10)..(10): n is a, c, t, g, unknown, or other
  misc_feature (14)..(14): n is a, c, t, g, unknown, or other
  misc_feature (35)..(35): n is a, c, t, g, unknown, or other
  misc_feature (36)..(36): n is a, c, t, g, unknown, or other
  misc_feature (42)..(42): n is a, c, t, g, unknown, or other
  misc_feature (43)..(43): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (68)..(68): n is a, c, t, g, unknown, or other
  misc_feature (80)..(80): n is a, c, t, g, unknown, or other
  misc_feature (81)..(81): n is a, c, t, g, unknown, or other
  misc_feature (84)..(84): n is a, c, t, g, unknown, or other
  misc_feature (85)..(85): n is a, c, t, g, unknown, or other
ggggggggnngggnggggggggggggggggggganngggggnnacgcgtgcggctccnnntcaacagnaccacaattatnnttnntaaagctggggctccccgcggtggcggccgctctagaatagtggatcccccgggctgcaggaattcgcacgagaccattacctagaacatcctaatcaaaaaattcgaacggaggtccttttcttctttctcgtctgcttcctccttccctcgtcgtcctcgcgtcgcctccttcggccctccctattaatacctgcctcctcacaaccagtcctgtcctcggggagccgaatccacacggacacaccagaggaccgcggggacgcccccgaatccttcgatttccgggagggacctacccggaaatagcccttaatggttccctgcctcaaggggatgggggccactgggaaaaaaacaaaaatttccgggataaaaaacgggaagccggcctaatgaaccgggccctggtttaaaaaggggccccgggtgtccccggggggaaacccttccccaacccctaaaaaggggggggcccacttggggaaaaaaattggggaaaaaaaaaaaaccggggggaattttcccagggggggggcgggggttttttttttcctccccaaaaaaaagaccccccccggaaaaggggcccctaaaaaaaaaattaatccgcccccccttttttaaaaggggcccccacattataaggggggg

SEQ ID NO: 24993 - DNA, 663 bp, Zea mays
  misc_feature: Ceres CLONE 1396399-F
  misc_feature: Encodes the peptide sequence at SEQ ID NO. 24994
  misc_feature (311)..(311): n is a, c, t, g, unknown, or other
tccccgcggtggcggccgctctagaactagtggatcccccgggctgcaggaattcgcacgagaccattacctaacatcctaatcgaaaaatccatcaaagtcacagagacgaccagctgaagcgaacacagagctgctcgccgtgtaacgcagcaggcagcagcacccagaggcggcaggtcacacacacagcacacgcagatcttcgatcaccaccatgggttctctcggcagcgccgcgcagcagcagcagcaaccgcacgccgtgtgcctgccgtacccagcgcagggccacatcaccccgatgctcnacgtggcgaagctgctgcacgcccggggctcccacgtcaccttcgtcaacaccgagtacaaccaggcgcgcttcgtccggacccgcggggcggcggccgtgcccgggctccccggcttccgcttcccaccatccccgacggtcttgccgcccgtcgaggaagacgacagcccccaagacttccccctcctggggcaagcccacacgggaaaactgcctccaatccttcccgccgctgggtcggggacctcaaagaacccccccgtaaccttgggtgtttttcgaaagagggtttgggtttttctccaagaaggccccccaggaggtctggcctctccctaacccaaggtctg

SEQ ID NO: 24994 - protein, 144 aa, Zea mays
  misc_feature: Ceres CLONE 1396399-F
  misc_feature: SWISSPROT Homolog: EC 2.4.1.195 N-hydroxythioamide S-beta-glucosyltransferase
  misc_feature (32)..(32): Xaa is any aa, unknown, or other
MGSLGSAAQQQQQPHAVCLPYPAQGHITPMLXVAKLLHARGSHVTFVNTEYNQARFVRTRGAAAVPGLPGFRFPPSPTVLPPVEEDDSPQDFPLLGQAHTGKLPPILPAAGSGTSKNPPVTLGVFRKRVWVFLQEGPPGGLASP

SEQ ID NO: 24995 - DNA, 636 bp, Zea mays
  misc_feature: Ceres CLONE 1396401-F
  misc_feature: Encodes the peptide sequence at SEQ ID NO. 24996
  misc_feature (415)..(415): n is a, c, t, g, unknown, or other
  misc_feature (447)..(447): n is a, c, t, g, unknown, or other
gctctagaactagtggatcccccgggctgcaggaattcgcacgagaccattacctagaacatcctaattgaaaaagaccacacaccacagcactaaaatctgttcatctctggctccccaaattcagctggagagcactttttcccatcatggataagaactacggtgaactctacaacatcctcggatggggtgaggagtacttcgcggtgaacacggaggggcacctcagcgtgaagcctttcggccgctggacggagcccgggcaggagatcgacgtgcactcggtcatcgtggaagctctagcgacccaacccaacgacagcaccaggcaaatctcagttccccatgatccttcgccttccccgacgtgctcaagaaaccgtatcgagacgctccataacgcattcacagncgccatggagtccacccgggtacacgtccagntaaccaaaggcgtgttccccgatcaaggtgaaccagaaaaagcccgtcgtgcaggaaattggggtaaggttcggcccaggaatgggaaatattggccttcgaggcttggcttccaagcaaaaattgctcatccgccatgaggctgcctccccgtccacggaaaccgaagcacaagcccgtattttgatt

SEQ ID NO: 24996 - protein, 145 aa, Zea mays
  misc_feature: Ceres CLONE 1396401-F
  misc_feature: SWISSPROT Homolog: EC 4.1.1.19 Arginine decarboxylase
  misc_feature (89)..(89): Xaa is any aa, unknown, or other
  misc_feature (100)..(100): Xaa is any aa, unknown, or other
MDKNYGELYNILGWGEEYFAVNTEGHLSVKPFGRWTEPGQEIDVHSVIVEALATQPNDSTRQISVPHDPSPSPTCSRNRIETLHNAFTXAMESTRVHVQXTKGVFPDQGEPEKARRAGNWGKVRPRNGKYWPSRLGFQAKIAHPP

SEQ ID NO: 24997 - DNA, 594 bp, Zea mays
  misc_feature: Ceres CLONE 1396405-F
  misc_feature (220)..(220): n is a, c, t, g, unknown, or other
  misc_feature (221)..(221): n is a, c, t, g, unknown, or other
ccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacaggggaagggtagtgtgnntgcatcatggtgggcgtccctcctgctcgccggggggttgttggtccaaaaaaccccggccggggcgggaggaaccggagggttaaaaggtcccccaagggggcccctcgtcccgccaaaaacaagggggggagggcccccccagcaaaggggccccccccccttaagaaatgtaacgcgcacgcctctccccccccgagtttgccaaaccgcacacaccccccgggcgcgcatagtccgtcggcgggaaaagggggggctaatctcggggggggggcgaaaaagaacctacgtggtctaacccacagcgagggggtggcaaccgaccccccccctcttctagtggcccccccccaatggggggggggtcggg

SEQ ID NO: 24998 - DNA, 696 bp, Zea mays
  misc_feature: Ceres CLONE 1396406-F
  misc_feature: Encodes the peptide sequence at SEQ ID NO. 24999
  misc_feature (306)..(306): n is a, c, t, g, unknown, or other
  misc_feature (444)..(444): n is a, c, t, g, unknown, or other
  misc_feature (448)..(448): n is a, c, t, g, unknown, or other
  misc_feature (449)..(449): n is a, c, t, g, unknown, or other
  misc_feature (460)..(460): n is a, c, t, g, unknown, or other
  misc_feature (516)..(516): n is a, c, t, g, unknown, or other
  misc_feature (650)..(650): n is a, c, t, g, unknown, or other
  misc_feature (672)..(672): n is a, c, t, g, unknown, or other
aagctggagctccccgcggtggcggccgctctagaactagtggatcccccgggctgcaggaattcgcacgagaccattacctagaacatcctaatcaaaaagtgagtagtgactcgtctggtctcccctctctcgttcgtctggtcctcccgtccagaggcgttctctctccctccccctttcctctggtcatcgcacccgtctccccgctctgactccgcccgcgccgccgactcccggcacggccccaggcttcatctccgccgccgcgccgcctcgctccgatcgacccccgaaacgccgganaccgtgggcttcgcgaggttgcctctcttcgtccaagcggtagataacataacagtgcgacaggtgaattgcagagagaaggggggcatttggtcgctgtatgatgggcgaagggccccatttcgctggcatgattgnaggnncatgacatggntgggatttctgcgacatggcatactaccggaagctcggtgagggctcaaacatgtncgtagacaaccttaatagcatgcagaccagcacacatggtggctccatgtgcatgtctgtggacaacagcagcgtagggtcctgtgactcccatactaggatgctcaatcaccctggcctcaagggacctgtcngtggaattactcggtcggcggncacagatttttcgtcatggagggg

SEQ ID NO: 24999 - protein, 73 aa, Zea mays
  misc_feature: Ceres CLONE 1396406-F
  misc_feature (14)..(14): Xaa is any aa, unknown, or other
  misc_feature (59)..(59): Xaa is any aa, unknown, or other
  misc_feature (66)..(66): Xaa is any aa, unknown, or other
MAYYRKLGEGSNMXVDNLNSMQTSTHGGSMCMSVDNSSVGSCDSHTRMLNHPGLKGPVXGITRSAXTDFSSWR

SEQ ID NO: 25000 - DNA, 671 bp, Zea mays
  misc_feature: Ceres CLONE 1396407-F
  misc_feature (424)..(424): n is a, c, t, g, unknown, or other
  misc_feature (434)..(434): n is a, c, t, g, unknown, or other
  misc_feature (487)..(487): n is a, c, t, g, unknown, or other
tccccgcggtggcggccgctctagaactagtggatcccccgggctgcaggaattcgcacgagaccattacctagaacatcctaatcgaaaagttccgcttcgtcccagcctctagttcttcctttcctccagagtgatggccaaatgctactcagattggcccccgattccgcctttccatccatcgcgaagaacgccgccgcaatcccacgcctccccgatcacgatcaggcggcagctcgcgtccttcgtgctccactgctccagatcctgcgctcccctcctcgagcccaagaacctgcccgatgagttcgaggccgtaccggcgacgccgccgccgccgctgccggacgccgcccgaagctggggatttctaacaaagtcatccgaggcctctgcggtgacccgcagaccgagcagtggnccttcgaggnctacagggaggcgctgtgccagcccgaattccgggttgaagaaaaaagacggncaacgcgctgacctgcagctgatccagggaaaaaccagtggggctccctggagctggctggtcgaagaacttcagggccccccggcggtgctccccggaaaaaagcggaggtggggggcggcttcgtcgcctgtggattaaggggggggggaaggggttccgccctccccccccgcggggggcc

SEQ ID NO: 25001 - DNA, 657 bp, Zea mays
  misc_feature: Ceres CLONE 1396409-F
  misc_feature: Encodes the peptide sequence at SEQ ID NO. 25002
  misc_feature (389)..(389): n is a, c, t, g, unknown, or other
  misc_feature (404)..(404): n is a, c, t, g, unknown, or other
  misc_feature (471)..(471): n is a, c, t, g, unknown, or other
  misc_feature (485)..(485): n is a, c, t, g, unknown, or other
ggagctccccgcggtggcggccgctctagaactagtggatcccccgggctgcaggaattcgcacgagaccattacctagaacatcctaatcgaaaaattcgtccatcccacctaccatggccaccgcctccggcactgacgccggtgcccagccgcgcgacgaccccagcctcctccccttcgcgtccttctcgctcggcctctccatccgcgcgccggccacccccacactcgcctccgtcccctccaccctccacctccccactcaaatctctacactcgccgtctgcctccacccctccgccgcgcagccctcctcccgccgcaccacccgcctcaattccgccacctcctccgtcatcgccccgctgccctcctcaacgcccggnctctcccgctccttncctttcgggcgcgcccgccgcagcagggcgcccgcgcacgctcgtctggttccgcgcccgactccgncctcacgacatgangcgtttcacgccgcagcgggggcgtcgtcctccctcctccccgttttcgtcttcgatcggcgggacttcggcaagtcccccctcgggttcgaccggacgggcccgtacgcggcaacttcctggctcgatcggtcgcgactttgcggcgggacctccggcgcccgcgttgggg

SEQ ID NO: 25002 - protein, 180 aa, Zea mays
  misc_feature: Ceres CLONE 1396409-F
  misc_feature (96)..(96): Xaa is any aa, unknown, or other
  misc_feature (119)..(119): Xaa is any aa, unknown, or other
  misc_feature (123)..(123): Xaa is any aa, unknown, or other
MATASGTDAGAQPRDDPSLLPFASFSLGLSIRAPATPTLASVPSTLHLPTQISTLAVCLHPSAAQPSSRRTTRLNSATSSVIAPLPSSTPGLSRSXPFGRARRSRAPAHARLVPRPTPXSRHXAFHAAAGASSSLLPVFVFDRRDFGKSPLGFDRTGPYAATSWLDRSRLCGGTSGARVG

SEQ ID NO: 25003 - DNA, 540 bp, Zea mays
  misc_feature: Ceres CLONE 1396413-F
  misc_feature (171)..(171): n is a, c, t, g, unknown, or other
ggagctccccgcggtggcggccgctctagaactagtggatcccccgggctgcaggaattcgcacgagaccattacctagaacatcctaatcgaaaaaagatgaatgctacgtaggtagacagtgttcttgtggtgacgtgaccctccacaggagtggcaaagatggggaanaaactgaaaacgccagaacgcatgtgagactgagctctctggcatggggcctctcctgccggtctgctcgaatcccaccaggggatccataaggaaattccggttttttgtaacccaaattatttggggggggggggaacccaaaaaaaaaaacaaaggaaaccccggggggggggaatttctcgggggggttcccaaaccgggggggaacccccgggttgttttttccggggggggggggggcttaaaaagggggggggattttctcctggggggggcccccacacaccctcgggtgttgtctcctcggccccaaaaaaaacccccgggggggggcgcccgtctcttgggggggggccccccccctat

SEQ ID NO: 25004 - DNA, 691 bp, Zea mays
  misc_feature: Ceres CLONE 1396415-F
  misc_feature: Encodes the peptide sequence at SEQ ID NO. 25005
  misc_feature (691)..(691): n is a, c, t, g, unknown, or other
aaagctggagctccccgcggtggcggccgctctagatccagtggatcccccgggctgcaggaatttgcacgagaccattacctagaacatcctaatcgaaaagtcctcttggctttctctttcccgctctcctcctcgcttgccccccgccagctcgatctccagggagtggactagtgcagggagggagggaagaaaggagtggtgcagctgtgagtgaagccgcctctcgtttccttgattgattggagccgagccggaatgtgatgcgagagaggtgtgcaaattagcaccgttcgcaggacacaactgagcaatcctctgaaggccaaacaccccctttcagttagccatctctgaaggaacatacaggctttttcataagatagtcatggcagagttcaagatcggtaggctggatggcccaccaccaagggtcagaaatgtgcccattggcgtcaccccggaaggattctggtggctgccatcacaggccgcgcttcagagacagggaagagccaaaccagcagggcaaggctagagggggagcatcccctgcgccttcaaagcgtcctcgggtcagagggtccaaccgtttcttcagaggagaagagacagcccactcctactaggtccagaacaattcagaatgagcaggggggcctccagaaatgctgttgctgcccctgan

SEQ ID NO: 25005 - protein, 49 aa, Zea mays
  misc_feature: Ceres CLONE 1396415-F
MAEFKIGRLDGPPPRVRNVPIGVTPEGFWWLPSQAALQRQGRAKPAGQG

SEQ ID NO: 25006 - DNA, 662 bp, Zea mays
  misc_feature: Ceres CLONE 1396416-F
  misc_feature (238)..(238): n is a, c, t, g, unknown, or other
  misc_feature (268)..(268): n is a, c, t, g, unknown, or other
  misc_feature (280)..(280): n is a, c, t, g, unknown, or other
  misc_feature (429)..(429): n is a, c, t, g, unknown, or other
  misc_feature (434)..(434): n is a, c, t, g, unknown, or other
  misc_feature (627)..(627): n is a, c, t, g, unknown, or other
tggagctcaccgcggtggcggccgctctagaactagtggatcccccgggctgcaggaattcgcacgagaccattacctagaacatcctaatcgaaaaaacaggcacaggctccctcctccactgtccagtgtccactcctcgtcccgagaagcagacaaagcgcggcgctgcagattttcggtacggttcccaatgcctccccatggcccgcccgtcgtcccgtgctagcaccccggngccgctcctccacctggcgcgtcggggcgnctgggatccggnggggcaccggggttaggagccccagaatccgggcggaaacccaggctttccgggggggagggctttacttctaacctcagaaatggggggttgccatttcccccccctcttttttgggggttttttttggggggggggggggggggganaaaanaagggggaagaaaaaagaggagaaaagggaagaaaaaggagaagacccccccccccccccttcaataatatttcgacgcacccattttaattatcacaggtagggtgaggtgaataatctggtggacggcctcttgttttctacgtatgtttatattttttgcagaggtggtgttgggccgcagtcggcgaangggatgagacggagaagggcgcgagcgcgacaggc

SEQ ID NO: 25007 - DNA, 756 bp, Zea mays
  misc_feature: Ceres CLONE 1396417-F
  misc_feature (118)..(118): n is a, c, t, g, unknown, or other
aagctggagctccccgcggtggcggccgctctagaactagtggatcccccgggctgcaggaattcgcacgagaccattacctagaacatcctaatcgaaaaaccgattcacaggcgcntcggatcctctgacgtcgacgttccctgccagctcccagctgccgccctcgctccttccgccatctgcgctgttctgcggtgccagagccggcgcgcgcccgctgccgccctcgacggaccgggacccggggcccccaccgttctcttccctgcgctgcgcggcggctgtgctgttgatcagttaatgggctgggaggctgtgacagggggcgtcaagggagttcgaaggcgggggggggggggctaactgaaccccgccgtttctcgagggggcccccgcgaaagcccaagtggaaggccgttaagcccaattgggggcccccaaggggggaggacaaagcccccccgcccccccccgttgaaaaaccaatgggtggttcaccagtttggaaaacaaaagaagggcgttttgacttttggaaggcccccaaaaaaaatccacccccttgcattttggagaggggggttgtcttttggcactagaactggggttattggggggaaaatccaattttgggccaaaaaagtgattaaaaccaactttgaggaaggtatgtggctggcccaaaaaaatagggggaaaatccccaagttgttgggaaacacacccctgtgaaaaaagccctacacactcccg

SEQ ID NO: 25008 - DNA, 834 bp, Zea mays
  misc_feature: Ceres CLONE 1396418-F
  misc_feature: Encodes the peptide sequence at SEQ ID NO. 25009
  misc_feature (12)..(12): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (18)..(18): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (37)..(37): n is a, c, t, g, unknown, or other
  misc_feature (38)..(38): n is a, c, t, g, unknown, or other
  misc_feature (40)..(40): n is a, c, t, g, unknown, or other
tttgcccccccncnnncncnnnngccccccccatccnnancccccccctcctcaaagctggagctccccgcggtggcggccgctctacactagtggatcccccgggctgcaggaattcgcacgagaccattacctagaacatcctaatcgaaaagaaaccaaccagatcacacgaaccaaaccaccgcttcctcccccgaccggagaggagcctcaccgccggcgcccatggcgacacgctacttgatcgtgtcgctgcccgtgcagtcgcccggagccaccgccagctccctgtgggcgcgcctccaggactccatctcccgccactctttcaacacccgctctaccgtttcaacgtcccggatctccgcgtcggaacccttcgaatcggtcctcgcggttaagtgaacacctcgtcaagtccaatgtccttcggggagggcgggtcaaaccaagatccgggagggaaaatcgagggacctcgaagcgccccccgagggggccaaaaaccgggacccttcaccggcgaaagggggtcccccggtcgaaacctatccctcacttagggttcgggggggggaacgaaggggcaaagcacccccaacaaagggccccccttctccagggaaaaatccgcccgggaagcaaatacaagcccacagggttttgccaaagattccgagggaatgacacttgtaaggggttcccaagccattccgaaaataaaaaaaaatggggaaggggggcccaagctttaagggggggatctcaacccggggaacccaaagggggggggagacttagcggggttcttcgcggaaccttttaccaaat

SEQ ID NO: 25009 - protein, 59 aa, Zea mays
  misc_feature: Ceres CLONE 1396418-F
  misc_feature: SWISSPROT Homolog: EC 3.6.3.14 H(+)-transporting two-sector ATPase
MATRYLIVSLPVQSPGATASSLWARLQDSISRHSFNTRSTVSTSRISASEPFESVLAVK

SEQ ID NO: 25010 - DNA, 710 bp, Zea mays
  misc_feature: Ceres CLONE 1396421-F
  misc_feature: Encodes the peptide sequence at SEQ ID NO. 25011
aaaagctggagctccccgcggtggcggccgctctagaactagtggatcccccgggctgcaggaattcgcacgagaccattacctagaacatcctaatcgaaaatctctcagttattcttccagcaaccgttcgcccaaatccattgccgctcctgcccccaacggcgcatgccttcacctcctcagccatggagctcacgagcatctccctctgtgcaccccctccgcgcgtccctgctccctcgtcaccaggtgcacgcgcgcagcttcctgcgcgccgggatggccctccagccccagctcgcccctgccctcagctatggcgccttgccgccgccgcccctgctttccatggcggcacttcctgcttcctggtggtcggcgccctccccaacctctctgctggtggttgtctccatcccctccatggcgagctcgtccctgcattcctgctcgcccaagatccccttccatgttccagccacctcccatggacgccagccctcacctcatagtcgccccagctcgcccaaccccctctctgctggtggccggccacctctgctgcttccatggtgtagcacttacggtatttaagatggagtggaatatttcagcacataacacaccaggtgttcggtgaaaggccaagccaaaagtcgtcgtcgtttcaaatatatcgagtcgattcgattttggtgagctgattc

SEQ ID NO: 25011 - protein, 107 aa, Zea mays
  misc_feature: Ceres CLONE 1396421-F
MAPCRRRPCFPWRHFLLPGGRRPPQPLCWWLSPSPPWRARPCIPARPRSPSMFQPPPMDASPHLIVAPARPTPSLLVAGHLCCFHGVALTVFKMEWNISAHNTPGVR

SEQ ID NO: 25012 - DNA, 715 bp, Zea mays
  misc_feature: Ceres CLONE 1396422-F
  misc_feature: Encodes the peptide sequence at SEQ ID NO. 25013
  misc_feature (590)..(590): n is a, c, t, g, unknown, or other
  misc_feature (674)..(674): n is a, c, t, g, unknown, or other
aaaagctggagctccccgcggtggcggccgctctagaactagtggatcccccgggctgcaggaattcgcacgagaccattacctagaacatcctaatcgaaaaacacacggaagaagccactagctctccgctctcgcctctcggacttctccttgtgccgccgaacaccctcacaagagtcggcctctcgatttctcagtccagccgcagcagcccccttccctccctcctccatcaggtgttgcctcccgcagatccaagtcggaattcggtccttcgtccccaaaccaccaatccggttgcattctttgggtttgctcacagcgcacacaaagccattttactgctgggaatggaggctggcacttagcgtctccggctcttgagtgatctccaagtcctttggaatgctacagggaagtgaagtgatgggggagtgcgaggacggcaaggagtacaggtgctgggaggagctgctgccggacgcgctgagcctcatcttccgcaacctgccgctgcaggaggagctcaccgtcctgccgcgggtgtgcaagtcctgaagggcgcatggtggacggcccctactgcntggcaggagatcgacatctaggagtggagccagcagcacagcaagccggagcagatcgcccgcatggaccagctactcgtgagncgcagcgccggctcgttgctgccggatcagcgtatccgacc

SEQ ID NO: 25013 - protein, 43 aa, Zea mays
  misc_feature: Ceres CLONE 1396422-F
MGECEDGKEYRCWEELLPDALSLIFRNLPLQEELTVLPRVCKS

SEQ ID NO: 25014 - DNA, 666 bp, Zea mays
  misc_feature: Ceres CLONE 1396423-F
  misc_feature: Encodes the peptide sequence at SEQ ID NO. 25015
  misc_feature (115)..(115): n is a, c, t, g, unknown, or other
  misc_feature (150)..(150): n is a, c, t, g, unknown, or other
  misc_feature (151)..(151): n is a, c, t, g, unknown, or other
  misc_feature (282)..(282): n is a, c, t, g, unknown, or other
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (313)..(313): n is a, c, t, g, unknown, or other
  misc_feature (318)..(318): n is a, c, t, g, unknown, or other
  misc_feature (366)..(366): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (638)..(638): n is a, c, t, g, unknown, or other
acaagctggagctccccgcggtggcggccgctctagaactagtggatcccccgggctgcaggaattcgcacgagaccattacctagaacattcctaatcgaaaagaggaggcagntgtcggagacgcggagccagtgggctcagtgacanngtgagcggcgacgttccagtgtccactgtccagtaggcgagcgaggaggtggtccattggccggccatggctcgtctccgctgcgtcttcgtcgtcttcgtcctgctctcgtctgccctccgcccttcagncgacgccattgcctcccggnnngcacatggncccgncgcacacgacaaacgggacgcgctcgtccaagtcattcctcttcttcnagggccagcggtccggcaaggtgccgccgtccaaggcgggttcctgcgcaaggaatccggactttccgacggtccttcccccaggggggcctggggggggggtaccccgacccttggggacaaccaaatttcgggttccaggggggttacaaaaaaaaaattttgggggaacgggggggaatttttgggcctcttttaaaagaggagtttgcggggnnnnnnnnnnnnnnnnnggggnnnnnnaaatttttttttataaannnnnnnncccnaaaaaaattttttttttgggggtttttt

SEQ ID NO: 25015 - protein, 115 aa, Zea mays
  misc_feature: Ceres CLONE 1396423-F
  misc_feature: SWISSPROT Homolog: EC 3.2.1.4 Cellulase
  misc_feature (22)..(22): Xaa is any aa, unknown, or other
  misc_feature (29)..(29): Xaa is any aa, unknown, or other
  misc_feature (34)..(34): Xaa is any aa, unknown, or other
  misc_feature (50)..(50): Xaa is any aa, unknown, or other
MARLRCVFVVFVLLSSALRPSXDAIASRXAHGPXAHDKRDALVQVIPLLXGPAVRQGAAVQGGFLRKESGLSDGPSPRGAWGGGTPTLGDNQISGSRGVTKKKFWGNGGEFLGLF

SEQ ID NO: 25016 - DNA, 680 bp, Zea mays
  misc_feature: Ceres CLONE 1396430-F
  misc_feature: Encodes the peptide sequence at SEQ ID NO. 25017
  misc_feature (332)..(332): n is a, c, t, g, unknown, or other
  misc_feature (353)..(353): n is a, c, t, g, unknown, or other
aaagctggagctccccgcggtggcggccgctctagaactagtggatcccccgggctgcaggaattcgcacgagaccattacctagaacatcctaatcgaaaatcagacatcaccaactcgtcgacggtagagagagcaagctcttcggcgatttgagaagaatcgaggagcgagcgagcgagcgagcgagagaggaggaggaggagctggggcttgagcctgcgcccgggggccccgggtcacggaatcctaccattaccaaccctagccttcgttgatcgccgtctcaggtcatggcagggccggcgccggatcgggcccgcctgactgtngggccgggcatggacatgccnatcatgcacgacagcgaccggtacgagctcgtgcgcgatatcggctccggcaacttcggcgttgcccggctcatgcgcgaccggcgcaacagcgaactcgtcgccgtcaagtacatcgagcgcggcgagaagataaatgagaatggccagcgggggatatttacccctaggtcttgggagcccccctaccattttagggttaaaggggttattttaaccccgacccatcttggttttggcctggaaaatgcccctgggggggggcttttttgaaggaatttgaaaaaccgggcgtttcaggggaaaggggggtcccccccccctccc

SEQ ID NO: 25017 - protein, 110 aa, Zea mays
  misc_feature: Ceres CLONE 1396430-F
  misc_feature: SWISSPROT Homolog: EC 2.7.11.1 Non-specific serine/threonine protein kinase
MAGPAPDRARLTVGPGMDMPIMHDSDRYELVRDIGSGNFGVARLMRDRRNSELVAVKYIERGEKINENGQRGIFTPRSWEPPYHFRVKGVILTPTHLGFGLENAPGGGLF

SEQ ID NO: 25018 - DNA, 686 bp, Zea mays
  misc_feature: Ceres CLONE 1396431-F
  misc_feature: Translation starting site: 155
  misc_feature (312)..(312): n is a, c, t, g, unknown, or other
  misc_feature (324)..(324): n is a, c, t, g, unknown, or other
  misc_feature (336)..(336): n is a, c, t, g, unknown, or other
  misc_feature (339)..(339): n is a, c, t, g, unknown, or other
  misc_feature (436)..(436): n is a, c, t, g, unknown, or other
  misc_feature (447)..(447): n is a, c, t, g, unknown, or other
  misc_feature (477)..(477): n is a, c, t, g, unknown, or other
  misc_feature (527)..(527): n is a, c, t, g, unknown, or other
  misc_feature (545)..(545): n is a, c, t, g, unknown, or other
  misc_feature (552)..(552): n is a, c, t, g, unknown, or other
  misc_feature (587)..(587): n is a, c, t, g, unknown, or other
  misc_feature (588)..(588): n is a, c, t, g, unknown, or other
  misc_feature (593)..(593): n is a, c, t, g, unknown, or other
  misc_feature (595)..(595): n is a, c, t, g, unknown, or other
  misc_feature (630)..(630): n is a, c, t, g, unknown, or other
  misc_feature (662)..(662): n is a, c, t, g, unknown, or other
  misc_feature (663)..(663): n is a, c, t, g, unknown, or other
  misc_feature (669)..(669): n is a, c, t, g, unknown, or other
aaagctggagctccccgcggtggcggccgctctagaactagtggatcccccgggctgcaggaattcgcacgagaccattacctagaacatcctaatcgaaaaagtttgttcaactacatacgcaaatcggaatcgaaaccctatctcggatccgatggctcgttcgccgccgccttcttcgtcggccggcggcgcgcagtacgcgcagcagttcctcaacacggcgctctccccagcggggccgtccgcgctgccgtacgccgaggacgtcaagtggctcatccgcaaccacctggtggcgctggccgaggncttcccctcccntcatccccaggncgncctcttcacccacaacgacggccgcgccgctcacctcctccaggccgacggcaccatcccccatccaccacgccggtggctcctacaacctccccgncgtcatctggntgcccgagccctacccgcgctccccgccgntcgtcttccctctcgcgacccgagacatggtcatcaagccccaccaccgncttgtcgacagctccggnctcgtcngcaacgcgccctacctcccgctctgggtcttcccnntctcnanctcgtcggactcgtccgatccctctcggcactatncgggctcgacccgcccctcttcacaggaaccnntctggncgcgctcaggctccgca

SEQ ID NO: 25019 - DNA, 679 bp, Zea mays
  misc_feature: Ceres CLONE 1396435-F
aagctggagctccccgcggtggcggccgctctagaactagtggatcccccgggctgcaggaattcgcacgagaccattacctagaacatcctaatcgaaaaagagagagagcaccaaaccgcaccgaaaagtcaacacccccggcccgcgcgccggcgtcctcctatgctcgccgtcgccggtgacgggaagggccgccgacgctcagtcctgccgaaggaacgctcatccggccgtcttatccgcctcctcgccgcgctccgcccctcccgagccgggcccctccccgtccagaccggctttcccacctctctcgccgacctcggcgtcaagaaccatggtcgcctcaagaagcttccctccccgtcctccaagcgcggcgccgccgcttcgcattcgccttcgactttgccttcgcatccacccccacctcgccatcgctgttcccgccggctgagtctccgcctccaccgacgacagacgacgcagtctcacctgtcgatcggaccagagccgaccttccagcggaacagcccccacgcggcagtaaggcagtggctatggcctgggctgggcctggggctgggcttcctgacggcagcgaagtgtagcgtccctcgaacgtctcgtgatctgtacctagtaggtagcgtcgataccgtgacctcttctactctac

SEQ ID NO: 25020 - DNA, 633 bp, Zea mays
  misc_feature: Ceres CLONE 1396438-F
  misc_feature (171)..(171): n is a, c, t, g, unknown, or other
  misc_feature (257)..(257): n is a, c, t, g, unknown, or other
  misc_feature (282)..(282): n is a, c, t, g, unknown, or other
  misc_feature (291)..(291): n is a, c, t, g, unknown, or other
  misc_feature (295)..(295): n is a, c, t, g, unknown, or other
  misc_feature (296)..(296): n is a, c, t, g, unknown, or other
  misc_feature (360)..(360): n is a, c, t, g, unknown, or other
tggagctccccgcggtggcggccgctctagaactagtggatcccccgggctgcaggaattcgcacgagaccattacctagaacatcctaatcgaaaaaaactcacagcacaaacgttcctctcctcttccatcgtcgtcctcgctcccggccccgcctgtctagtctagtnccctcttctcgcgtgcaacccctgtactgtacgtgctaggcacacagctagctgcagctacagcagggcagcaaatggtttctggntgcggtcatggtgggtacggcggcngcgacgacngggnnaggcgtccactttccgggaaacccggcggaaaaatcaaggaccggaagctggttgggcccccgncttgatccgggaacccgaatttgcggaaccctctgggcccaaagggaattccccaagaaccgggggaaccaccccccgccccgttaaacccttttaaagccccaaaaaaaaaggggggtggaaaaataaagggggaaaaaaaaccttttcccccaccccaaagggggtttcccccaaagccaaaaaacccttttatgtgaggaaaatagaaaacccccgaaaaagggggggggaaaaacccctcttttggggggaggggggggcgccctcctc

SEQ ID NO: 25021 - DNA, 697 bp, Zea mays
  misc_feature: Ceres CLONE 1396440-F
  misc_feature: Encodes the peptide sequence at SEQ ID NO. 25022
  misc_feature (697)..(697): n is a, c, t, g, unknown, or other
tagagctggagctccccgcggtggcggccgctctacctctcagcatcccccgggctgcaggaatttttcacgagaccattacctagaacatcctaatcgaaaagaaacaaggccacaccaccagtctgaccgccgaacggaacgagcccggcgggtggaagggagagagcgcgccagagcggtgccgaacaaccctcgtccaccgcactctcctggaccgtggccatggccatggtcgccgcgtcccgatcccgggcgctgtgggcgtcccgcgccgccgcctacctcaggatctccaccttccccagggccttctccaccgtgctgaaggatctgaaatatgctgacactcatgaatgggtgaatgttgaggtcgattcagcaaccgtgtggattactgaccatgcccaggatcatctgggtgatgttgtctacgtgcagctgccagaagttggagtcagtgtatcccagggaaagaacttcggagctgtcgatagcgtgaaggctaccagtgatatcaattcaccagtgtccggagaggtggttgaggtgaaccggaagctaagcgaggagcctgggttgctgaacgcaagcccgtacgagagtgagtggattatcaaggtcaagctcagcgattcaggcgagctcagttcgctcatggatggtgaccagtactcgcaattctgcgaggaacaan

SEQ ID NO: 25022 - protein, 157 aa, Zea mays
  misc_feature: Ceres CLONE 1396440-F
  misc_feature (37)..(157): Pfam Name: GCV_H Pfam Description: Glycine cleavage H-protein
MAMVAASRSRALWASRAAAYLRISTFPRAFSTVLKDLKYADTHEWVNVEVDSATVWITDHAQDHLGDVVYVQLPEVGVSVSQGKNFGAVDSVKATSDINSPVSGEVVEVNRKLSEEPGLLNASPYESEWIIKVKLSDSGELSSLMDGDQYSQFCEEQ

SEQ ID NO: 25023 - DNA, 677 bp, Zea mays
  misc_feature: Ceres CLONE 1396442-F
  misc_feature: Encodes the peptide sequence at SEQ ID NO. 25024
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
aaagctggagctccccgcggtggcggccgctctagaactagtggatcccccgggctgcaggaattcgcacgagaccattacctagaacatcctaatcgaaaaattccccgtttgccttgtttaccattcctccccaaaacacatcctgcgatcctcgaagcctccgccgagcatcgatcatgtcggcctactgcggcaagtacgcggatgagctcatcaagaatgctgcctacatcggcacccctggcaagggtatccttgctgctgatgagtcaactggcaccattggcaagcgcctttccagcatcaatgtcgagaacgtggaggagaaccggggggctctccgtgagctcctgttctggtgccctggggccctccagtacatcagcgggggtgatcctcttcgaggagaccctctaccagaaagacaagggatggcaagccttttgccgatggccctcaaggaggaaggcgccctccccggcatcaagggccacaaagggccccattggagggttgttggccccccaccaaggaaaccccccccccaggggccccgaatgccctcgggaaagnnngtggtgtggtctaaaaaaataaaaaggcgcggggcccccctttttcccaaagggggggggggggttttccccaaaaaatgggccccccaaaaagacgcc

SEQ ID NO: 25024 - protein, 166 aa, Zea mays
  misc_feature: Ceres CLONE 1396442-F
  misc_feature (11)..(162): Pfam Name: Glycolytic Pfam Description: Fructose-bisphosphate aldolase class-I
  misc_feature: SWISSPROT Homolog: EC 4.1.2.13 Fructose-bisphosphate aldolase
  misc_feature (133)..(133): Xaa is any aa, unknown, or other
MSAYCGKYADELIKNAAYIGTPGKGILAADESTGTIGKRLSSINVENVEENRGALRELLFWCPGALQYISGGDPLRGDPLPERQGMASLLPMALKEEGALPGIKGHKGPHWRVVGPPPRKPPPQGPRMPSGKXVVWSKKIKRRGAPLFPKGGGGVFPKKWAPQKDA

SEQ ID NO: 25025 - DNA, 638 bp, Zea mays
  misc_feature: Ceres CLONE 1396444-F
  misc_feature: Encodes the peptide sequence at SEQ ID NO. 25026
  misc_feature (168)..(168): n is a, c, t, g, unknown, or other
  misc_feature (414)..(414): n is a, c, t, g, unknown, or other
  misc_feature (418)..(418): n is a, c, t, g, unknown, or other
gctctagaactagtggatcccccgggctgcaggaattcgcacgagaccattacctaaacatcctaatcgaaaaaccaacccttgtagtctcagtcaatctgtagattgagactacgatgagcctgtcaccgctcgactcctcctccccgccggccgcggctgcggctngctgctacggaggtgcccctcgccccgggcttccgcttccaccccaccgacgaggagctcgtctcctactacctccgccgccgcgtcctcggccgccgcctccgcgtcgacgccatcgccgagatcgacctctaccgcctcgagccctgggacctcccctccctctcccgcatccgcagccgcgacgcccagtggtacttcttcgcccgtctcgaccgcaaggtcgccggcgctggcgccgggggnccgnggcggtcccggcaacaggaccaaccgcgctacgccgaagggggtactgggaagacacgggcaaggaccgcgaggtgcaccaccgcggcaaggccggtcgggatgaagaaaacgctcgtcttccacgccgggagggcgcctaaagggcgaaaggaccacttgggtcatggacgagtaccggcttcctcgatggaaacggaccctcagggactggatggggc

SEQ ID NO: 25026 - protein, 39 aa, Zea mays
  misc_feature: Ceres CLONE 1396444-F
MKKTLVFHAGRAPKGRKDHLGHGRVPASSMETDPQGLDG

SEQ ID NO: 25027 - DNA, 731 bp, Zea mays
  misc_feature: Ceres CLONE 1396446-F
  misc_feature: Translation starting site: 198
  misc_feature (718)..(718): n is a, c, t, g, unknown, or other
aaaaactggagctccccgcggtggcggccgctctagaactagtggatcccccgggctgcaggaattcgcacgagaccattacctaagaacatcctaatcgaaaacctcaggcctcgctcagatctctccgcccgggtccatcttcccacccccaaaccttctcccgcctctctcgtcaacgccgcccgacgagagggatggcggccttgcgggctccggccgcaacgctcctcgtcctcctcgccctagcggcggccggcggcgtggcggccgacggctccgatcaccggtacaagattcgcgagcccgtcccgctctacgccaacaaggtcggcccattttcacaattcccagtgaaacattttcgatatttcgacctgcctttctgctcttcctgacaaagtgaaggagaagagcgaggccctttggggaagttcttcaatggggattcggttaagttgattgcgccttacaagcttgattttccgtgacgaagttgagtccaaggcagttttgcttcaaaaagcttaacttacagaagatgtagtgaagttccggaatgcagtggctaaggacttctacttccaaatgtactattgatgatctcccactgtggggcttcattcggtaaagttgagaagggcggcaaggatgatccgagcgagtggaaatactttctgtacaggcacattcatcttcgacatcctatacaaaacgnaccgggtgatcga

SEQ ID NO: 25028 - DNA, 635 bp, Zea mays
  misc_feature: Ceres CLONE 1396446-R
caattgggtaccgggccccccctcgaggtcgacggtatcgataagcttttttttttttttttttcgcctctatcagctctcacatgcttattggttattattgcccactgtcacaaaagatgaactaaagttgagaacggatacaaaacatccaccgagaagtgaaacagagaaacagttcaaagggggagccaaattgcattacggaacagaaaagaccacaggctgcatcacgcgtgcgagctacgcaagatcccgtggaagtagcctccgaccataaccagggatacaagggacacgacgccggcagggaataccttcccggacttcttgaagcgcgaccccatcactgacagtagcgcggccgatatacctaaaccgatcgatgatgcgaggacaggtctcactgggagttgagtgtggacgacgtacaggaccagtgctgctgtggcactataagcaatagcaacggtgttcaagaagcaaaatgtcaggaagagaggtccacagaataggcatcctgtcaatagcaagttcctcacccagtttgtcccctccaactgacaatagaaagaggtagcaatgtatccagcaattcctgaagtgagtgcataaatgacaaccaatgcagtaaa

SEQ ID NO: 25029 - DNA, 673 bp, Zea mays
  misc_feature: Ceres CLONE 1396448-F
  misc_feature (385)..(385): n is a, c, t, g, unknown, or other
  misc_feature (481)..(481): n is a, c, t, g, unknown, or other
  misc_feature (486)..(486): n is a, c, t, g, unknown, or other
  misc_feature (487)..(487): n is a, c, t, g, unknown, or other
  misc_feature (673)..(673): n is a, c, t, g, unknown, or other
tccccgcggtggcggccgctctagaactagtggatcccccgggctgcaggaattcgcacgagaccattacctagaacatcctaatcgaaaaatcctctcttcatactatctaccacaactagttgccagagttcgtcatggacttctacaaagagttcgtggagacttcgtccgatgacgattccgaagactgaggtcgacactcgacaccatgtacgtttagcaagcccttgagcaactaggtgttggaggttcgagcgggcgtcgtagacgctcttccttgccacgtctagtaatccatagggatcacagtgctagcgaaaatctgataaagctccactacttcggtccaaatcctgtctatcccgcccactttttccaacgnaaggtttcggatgcagcggcctttgttcctgcgaatcccttagaggtgtgcagcaagtggacagatttttttactgttaggtgtgattgctagggntttanncggggctcggtccggttgcaaaaagtctctgcctgcttttgcgtgtcctcggcatatgggttgcctaacgatggctggccgatgagtacattcaaatcggacaaactaccggctagggactgtctcctttcgtttctgcactgcaatcatctcatggttacagcaagggttaccttccgtattccn

SEQ ID NO: 25030 - DNA, 735 bp, Zea mays
  misc_feature: Ceres CLONE 1396450-F
  misc_feature (192)..(192): n is a, c, t, g, unknown, or other
  misc_feature (304)..(304): n is a, c, t, g, unknown, or other
  misc_feature (325)..(325): n is a, c, t, g, unknown, or other
  misc_feature (326)..(326): n is a, c, t, g, unknown, or other
  misc_feature (341)..(341): n is a, c, t, g, unknown, or other
  misc_feature (374)..(374): n is a, c, t, g, unknown, or other
cagagctggagctccccgcggtggcggccgctctagaactagtggatcccccgggctgcaggaattcgcacgagaccattacctagaacttcctaatcgaaaaatgatccaatagccgccgccttgtggttgtgtcatatatgggggccgaccagtggccgtggccgtggccgtgggcgacgccgccgccgnccggccctgctgcttctggcctcactactgccggcgctgctgctcgcgctgtggcgcctggtgtggcaaccgcgggccgtggcgcggtcgttcgcgaggcagggcatccggnggccgccctactgtttcctgnncggatccttgtcggnagcgaagcggctggcgcgtgccagccggagaangggttccgcagctggacgtcgcttcacatgacatcatgcccatctttgctgcaccgttccaccgatgggtcgtccaatattggaggaattcctggactggatcgggccaacactgcaatctttctccgtgatttaaagtgattaaggaaggctccccaaaagggacggcccgttttggaaggaatttaggaaccccgttttaaaagcccttgtgggcaacgggccttttttttaaaaacgggccccctttgaaaacgcccccgaaaatttcccctttccccctttcccaccgaaggaaaaaaaaatttttgggggggggcgggggactcttccaaacaagtgcccccttgggtggcaaact

SEQ ID NO: 25031 - DNA, 693 bp, Zea mays
  misc_feature: Ceres CLONE 1396456-F
  misc_feature: Encodes the peptide sequence at SEQ ID NO. 25032
  misc_feature (41)..(41): n is a, c, t, g, unknown, or other
  misc_feature (693)..(693): n is a, c, t, g, unknown, or other
tccccgcggtggcggccgctctagaactagtggatcccccngggctgcaggaattcgcacgagaccattacctagaacatcctaatcgaaaactctaccccttcctctcccggcgaccagctggcctctcctttgttgaggcgagagacccccacccgatccggcgatggacgccgcgtccaggccgcctccgccccacggaacaggggtccgcgtccgcgccccgctggtggagtctgtctcctgctactgcagattagatacaggccttaaaactgttgttgaggcccaggaagtttgttcctgccgcgaatatgtgcatggcaacctgaagtcaaacaaaacaagcgcaagtccaggcgctcaaaaaaaggaaaggtgcagggactcaagcacccacttttacctggccttccttgatggatcttggtattggctgccttaaaacgagttccctcgactggaaaaggccaaaatttcggggtgggttgggaaaaaaggggacccgtcttttgggcgggggaaaataatttttaccccctggggaaaaaaaaaaggggagggggcaaaaaaaaagggtatatagttcttttaaagggggacgggggaaggggaaaaaaaccccggggaaggccctttagaccccccccccgcgtttttgggaaggcccctcccccccactttcccaaaaan

SEQ ID NO: 25032 - protein, 92 aa, Zea mays
  misc_feature: Ceres CLONE 1396456-F
MDAASRPPPPHGTGVRVRAPLVESVSCYCRLDTGLKTVVEAQEVCSCREYVHGNLKSNKTSASPGAQKKERCRDSSTHFYLAFLDGSWYWLP

SEQ ID NO: 25033 - DNA, 696 bp, Zea mays
  misc_feature: Ceres CLONE 1396458-F
  misc_feature (439)..(439): n is a, c, t, g, unknown, or other
acaagctggagctccccgcggtggcggccgctctagaactagtggatcccccgggctgcaggaattcgcacgagaccattacctagaacatcctaatccaaaaacaccaacccgttctgcctccgcttcgatcatggggtggtcgcgctttcgtcgccgccatcaacggtgtcgctatctcctccctatccggcgtccgcgatgctcgccacccctcctcccccacgcgtcggacgctcgccatgctcgcctccctcccctccggtccgcctcgctccccttccgcccttccgtcgcgtgcgcttggaaaaaggtccagcagccccaaactccccagcggggccatctcgcccacctctccctgcacgccggatccccgccgtccccaccatcgcctggtgtgggtccgaccccagtcgctcatgcctcgacgcgcagntctcgcacaccgtccgcggacgggttcgcctcggggcggtctcgacaccggtccgcaggggatccaatcacggctctcaccctcggtggctccttccaatccctttccattgaatcgggattccgggcccacagggataccgggagctcgcccccgcctcatgggtcttcctccgtcgggatccccccgggccgtggaagggggcccggatcttaacgggtccggttgataacctccgggtgaccgggaaggccccc

SEQ ID NO: 25034 - DNA, 426 bp, Zea mays
  misc_feature: Ceres CLONE 1396460-F
  misc_feature: Encodes the peptide sequence at SEQ ID NO. 25035
  misc_feature (52)..(52): n is a, c, t, g, unknown, or other
  misc_feature (243)..(243): n is a, c, t, g, unknown, or other
  misc_feature (263)..(263): n is a, c, t, g, unknown, or other
aaagctggagctccccgcggtggcggccgctctagaactagtggatcccccngggctgcaggaattcgcacgaaccattacctagaacatcctaatcgaaaaaatcagtgctcgctagcccaccacgccctgaacctagcccggacaccagccagaacaggccatgtccatgggctccccggtgcagctcaggcggctgagcctctgtacagttcgtggtgacaacatcctggccatcgtggncgtgccgctcgccaccgcgntcctgctcaaggcgtcgtcgctcgggcccgaggagatctggcgctccgggcgggaactggtccttgccgggtcctggctgccggggcacggggtgtacttatggttccgccccccccggggaactgggggaaaaccggggtttccgaccaagcccaattgggg

SEQ ID NO: 25035 - protein, 87 aa, Zea mays
  misc_feature: Ceres CLONE 1396460-F
  misc_feature (27)..(27): Xaa is any aa, unknown, or other
  misc_feature (34)..(34): Xaa is any aa, unknown, or other
MSMGSPVQLRRLSLCTVRGDNILAIVXVPLATAXLLKASSLGPEEIWRSGRELVLAGSWLPGHGVYLWFRPPRGTGGKPGFPTKPNW

SEQ ID NO: 25036 - DNA, 645 bp, Zea mays
  misc_feature: Ceres CLONE 1396463-F
  misc_feature (606)..(606): n is a, c, t, g, unknown, or other
ggagctccccgcggtggcggccgctctagaactagtggatcccccgggctgcaggaattcgcacgagaccattacctagaacatcctaatcaaaaagatctacctgtctgttcttcgatcgagtctgagagatttgggaggagtagggaaacaaagcgaaaagagcccatcttttttgtctttttggttcgtttcgtgggtgcttcttttggaccccgcggaggagcccaccgtttctacaaaaaccaatctttgctgcctcctcagcggtcgagatcgataggtttccagactggaggttccgggttctggcctggaaaaacggaggcccaaaatccgagcacgcggttagaagggaaaggacccaaggaaagttcccaatttttctcgggggcaacgggcggataacaaatttctgggaaaggaaaggggtaaggggggggaaggccccccgaaaaaagggaatcctatcccccccgaggggggaatttgaaaaatttggcccggggccggggaaaaccgggggggggggccccccccaaaaaagataaattccccccgccccccccaaaaaggtttctttggggtaaaaaggagggggggggnacatctctcccaaaaaagaaggcccccccccccggcgcg

SEQ ID NO: 25037 - DNA, 687 bp, Zea mays
  misc_feature: Ceres CLONE 1396464-F
  misc_feature: Encodes the peptide sequence at SEQ ID NO. 25038
aagctggagctccccgcggtggcggccgctctagaactagtggatcccccgggctgcaggaattcgcacgagaccattacctagaacatcctaatcaaaaattttccaaatccgtctacgccctcacgcacgcggcccaactagcctaacaaaccctagctagatttagaaaaaaagtttgtccccaatccgaaccgacgaggagctcgccgccgtgagatgtccgagtacgacgagcgctaccagggcaacgccgacatgcccgcagccgaaggcggctatccgcaggccgagtacgccgccgccgccgcgcctgcccgcgggggttcgccgcccgcagacagcaagcccctccggttctccgaccacgccgacggccgctcctcccagcaccagcatgagacacaatcacatgacagtggttcctcgaaatctcgagaaagggaccgagaacgcgataagggcaaggatagggagcgtgacagggatcgtgggccgagaaaaggggagggaccgagacaggggatagggatcgtggaagaagtgacagagacagagatcgcgatcgccaccacagggaaccatcgagagcgcagcgagaaaaggaaacaccgtgatcgttctgatgatcgtgacggccaccgtgatggccgtgaaccgccaccggatgatcgtgatccaaaagaa

SEQ ID NO: 25038 - protein, 156 aa, Zea mays
  misc_feature: Ceres CLONE 1396464-F
MSEYDERYQGNADMPAAEGGYPQAEYAAAAAPARGGSPPADSKPLRFSDHADGRSSQHQHETQSHDSGSSKSRERDRERDKGKDRERDRDRGPRKGEGPRQGIGIVEEVTETEIAIATTGNHRERSEKRKHRDRSDDRDGHRDGREPPPDDRDPKE

SEQ ID NO: 25039 - DNA, 693 bp, Zea mays
  misc_feature: Ceres CLONE 1396468-F
  misc_feature: Encodes the peptide sequence at SEQ ID NO. 25040
  misc_feature (533)..(533): n is a, c, t, g, unknown, or other
  misc_feature (590)..(590): n is a, c, t, g, unknown, or other
  misc_feature (593)..(593): n is a, c, t, g, unknown, or other
  misc_feature (622)..(622): n is a, c, t, g, unknown, or other
  misc_feature (654)..(654): n is a, c, t, g, unknown, or other
  misc_feature (664)..(664): n is a, c, t, g, unknown, or other
aaagctggagctccccgcggtggcggccgctctagaactagtggatcccccgggctgcaggaattcgcacgagaccattacctagaacatcctaatcaaaaacatgccacattgccaccaagccacagttccacctttcgattcatgcacgctcagtcatgggcgccctccggagtttagccatctcctacccggagttcctcgtggccgggctgtgcttcgtctccctctcggccctgcgccacgcgatgcgtgagcggcggcaacgcgcccccctgagctggcctgtggtgggcatgctcccgttcgtgctcgcgaacctcgggcgcctctacgacgccatcaccgacgccctccacgggtccgggtgcacgctcatgttccgcgggccgtggctcgcccgcgcggacttcctgctgacgtgcgacccggcggccgtccagcactgcctggcgtccaaccacgggggctacgacaggggccgagactttgcggagatgttcgacctcctgggcgacgggctgctggttgcngacgccgcgtcgtgggcgcgccagcggcacgtcgcccgcaccgtctttcgcaccccnggngtccggtccttcgtcctgtgcaccatggncgcgcagacggcgcggctgctcgtgccgtccntggactgcgncgcgcggatcaggaaaagggacgtggcgt

SEQ ID NO: 25040 - protein, 178 aa, Zea mays
  misc_feature: Ceres CLONE 1396468-F
  misc_feature (155)..(155): Xaa is any aa, unknown, or other
  misc_feature (166)..(166): Xaa is any aa, unknown, or other
  misc_feature (169)..(169): Xaa is any aa, unknown, or other
MGALRSLAISYPEFLVAGLCFVSLSALRHAMRERRQRAPLSWPVVGMLPFVLANLGRLYDAITDALHGSGCTLMFRGPWLARADFLLTCDPAAVQHCLASNHGGYDRGRDFAEMFDLLGDGLLVADAASWARQRHVARTVFRTPGVRSFVLCTMXAQTARLLVPSXDCXARIRKRDVA

SEQ ID NO: 25041 - DNA, 717 bp, Zea mays
  misc_feature: Ceres CLONE 1396469-F
  misc_feature: Encodes the peptide sequence at SEQ ID NO. 25042
  misc_feature (475)..(475): n is a, c, t, g, unknown, or other
  misc_feature (497)..(497): n is a, c, t, g, unknown, or other
  misc_feature (531)..(531): n is a, c, t, g, unknown, or other
caaagctggagctccccgcggtggcggccgctctagaactagtggatcccccgggctgcaggaattcgcacgagaccattacctagaacatcctaatcgaaaaaccttggtctacaagggttttccgctgtcttatcccttcgtccacgctccctgcagccgccgcccaaaccctagcaacccgtcctccgccatggccgacgaccactactcctctaagaggaagtacgacgacccctcgccgccgccgcggcgcacggggttctcttcgggcccgccgcctgcctcgccgctcgcgggcggcgccccgtcgtacaacagcgtgccaccgccccccgatgagatccagctcgcgaagcagcgcgcgcaggagatcgcggcgcggatctttaacgccgcagaggccaagcgtcctcgcgtcgacaacggcgacgatgacagcggcggcttcggtgtaggcctgggcagcactggntggcggtggccgcatcgggcgncggaggactcggcttctcgtcctctgccggtggntggccacggggcttctatcccacaattatcttctcagagcagcgcacctcagtactcctcttatgggggaaattcgggttcaaggcaaaaagattgaattcaaatgggaggggtgggtgtaatcatgggaaagccggggaaacctattaggtatttccacttccatccggggcaagatttcaggcc

SEQ ID NO: 25042 - protein, 144 aa, Zea mays
  misc_feature: Ceres CLONE 1396469-F
  misc_feature (102)..(102): Xaa is any aa, unknown, or other
  misc_feature (113)..(113): Xaa is any aa, unknown, or other
MADDHYSSKRKYDDPSPPPRRTGFSSGPPPASPLAGGAPSYNSVPPPPDEIQLAKQRAQEIAARIFNAAEAKRPRVDNGDDDSGGFGVGLGSTGWRWPHRAXEDSASRPLPVXGHGASIPQLSSQSSAPQYSSYGGNSGSRQKD

SEQ ID NO: 25043 - DNA, 708 bp, Zea mays
  misc_feature: Ceres CLONE 1396470-F
  misc_feature: Encodes the peptide sequence at SEQ ID NO. 25044
aagagctggagctccccgcggtggcggccgctctagaactagtggatcccccgggctgcaggaattcgcacgagaccattacctagaacatcctaatcgaaaacactcgctttccggcgggcgactggcctaaaatcgcctcttgtttgtttgcttccgtcgtcccctctccacgtagagcacgcccccggaccaccttttataagcaccaaccatctggccttgccgcgccgattcgccacgaagccgcactgtgagagagggacgcggcctgttgtcccggcttttagacgcaacttccatcgctgcgaagctatccattcgtgttcgtcatggccgccagcgtcaccgtggaaaacctcaaccccaaggtcttaaaatgtgagtatgcagtccgtggggagattgtcatccatgctcagcgcctgcagcaacaactacaaacacaaccagggtctcttccttttgatgagatcctctattgcaacattgggaatccccaatctcttggtcagcaacctgtgacattcttcagggaggttcttgctctttgtgatcatccgtgcctcttggaaaaagaggaaaccaaatcattgttcagtgctgatgcaatttctcgagcaaagcagattcttgcaactattcctggaagggcaacaggtgcatatagtcacagtcagggtatcaaaggactgcgtgatgcaattg

SEQ ID NO: 25044 - protein, 125 aa, Zea mays
  misc_feature: Ceres CLONE 1396470-F
  misc_feature: SWISSPROT Homolog: EC 2.6.1.2 Alanine transaminase
MAASVTVENLNPKVLKCEYAVRGEIVIHAQRLQQQLQTQPGSLPFDEILYCNIGNPQSLGQQPVTFFREVLALCDHPCLLEKEETKSLFSADAISRAKQILATIPGRATGAYSHSQGIKGLRDAI

SEQ ID NO: 25045 - DNA, 794 bp, Zea mays
  misc_feature: Ceres CLONE 1396471-F
  misc_feature: Encodes the peptide sequence at SEQ ID NO. 25046
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (19)..(19): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (38)..(38): n is a, c, t, g, unknown, or other
  misc_feature (39)..(39): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (282)..(282): n is a, c, t, g, unknown, or other
ggggnnnnnnnnnnttttnaaaaagtgagggtnnnttnntnnnccaaactggagctccaccgcggtggcggccgctctagaatagtggatcccccgggctgcaggaattcgcacgagaccattacctagaacatcctaatcgaaaaagcacgccccgccccgctcctcttgaccgcctcgctcccacggtcccacccccgacgcgcggtttcctcaggcacccacctcgccgaccgacacatggaccccaccgccgcccccggctccggcggcacccccggngactccgacgccacctccccgaccaacaccaccgtgacgctcccgccgttcaccctcggcgacgtgccgcgcctcgcctcctcgtccccggcggggggggggggggtcccgacccccttctcgggccacccctattttccacccgcccgccaacttctaaatctctccggggggaacgtctccccccggcacggcctttttcgaaccttcgactccgccggggccctcccccgttcggtcccctaccggccggggggggcccccccggggggaaccttcccccgttcgacacgggagccgcggcgcggcgccggcctttcgttaccctggggggggcccccttgcccgggggttccaaacccgggggtggggggaagcttgtcaggcgcggttcacagagaaattataggggctaccagccaactcttttgggggtccccccccgtgtacccgggggctctccaccgcccccaacaaaggatacacgggcaggggtgaccccccgtgcgggg

SEQ ID NO: 25046 - protein, 179 aa, Zea mays
  misc_feature: Ceres CLONE 1396471-F
MDPTAAPGSGGTPGDSDATSPTNTTVTLPPFTLGDVPRLASSSPAGGGGVPTPFSGHPYFPPARQLLNLSGGNVSPRHGLFRTFDSAGALPRSVPYRPGGAPPGGTFPRSTREPRRGAGLSLPWGGPPCPGVPNPGVGGSLSGAVHREIIGATSQLFWGSPPVYPGALHRPQQRIHGQG

SEQ ID NO: 25047 - DNA, 695 bp, Zea mays
  misc_feature: Ceres CLONE 1396472-F
  misc_feature (592)..(592): n is a, c, t, g, unknown, or other
cagagctggagctccccgcggtggcggccgctctagaactagtggatcccccgggctgcaggaattcgcacgagaccattacctagaacatcctaatcgaaaaacttccccatcccgcttgctccgtgccgtggtctccgaggtcggggttcctttccgatttgatccgcccagctggaaaacgaaaatcgctgatgggttttggaaggaaagtcgtcatttcttggtgaggtttccgtttctggatcgactggctgatcgatcgtactagccgccatggcgtcgtcgtgcatcccggccggcggcatccggctgccggacctggagatggtcaaggccgcgccgccgccgccgccgccccgcccggcgcactcagcggcgtcctccacgctctcggaggcgtccaactcgtccccagcctcctcgtcgtcgttggcgtcgctgtcgctcaagcgcccgcgcacgccgcggaagcggcccagccagacgtacaacgaggcggcggcgctgctcgcgtccatgtacccctccgtattccccgtcgccagggggctgggggggccccgaggcggcgccaccccgcctcctcggnctcgcctccgcgcttggcgacgacccgtcctgctccgacctcctccctccgttccccgttcccggaggccacgccgccttcctcctccgcgacctgccgccgc

SEQ ID NO: 25048 - DNA, 630 bp, Zea mays
  misc_feature: Ceres CLONE 1396473-R
cgggccccccctcgaggtcgacggtatcgataagcttttttttttttttttttgccaccaatacactcttgtatttcaagctggggcgagaccacacattctgatgtttgtgctctggtaagccttgaccgcccagaccgccctgaaaggaaagatcccagatttgataattggaatgtctcttgctgcccgttacatctttcacttacaccttcccgccttgttgatctccacctacacacaactctggaatgatacctactccttacgagctacgcgctctgcgggcggggaaatggctcgtggtcgtcctccgcatgtactccaatgtttgctcggacttgttctctgtccggggcaagctcttggtccccatgattggcgccgagtcctgtctcgctcatctgcgcagggaccggcttccagctagagtcctcagtcttcctcctgctctccaccacagactagtatgagtagaggcccgtgccgaacatggcgatgatgatgcccacctcgttgcgcgcggtgaaaggggctctgtagatgatgtggccaaaagatagctccgaacgcgtcttgaggtggcccagcagcttggtacgtcacgatgaacttcgtgacgatctcctg

SEQ ID NO: 25049 - DNA, 706 bp, Zea mays
  misc_feature: Ceres CLONE 1396473-F
  misc_feature: Encodes the peptide sequence at SEQ ID NO. 25050
  misc_feature (624)..(624): n is a, c, t, g, unknown, or other
aaaagctggagctccccgcggtggcggccgctctagaactagtggatcccccgggctgcaggaattcgcacgagaccattaacttaaaacttcctaatcgaaaacattaaattgacaaatactcactgacatgcaattacgacaaccaggagctcccccccttcctcggatgccgaccgagtcgaggaacagcttgtctgcctctcccgctatccttcccctcctctccagaacatctgatacatcatcgaggactccccgtcaacaatcaaggatatatagatgatatacaaacaacaggttcctccagagcccagaggaggtaatgcaccgggcgtccgcgctcaagagatgtttcaaggagcgctctcccggatgtacggccctggcgcactgcgcctctcggacacctcgatttaggtcatcgacatctgatacaaggacctcatcagcactctcggcttcttctttgcgactactcttatgatgctggacctgaaggagagcttcttgacgatgtactgtgcgcagctgctgtgcttcatcaagtcaaggacgatagacgagcgtagcggcatcatcttctgactgttcaacggtatctcctttgtcctcctcaacatntagcctcgggtgcagctctgttggcttcaacggaatgacaagttggccgtcaacacgtcaccatatgcgttggaaccctctt

SEQ ID NO: 25050 - protein, 34 aa, Zea mays
  misc_feature: Ceres CLONE 1396473-F
MMLDLKESFLTMYCAQLLCFIKSRTIDERSGIIF

SEQ ID NO: 25051 - DNA, 715 bp, Zea mays
  misc_feature: Ceres CLONE 1396481-F
  misc_feature: Encodes the peptide sequence at SEQ ID NO. 25052
aaagctggagctccccgcggtggcggccgctctagaactagtggatcccccgggctgcaggaattcgcacgagaccattacctagaacatcctaatcgaaaacctttcgggcagaaagagccagagagagagagagagagaggtcggggctggggagcacacacccatcacccatggcctgactgacctccggactctccctgcttccgtcgccgccgcgggccgcccagctgactgctcctgccctccgcccgccctccatggcgtccgtcaagctcggctccaagcctgacgccttcaagcggcaaggccaggcatggttctgcacaacaggacttcctagcgatgtcaccgttgaggttggggatatgtctttccaccttcacaagttccctttactttcaaaaagtgcctttcttgaacggtcaattgaagaaaattctgaccaagaagaatgcatcatcaaactaaatgacattcctgggggtgccaagtcatttgagctagttgcaaggttctgctatggtgtgaaaatagagctttcacctgcaaatgttgtctacctacggtgtgcctcagagcatctagaaatgactgaagaagtagctgaggaaaacctgattgcacagtcagaaatgttcctcaaccaagtggttctccgtaactggaaagattccttggcagcattggaaacatgtgatgacctactccccca

SEQ ID NO: 25052 - protein, 151 aa, Zea mays
  misc_feature: Ceres CLONE 1396481-F
  misc_feature (23)..(124): Pfam Name: BTB Pfam Description: BTB/POZ domain
MASVKLGSKPDAFKRQGQAWFCTTGLPSDVTVEVGDMSFHLHKFPLLSKSAFLERSIEENSDQEECIIKLNDIPGGAKSFELVARFCYGVKIELSPANVVYLRCASEHLEMTEEVAEENLIAQSEMFLNQVVLRNWKDSLAALETCDDLLP

SEQ ID NO: 25053 - DNA, 658 bp, Zea mays
  misc_feature: Ceres CLONE 1396482-F
  misc_feature: Encodes the peptide sequence at SEQ ID NO. 25054
  misc_feature (457)..(457): n is a, c, t, g, unknown, or other
tccccgcggtggcggccgctctagaactagtggatcccccgggctgcaggaattcgcacgagaccattacctagaacatcctaatcaaaaaaacatcgattttcctccggaatcgtaacctcagaaagccaaatctcattctccggcgctcaggcccacccaagcgtcgactctcccgatccaatcggtacctcctagttcctcgccggcggtagcggcgtcgggcgaacagcggtgacttggcgagggcgcttggccggcgacaatcatccactaggatggaaggtgaggcagagaccgtggttggttcttgttctaaaccatgtgggcctctgggagactactacattccagattacattctgaagccaggtgcccaacaagtacttgttgatcatgcggcaccctgcccccgttgtagtgttcatcaactcaagatctggaggccaactttggnaagtagtttaatcaaaacatatcgtgagcttctcatgaaagcaagggttttttgatctctcaaagaggctcagagataggtatttgcatcgttatatgcccacttgaaaggctgaaaatggaagagaacattctgcagtcaaaattggaggacctgaaggttattgttggagggcggggatggaacagtagtggtttgttt

SEQ ID NO: 25054 - protein, 77 aa, Zea mays
  misc_feature: Ceres CLONE 1396482-F
  misc_feature (60)..(60): Xaa is any aa, unknown, or other
MEGEAETVVGSCSKPCGPLGDYYIPDYILKPGAQQVLVDHAAPCPRCSVHQLKIWRPTLXSSLIKTYRELLMKARVF

SEQ ID NO: 25055 - DNA, 670 bp, Zea mays
  misc_feature: Ceres CLONE 1396483-F
  misc_feature: SWISSPROT Homolog: EC 2.4.1.195 N-hydroxythioamide S-beta-glucosyltransferase
  misc_feature (593)..(593): n is a, c, t, g, unknown, or other
aagctggagctccccgcggtggcggccgctctagaactagtggatcccccgggctgcaggaattcgcacgagaccattacctaacatcctaatcgaaaaatccatcaaagtcacagagacgaccagctgaagcgaacacagagctgctcgccgtgtaacgcagcaggcagcagcacccagaggcggcaggtcacacacacagcacacgcagatcttcgatcaccaccatgggttctctcggcagcgccgcgcagcagcagcagcaaccgcacgccgtgtgcctgccgtacccagcgcagggccacatcaccccgatgctcaacgtggcgaagctgctgcacgcccggggcttccacgtcaccttcgtcaacaccgagtacaaccaggcgcgcctcgtccggacccgcgggggcggcggccgtggccggccctcccgggcttccgcttcgcaccatccccgacggcctgccgccgtcggaggacgacgacgtcacgcaggacatcccctcgctgtgcaagtccaccacggagacctgcctcgatcccttccgccgcctgctcgcgggactcagcgacccgcccgtcacctgcgncgtctccggacggcgtcatgggcttctccatcgacgccacaagggagttcggccttccctacgtccagttctggacc

SEQ ID NO: 25056 - DNA, 688 bp, Zea mays
  misc_feature: Ceres CLONE 1396488-F
  misc_feature: Encodes the peptide sequence at SEQ ID NO. 25057
  misc_feature (571)..(571): n is a, c, t, g, unknown, or other
caaagctggagctccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagaagagagcgagatggatgtgaacgacgtgctgctagtggtgctggcggcggcgctggctgccatgtggtggcgtcggtgctccaagaccggcggtgtcgacggcctcccgccggggcctccgggttggccggtggtggggaacctgttccaggtgatcctgcagcgacggcccttcatgtacgtggtgcgcgacctccgggagaagtacgggcccatcttcaccatgcggatggggcagcgcaccctcatcgtggtcacctcggcggagctcatccacgaggcgctgggtgaaagcaggccccatgttcgcgagccggcccgaagacagcctcaccgcctcctcttcagngtcggcaagtgcacccgtcactcggcgtctacggcccccctgtggctgctctgcgcgcacttcgtcgccgagatcgtgtccccgcacgcgtcaggcttctctggaattcggaattgg

SEQ ID NO: 25057 - protein, 152 aa, Zea mays
  misc_feature: Ceres CLONE 1396488-F
  misc_feature: SWISSPROT Homolog: EC 1.14.13.11 Trans-cinnamate 4-monooxygenase
  misc_feature (113)..(113): Xaa is any aa, unknown, or other
MDVNDVLLVVLAAALAAMWWRRCSKTGGVDGLPPGPPGWPVVGNLFQVILQRRPFMYVVRDLREKYGPIFTMRMGQRTLIVVTSAELIHEALGESRPHVREPARRQPHRLLFXVGKCTRHSASTAPLWLLCAHFVAEIVSPHASGFSGIRNW

SEQ ID NO: 25058 - DNA, 679 bp, Zea mays
  misc_feature: Ceres CLONE 1396489-F
  misc_feature: Encodes the peptide sequence at SEQ ID NO. 25059
  misc_feature (521)..(521): n is a, c, t, g, unknown, or other
  misc_feature (522)..(522): n is a, c, t, g, unknown, or other
  misc_feature (543)..(543): n is a, c, t, g, unknown, or other
  misc_feature (679)..(679): n is a, c, t, g, unknown, or other
tccccgcggtggcggccgctctagaactagtggatcccccgggctgcaggaattcgcacgagaccattacctagaacatcctaatcaaaaaaacaatccagttctcctttcgccggaatctgtccctcctccccctcctccccgcctctgcgggtactggaccaccgtggagcgggcattcatccaggctaggtccattccttcctttgctcgtaagtgaccctgatttttgctctacgagtttgtttcgtgctccattgaatctaaatcccactccgcatttgcggattcatgccctactactattacaacccctttcatccatccattcctcgactaggttctcttctccatcgcggaagctccacccgagttgacgccagaagagaatcggtgccctagggtgttctcgcagaattattttccagaagatttgcagatcgagtcgaaccctatgccccacgttaagcctgccgccggcctgcccccttaccaccaccgggcgctccctggccccgggnnagggtccagttcccacggggnacatgggatgaggcccccgggaagggccgggaatcagaaacgggccgcttgggggcccgagatgacccttaccccccggtggggggacgggggccccgcttccgtttcccctaacaaattgggtgcctccgctgcn

SEQ ID NO: 25059 - protein, 75 aa, Zea mays
  misc_feature: Ceres CLONE 1396489-F
  misc_feature (23)..(23): Xaa is any aa, unknown, or other
  misc_feature (30)..(30): Xaa is any aa, unknown, or other
MPHVKPAAGLPPYHHRALPGPGXGSSSHGXHGMRPPGRAGNQKRAAWGPEMTLTPRWGDGGPASVSPNKLGASAA

SEQ ID NO: 25060 - DNA, 642 bp, Zea mays
  misc_feature: Ceres CLONE 1396494-F
  misc_feature: Encodes the peptide sequence at SEQ ID NO. 25061
  misc_feature (589)..(589): n is a, c, t, g, unknown, or other
  misc_feature (620)..(620): n is a, c, t, g, unknown, or other
ggagctccccgcggtggcggccgctctagaactagtggatcccccgggctgcaggaattcgcacgagaccattacctagaacatcctaatcgaaaagtttcttggatagtccgtagccgcttgccctgttcgcatcttcgcgcgtggcgcacaccgctccagctctccttcgacgggcacggccgagccgccttcgtcttggccgcagcggtgcgcgctctccatggcgtcctaattagcctagccgcaacgccgcgcccgtgcctgcggcatggatgaaccccttcttggcaatggtcttaagaccagcgggaaaagagagagcctggtagtggccgaggtcagaaaacagatgtaccttgctgggccactcatcgctgcatggatcctacagaacattgtccagatgatatctatcatggtttgtcggtcacccttggtgagcttgccctctccagtgcctccatcgccacctcccttttgcaggcgttactggcttcagcttattggtctggcatggcgagcagcttggacacactgtgtgggcaatcgttcgggggcaaagcagtactatcttcttggcatctancagcagagggcaatccttgtgctcctctagncaagcccttgtggttggcgata

SEQ ID NO: 25061 - protein, 115 aa, Zea mays
  misc_feature: Ceres CLONE 1396494-F
  misc_feature (106)..(106): Xaa is any aa, unknown, or other
MDEPLLGNGLKTSGKRESLVVAEVRKQMYLAGPLIAAWILQNIVQMISIMVCRSPLVSLPSPVPPSPPPFCRRYWLQLIGLAWRAAWTHCVGNRSGAKQYYLLGIXQQRAILVLL

SEQ ID NO: 25062 - DNA, 718 bp, Zea mays
  misc_feature: Ceres CLONE 1396495-F
  misc_feature: Encodes the peptide sequence at SEQ ID NO. 25063
  misc_feature (416)..(416): n is a, c, t, g, unknown, or other
  misc_feature (505)..(505): n is a, c, t, g, unknown, or other
  misc_feature (582)..(582): n is a, c, t, g, unknown, or other
aagagctggagctcaccgcggtggcggccgctctagaactagtggatcccccgggctgcaggaattcgcacgagaccattacctagaacatcctaatcgaaaaattttcgactttcgagcgcagaaacgagagggccggagcagccgcagtcccggcgatcccgccgccggtcgccctcatacttcctcgtcactgccttcgtttctctttccaacaatcaagatgagccgtggcggtagcgcgggtggtggtcaaagttctctgggttacctctttggaagcggtgagccccccaaaccagcagtggcaccagctgtaagtgctccacctgctgctgcaggtgctccacctgctgagaaaccacctgctgcaaagcctgatggcaccagtcagattgcttgctggggttaccagncaaaccaataactaccacagggcccgacggtcagaacaccggaactttcttacggaccgtcctttcgacaaggtcacgcttgctctggncgtggctctttccctgggatacttgtttggtgggaactgatgccgttcaccaattatcaccccccactggtccccanggttttttcttgatcgggaaacagcctttgcattttagtgggaccccaacctcccgtcccgggggggccccaaaattggccccaaattttaggggaaaacggggggcctgacccctacaaaaaaggtcttttaacc

SEQ ID NO: 25063 - protein, 67 aa, Zea mays
  misc_feature: Ceres CLONE 1396495-F
  misc_feature (65)..(65): Xaa is any aa, unknown, or other
MSRGGSAGGGQSSLGYLFGSGEPPKPAVAPAVSAPPAAAGAPPAEKPPAAKPDGTSQIACWGYQXNQ

SEQ ID NO: 25064 - DNA, 640 bp, Zea mays
  misc_feature: Ceres CLONE 1396496-F
  misc_feature: Encodes the peptide sequence at SEQ ID NO. 25065
gctcttgaactagtggatcccccgggctgcaggaattcgcacgagaccattacctagaacatcctaatcgaaaactaacctaaccagctgcatctcctctctctcctaactcctaagctctcagccgtcgccgtcgccgtcgccgtcgctctcctctctgtccctctccacgccgctctcctctctcctccgagccgcagctccctctccccagcgcgccgccactgtaccggcatctgggccaattcgccccactaggagggaaacaaactgctgcacagcttcccggggactggatctccattggcccacagcacccagtggctctggtactccgtgtacgcaaccttcttccattaagaatgggtcatcatggcgtgggagctcatttgagtcccgggcaacttggatccttctctcaagactcttcagttgatgtggtggccgccaagattgatcccaagttagccaaatacctctcattaggcaggtaaggccggtggtgcccttgggagatcctgaggatgtaaaagcgggtacgtcgacgtactggatggggtgggaaaacctgagttatcaataatcctatggggttcccactggggcctgaaacttggaacaaacggttctctggagatca

SEQ ID NO: 25065 - protein, 43 aa, Zea mays
  misc_feature: Ceres CLONE 1396496-F
MGHHGVGAHLSPGQLGSFSQDSSVDVVAAKIDPKLAKYLSLGR

SEQ ID NO: 25066 - DNA, 732 bp, Zea mays
  misc_feature: Ceres CLONE 1396502-F
  misc_feature: Encodes the peptide sequence at SEQ ID NO. 25067
  misc_feature (622)..(622): n is a, c, t, g, unknown, or other
  misc_feature (636)..(636): n is a, c, t, g, unknown, or other
  misc_feature (637)..(637): n is a, c, t, g, unknown, or other
  misc_feature (645)..(645): n is a, c, t, g, unknown, or other
  misc_feature (679)..(679): n is a, c, t, g, unknown, or other
  misc_feature (680)..(680): n is a, c, t, g, unknown, or other
  misc_feature (682)..(682): n is a, c, t, g, unknown, or other
  misc_feature (683)..(683): n is a, c, t, g, unknown, or other
aaagctggagctccccgcggtggcggccgctctagaactagtggatcccccgggctgcaggaattcgcacgagaccattacctagaacatcctaatcaaaaagcaaggcaagaagaacacgagagagatagcaggcaccaggcagggatcaatcatccgtccatggagaacctaaaggagcggggacacgacgcggcgggcgccaacgcctggatgacggtgccggcgttcggggactgggacacgaagaacggcgcgctgccggactactccatggacttctccaagatccgcgagatgcgcaagcagaacaagaaggagctctcccgcgccagcctcggcggcgacgacgacctcctcgcccacgcccaggcccaggccctgaagccgcaggccagtaacgccccgcccaagctcggccgcccccgccccggccccgccgacgaccactccccaacgggagggaagaagttcctgagctacttccggtgttgtatcaaggcctgaagaggtgctgctctagtgcctgcagtccctgtgtttttttttcgcagcagaacacttgtgagaatcaggatcgttagaaaaaccccccccccccccccttcctttaaaaaaaaancccccaaaaaaaannaaaaaaancccacaatcccccaaaaaaaaaaaaaaaaaaccnnannaaacactcccaaaaccaaaaacccaaaaaaaaattttccccttaaaaat

SEQ ID NO: 25067 - protein, 114 aa, Zea mays; identical to SEQ ID NO: 12016
  misc_feature: Ceres CLONE 1396502-F

SEQ ID NO: 25068 - DNA, 706 bp, Zea mays
  misc_feature: Ceres CLONE 1396507-F
  misc_feature: Encodes the peptide sequence at SEQ ID NO. 25069
  misc_feature (492)..(492): n is a, c, t, g, unknown, or other
aaagctggagctccccgcggtggcggccgctctagaactagtggatcccccgggctgcaggaattcgcacgagaccattacctagaacatcctaatcaaaaaaagttttgagagcggcaaagcgttaggcgttagggcatccacctcgtcgtaggcggcggtctccatgtctaccgcatccggcaacggcaacggcggctcctcctcttccatgttatacgacttgtacggccctaatgcaaagcctgatgtggtttttaaggaggctgctttaaactctacgttaaatctgcaggatgttcagggtctagttacttgggttattggtgatggcatgctgccttcttgggtgtttgttaagaacaaacctcttataccaaaaagtgtcctactatatgttcctgggccttgatgcaactttatatatgtcacacactcgactttcttcttctctgaaagaatatgtggccatccaaaacctggtttagcttncagccgaatgccgggatagaggcacaccatgatgccctccttacctgcaaggaaaaagaaagcggggtgaaaaacctcaaagggtcttctaacccggactaaaatgaaaaatataaagcttggaggactggggaacacccatcccgggacaaattccccctccccaaaaaaaacttggaaaaaagggcaccttttcattaccccgggttgcccc

SEQ ID NO: 25069 - protein, 81 aa, Zea mays
  misc_feature: Ceres CLONE 1396507-F
MSTASGNGNGGSSSSMLYDLYGPNAKPDVVFKEAALNSTLNLQDVQGLVTWVIGDGMLPSWVFVKNKPLIPKSVLLYVPGP

SEQ ID NO: 25070 - DNA, 622 bp, Zea mays
  misc_feature: Ceres CLONE 1396511-F
  misc_feature (311)..(311): n is a, c, t, g, unknown, or other
caaagctggagctccccgcggtggcggccgctctagaactagtggatcccccgggctgcaggaattcgcacgagaccattacctagaacatcctaatcaaaaattcctcttgctcttcctcttccattcattagctgcactcgcctccctcgcgccaccgccttctcagccaccaccgccgcgggtgcctcagaaagtgcaggtgtggcccaagccggtgtccatctcgtggccgttgccggcatacgcgccgatctccccgtcgttcaacatccgcgcctcgccgtcgcacccgtcgctccgtcacgccnatcgcgtactacaccccgcctcatccgcaccgagcgtacacgccgattatccccccgtcactacacgtctcggcgtcccatccgctggtcgggctctcgtctcgatccgacgtcccgtcgcccggcgtcgacagtctaccggtctccgtgcacccatttcaagtcgttgaatttcttgcgcactcctggggaatcatcgcggtttcgaaccttttcccagttgcctgggaaaagggggcccccaaccggaggggccaacaaatagccccccgggaattaaaactcccgacccccccccggttacccccccg

SEQ ID NO: 25071 - DNA, 664 bp, Zea mays
  misc_feature: Ceres CLONE 1396522-F
  misc_feature: Encodes the peptide sequence at SEQ ID NO. 25072
  misc_feature (630)..(630): n is a, c, t, g, unknown, or other
aaagctggagctcaccgcggtggcggccgctctagaactagtggatcccccgggctgcaggaattcgcacgagaccattacctagaacatcctaatcgaaaagattcggtttggtgcgcctcgtggtccacgtgcgcgggctttgtgctctctcttccctctgtgtgtgtgtgtgtcagttcatcgggtaggttggtggcggcgtgagagatgacgagctgcggcgtcggaggagcggacgggcagcagtgcccgtgcgactactgcggggaggcggcggcggctctgcactgccgcgcggacgccgcgcgcctctgtgtcgcgtgcgaccgtcacttgcacgccgccaacgcgctgtcgcaggagcacgtgcgggcgccgctctgcgcggtgtgcgtcgcgcgccacgacgacgtgagcgacttgctcgcccgttcccccgtcggcgacggaccggggttcctctgcatgcactgatgccagctctgccacaacgctttctcgtccaaggcctcccccgacgattactatgactagtgcatctgcccacgtggtaacaaggatttggctacccgatgtttgctaggttaagaggcaggtagccagaaggcctttgagagctcgaagggntacccaataacataggttccttttctggttccct

SEQ ID NO: 25072 - protein, 88 aa, Zea mays
  misc_feature: Ceres CLONE 1396522-F
  misc_feature (11)..(58): Pfam Name: zf-B_box Pfam Description: B-box zinc finger
MTSCGVGGADGQQCPCDYCGEAAAALHCRADAARLCVACDRHLHAANALSQEHVRAPLCAVCVARHDDVSDLLARSPVGDGPGFLCMH

SEQ ID NO: 25073 - DNA, 733 bp, Zea mays
  misc_feature: Ceres CLONE 1396534-F
  misc_feature: Encodes the peptide sequence at SEQ ID NO. 25074
  misc_feature (52)..(52): n is a, c, t, g, unknown, or other
  misc_feature (53)..(53): n is a, c, t, g, unknown, or other
  misc_feature (58)..(58): n is a, c, t, g, unknown, or other
  misc_feature (225)..(225): n is a, c, t, g, unknown, or other
tgggatcgcgccggggaccgcagaccccacccaaacacccaccaaaaaattnntctcnctcaaagtggggctcaccgcggtggcggccgctctagaaatagtggatcccccggggctgcaggaattcgcacgagaccattacctaagaacatccctaatcgaaaaaataccaaaaccatcctaattcctcccaaggcaagaaaccaagaccatggctggcacggncaagacccccgtcctcggcttcctccttgctcttgctcttggtggccacctcgaacgccgggctggcggcccaccacggcttgacggcttccacaaaccctgggggtccggaacccccgggggggccgtttggttgaagcccgaaaaacccgggtttcccccgccatttttccgaaaaaaaaaggggggcccgctctccaaacggggggggggggggggggggggccctcgggtccccccctatctggggtttttccccggggaaaaaagaattttttttgtgggggggggggtgcccccaccccgggggggggcgcgcccccccaccctgcggaaaaaaaacccctccccccccgcaaataatttcccccggggggggaggaaaacaacggggagagaacggccggcccccccccccccccccgggtctaagagagggtggggccctctttcgtcgcccctacccccacccacgaggggggtgggagaaaaaacacatttgtgaaag

SEQ ID NO: 25074 - protein, 172 aa, Zea mays
  misc_feature: Ceres CLONE 1396534-F
  misc_feature (5)..(5): Xaa is any aa, unknown, or other
MAGTXKTPVLGFLLALALGGHLERRAGGPPRLDGFHKPWGSGTPGGAVWLKPEKPGFPPPFFRKKKGGPLSKRGGGGGGGPRVPPYLGFFPGEKRIFFVGGGVPPPRGGARPPTLRKKNPSPPANNFPRGGRKTTGRERPAPPPPPGSKRGWGPLSSPLPPPTRGVGEKTHL

SEQ ID NO: 25075 - DNA, 640 bp, Zea mays
  misc_feature: Ceres CLONE 1396535-F
gctctagaactagtggatcccccgggctgcaggaattcgcacgagaccattacctagaacatcctaatcgaaaagaaaaagagcgtatttcttcttcctcaccctcctcgaggaagagagagggcagctccggagccgcacgggcgcgagcgaggcaggcagtggctcctccccccctctttcgatatcagctcatcgattcgtcctatcacacacatatcattaacgctccctcttctccactatgcttggcctcctactcaatggggcagaggagaaaaaaaaggccttggtgaagtggttggatcggggttctggggggggatgggaacggggggttccttgggcgggttcttgggtttggggaaggaacgaattggcggcccttcggggttccgcccgggggggggggtgaaaaccccctttccggggtcccttccccttaaagtttggaacggggataagggggggggaaaggggacaaaaaaaaaaaatttgggggattgggatccccgggggagaagggggggtgtaaaaaaaaaaatacccagggggggggggaggccgtggggatttctccgggggggggggtggtgggtgaggccccaaagcctcccgaaaaggggggggatatgtttgt

SEQ ID NO: 25076 - DNA, 745 bp, Zea mays
  misc_feature: Ceres CLONE 1396539-F
  misc_feature: Encodes the peptide sequence at SEQ ID NO. 25077
  misc_feature (13)..(13): n is a, c, t, g, unknown, or other
  misc_feature (14)..(14): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (56)..(56): n is a, c, t, g, unknown, or other
  misc_feature (57)..(57): n is a, c, t, g, unknown, or other
agggggggggatnntgaannnaagtattggggtgtggggatccgagttttggtaanncacaaaagtggagctccccgcggtggcggccgctctagaactagtggatcccccgggctgcaggaattcgcacgagaccattacctagaacatcctaatcaaaaatcccatcccctcaggcctcagtcgtcagtccctcacacactcactatacactgctctgctgcagcaagaaggaagaagctagcgcctccctagctctcgttgtcagcaatggccaccaccgccgcgtccagcctcctcaagtcctccttcgcgggctcccggatcccttcggccacgcgcaccaccaccccgtcgtccgtggccgtggccaccccgcgcgccgggggcggccccatccgcgcgtctatctcctcctcccccaccccgccctacgacctgacgtccttccgggtcagccccatcaaggagtccatcgtgtccccgcgagatgacccggggctacatgacggacatgatcacccacgtcgacaccgacgtggtgatcgtgggcgcccgggcccgcgggccctggcctggcgcaaacgagcgtggtcaaaggaccccttccgggaaacgtcccccaatcggggaagaaaacccggggtcccccgggcggagcgacgccgggggactgggactagaacaagatcgttttctccggggcaaagggagagggggggacatcagaccgctcgacgcgcac

SEQ ID NO: 25077 - protein, 85 aa, Zea mays
  misc_feature: Ceres CLONE 1396539-F
MTRGYMTDMITHVDTDVVIVGARARGPWPGANERGQRTPSGKRPPIGEENPGSPGRSDAGGLGLEQDRFLRGKGRGGDIRPLDAH

SEQ ID NO: 25078 - DNA, 625 bp, Zea mays
  misc_feature: Ceres CLONE 1396540-F
  misc_feature (196)..(196): n is a, c, t, g, unknown, or other
  misc_feature (200)..(200): n is a, c, t, g, unknown, or other
  misc_feature (215)..(215): n is a, c, t, g, unknown, or other
  misc_feature (246)..(246): n is a, c, t, g, unknown, or other
  misc_feature (279)..(279): n is a, c, t, g, unknown, or other
  misc_feature (310)..(310): n is a, c, t, g, unknown, or other
aagctggagctccccgcggtggcggccgctctagaatagtggatcccccgggctgcaggaattcgcacgagaccattacctagaacatcctaatcaaaaaaggaaaaaaaaggatggctctccggcaacgccggatccctcgcgctccgcgccgccgcctacctccgccgccaccgtccccattcatcctccccantggncctcggcgcccccgntccaactccatacgctccccgctggccccgnctttccggacttcgctggctcggctggtactcnaccaataagaagcgaggcaaggaggaggacnatgccccgcggggcccggaatgaaaaaagccttgccccttcccttgtaaagttccgaagggaagaagggcaaaaaattcccccccgggtggagaccttcgccttgggaacaaaaagggatgggcttgggtgggggccataagaaacacaaccccccctgttggaaaaatggggtttttcccaaaagaaagattataaaaaaacccgggggaaaaaaggttggaaaaccaccggcttttttttaaaggggggggagaaaaaaaaaaggggcttttgggggaaaaggacaaaaaatttttggggggaaaggaaatgg

SEQ ID NO: 25079 - DNA, 708 bp, Zea mays
  misc_feature: Ceres CLONE 1396547-F
  misc_feature: Encodes the peptide sequence at SEQ ID NO. 25080
  misc_feature (496)..(496): n is a, c, t, g, unknown, or other
  misc_feature (497)..(497): n is a, c, t, g, unknown, or other
  misc_feature (523)..(523): n is a, c, t, g, unknown, or other
  misc_feature (552)..(552): n is a, c, t, g, unknown, or other
  misc_feature (658)..(658): n is a, c, t, g, unknown, or other
aaagctggagctccccgcggtggcggccgctctagaactagtggatcccccgggctgcaggaattcgcacgagaccattacctagaacatcctaatcgaaaaattccaaaagctctcgagacttcctcagcaatcaatcagctttccagcgatcggcagctcctcgatcgtttcgaagctccaatccgcccggccgcctccgcctgttgccactagctaggtgatcgatcgaatggactgcggtggctcgctgcagctcccgcctgggttccgcttccaccccaccgatgacgagctggtgatgtactatctcctccgcaagtgcggcggcctgccgctcgccgcgccggtcatcgccgaggtggatctctacaagttcgacccatggcagctcccagagaaggcgttcggtggggagaaggagtggtacttcttctcgccgcgcgaccgcaagtacccgaatggctccaggcctaaccgggcggccgggacaggnntaactggaaggccaccggcgccgacnaagccggtagggtcgccgcgccccgtggncatcaagaaggcgctcgtcttctacgccgggaagccgccccaagggcgtcaagaccaactggatcatgcacgagtaccgccctcgcgggacgtcgaacggctcggnccgcgcacgcaagaagacaacaacgcgcttcaggctgggataaactgggg

SEQ ID NO: 25080 - protein, 158 aa, Zea mays
  misc_feature: Ceres CLONE 1396547-F
  misc_feature (9)..(128): Pfam Name: NAM Pfam Description: No apical meristem (NAM) protein
  misc_feature (89)..(89): Xaa is any aa, unknown, or other
  misc_feature (107)..(107): Xaa is any aa, unknown, or other
MDCGGSLQLPPGFRFHPTDDELVMYYLLRKCGGLPLAAPVIAEVDLYKFDPWQLPEKAFGGEKEWYFFSPRDRKYPNGSRPNRAAGTGXTGRPPAPTKPVGSPRPVXIKKALVFYAGKPPQGRQDQLDHARVPPSRDVERLGPRTQEDNNALQAGINW

SEQ ID NO: 25081 - DNA, 712 bp, Zea mays
  misc_feature: Ceres CLONE 1396548-F
  misc_feature: Encodes the peptide sequence at SEQ ID NO. 25082
  misc_feature (614)..(614): n is a, c, t, g, unknown, or other
  misc_feature (615)..(615): n is a, c, t, g, unknown, or other
  misc_feature (673)..(673): n is a, c, t, g, unknown, or other
  misc_feature (712)..(712): n is a, c, t, g, unknown, or other
aagctggagctccccgcggtggcggccgctctagaactagtggatcccccgggctgcaggaattcgcacgagaccattacctagaacatcctaatcgaaaaacaaaccgaaaaaggccgcgacgagccgacgatctctactgcccccttccggccttcggcgaccgtgacgagcaacgacgacgacggcgacgatggccgcttcctccctctgccacgggcacttgctcctgtttctcctcgtgtccgtcacatcggcctgcctcggtaccgcggcagcgcatcaagccgggtctggagagggctacacgatcgccggccgcgtcaagatcgatggcatgagtgagaagggctatggtcttccagccaagacatcaaacacaaaagtgatacttaatggcggccaaagggttacatttgccaggccagacggctactttgcattccacaacgtgccagctggaactactgtgtttttttttaggatgcgcgttcttgttaagttggtccaatccaagttcctgtggtagttgcagcagagcagagcgatttgcttgcttgcttcttagctctgtggatgactctgattctcaatgtgtgtgctgctgctggtgnncagattttgctcggcagaaatctactggaaattgcactggtagggagaggagctactnatatctttctctccatggtctacgactacgactctacgn

SEQ ID NO: 25082 - protein, 111 aa, Zea mays
  misc_feature: Ceres CLONE 1396548-F
MAASSLCHGHLLLFLLVSVTSACLGTAAAHQAGSGEGYTIAGRVKIDGMSEKGYGLPAKTSNTKVILNGGQRVTFARPDGYFAFHNVPAGTTVFFFRMRVLVKLVQSKFLW

SEQ ID NO: 25083 - DNA, 695 bp, Zea mays
  misc_feature: Ceres CLONE 1396550-F
  misc_feature: Encodes the peptide sequence at SEQ ID NO. 25084
  misc_feature (478)..(478): n is a, c, t, g, unknown, or other
aaagctggagctccccgcggtggcggccgctctagaactagtggatcccccgggctgcaggaattcgcacgagaccattacctagaacatcctaatcaaaagtcgcatcgcacgccatcagcagctagcgcgctcctcgagcccagcagagaaaggccggcagcgctaatcgtaatagccatgggctccaccgccggcgacgtggccgcggtggtggacgaggaggcgtgcatgtacgcgatgcagctggcgtcgtcgtccatcctgcccatgacgctgaagaacgccatcgagctgggcctgctggaggtgctgcagaaggaggccggcggcggcaaggcggcgctggcgcccgaggaggtggtggcgcggatgcccgcggcgcccagcgaccccgccgccgccgcggccatggtggaccgcatgctccgcctgctcgcctcctacgacgtcgtccggtgccagatggaggaccggnacggccggtacgagcgccgctactccgccgcgcccgtctgcaagtggctcacccccaacgaggacggcgtgtccctggccgccctcgcgctcatgaaccaggacaaggccctcatggagagctggaactatcccaaggacgccggtgttggaacggggccatcccggatcaacaaaggggtcacgggatgacggccgttcgagtaccaccgggaccg

SEQ ID NO: 25084 - protein, 162 aa, Zea mays
  misc_feature: Ceres CLONE 1396550-F
  misc_feature (31)..(87): Pfam Name: Dimerisation Pfam Description: Dimerisation domain
  misc_feature: SWISSPROT Homolog: EC 2.1.1.68 Caffeate O-methyltransferase
  misc_feature (100)..(100): Xaa is any aa, unknown, or other
MGSTAGDVAAVVDEEACMYAMQLASSSILPMTLKNAIELGLLEVLQKEAGGGKAALAPEEVVARMPAAPSDPAAAAAMVDRMLRLLASYDVVRCQMEDRXGRYERRYSAAPVCKWLTPNEDGVSLAALALMNQDKALMESWNYPKDAGVGTGPSRINKGVTG

SEQ ID NO: 25085 - DNA, 706 bp, Zea mays
  misc_feature: Ceres CLONE 1396551-F
  misc_feature: Encodes the peptide sequence at SEQ ID NO. 25086
aaagctggagctccccgcggtggcggccgctctagaactagtggatcccccgggctgcaggaattcgcacgagaccattacctagaacatcctaatcgaaaaccgtcgatctcgtcggcgacgccactacctctcgccgtccggtgccaccatccgcctccgactcctgcgacccagccacggttcccgaggatacgggccgagtccggcgatgggggtggtgggtagagcgggaggagtgggcactcagccccttcgcctacccgctcctctccgccgccgccctcgccgcggtgctcctcctcccttacctttccccgaggactgcgccgcacgccaccggaccctcgtctcccttcgacgtgggcgccgcacccttcctccggttccgccgcgccttcctcgtcctcttctccctcgcgtccgtggttgaaggtatccattccgtgtttggggaggatgagttcgtgcggtgtgggcttggcagagagcagacgaccgcgcgccttggctctaccactgcagctgcgctggtccccgggtgcatttctggcggcatctccgacaaataggaccacgaagggcttgatattggacggggcacttcactttgaaataagggttgggaaaagtttcagggcgctcactggtcatggatcaaaaatttcattctgggttttggctcttcggggttccctttcgggtt

SEQ ID NO: 25086 - protein, 82 aa, Zea mays
  misc_feature: Ceres CLONE 1396551-F
MSSCGVGLAESRRPRALALPLQLRWSPGAFLAASPTNRTTKGLILDGALHFEIRVGKSFRALTGHGSKISFWVLALRGSLSG

SEQ ID NO: 25087 - DNA, 712 bp, Zea mays
  misc_feature: Ceres CLONE 1396552-F
  misc_feature: Encodes the peptide sequence at SEQ ID NO. 25088
  misc_feature (393)..(393): n is a, c, t, g, unknown, or other
  misc_feature (423)..(423): n is a, c, t, g, unknown, or other
  misc_feature (496)..(496): n is a, c, t, g, unknown, or other
aagctggagctccccgcggtggcggccgctctagaactagtggatcccccgggctgcaggaattcgcacgagaccattacctagaacatcctaatcgaaaagagactctgagtctcgctcgcaccccgtcccccgcagcctgtgctctgggttggagggaggtgagctgcgagggagcgcggagggggcgaggagatggaggcagattcggcgaggaagagacttgcattgctggccctgcttctcctggcggcgcccgtccgcccggcctcggcggctccggtggaggatggcctgctcagcaatggtgactttgagacagcaccaagtggtggttttgtaaaatctgcgtctgttgctgagggtgcatcgtcaatccctggttggacgatncacggcacggttgaactcatttcagcaggnccacacccaggtggcatgatcctgatttgtccacagggggaccatgcagtaaggctagggaatgatgctagcngtgggcaggtggtggacgttgagaagggttcggagtatgctatcacattcagtgctgcccggacatgtgcacaactggaggcactggaatggttccgtgctaggtggcgtatctcagacagtagacttgcagacgtttgtacacatagaaggctgggatgcctacgcgtttggcttttcaggcgacggaggagcagcacatcttcatttcatgacc

SEQ ID NO: 25088 - protein, 172 aa, Zea mays
  misc_feature: Ceres CLONE 1396552-F
  misc_feature (49)..(172): Pfam Name: DUF642 Pfam Description: Protein of unknown function, DUF642
  misc_feature (66)..(66): Xaa is any aa, unknown, or other
  misc_feature (101)..(101): Xaa is any aa, unknown, or other
MEADSARKRLALLALLLLAAPVRPASAAPVEDGLLSNGDFETAPSGGFVKSASVAEGASSIPGWTXHGTVELISAGPHPGGMILICPQGDHAVRLGNDASXGQVVDVEKGSEYAITFSAARTCAQLEALEWFRARWRISDSRLADVCTHRRLGCLRVWLFRRRRSSTSSFHD

SEQ ID NO: 25089 - DNA, 747 bp, Zea mays
  misc_feature: Ceres CLONE 1396553-F
  misc_feature (274)..(274): n is a, c, t, g, unknown, or other
  misc_feature (313)..(313): n is a, c, t, g, unknown, or other
  misc_feature (314)..(314): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
aaagctggagctccccgcggtggcggccgctctagaactagtggatcccccgggctgcaggaattcgcacgagaccattacctagaacatcctaatcgaaaaatcattagtcgattccacaatgtatatcttagatagtttaattttgataatggatccaagatatatcaccctatgcatcttcctagtacttgtcttacatggagatacaactttggcagaaacttgcaggcagtttgttaaatgggatccattctgctttagtgcaatatgncaggcaagttgttttatagagggaaaatcctccgatggnntctatgtaaaggggcacgatgtgaatcaaagggaaatccctctggggggggttgcctttgggggaaaaaatagaatcaaggacctggggaacaactttcttttgccccccttggcccccaagggggggggccaaaaattttttgggaaaaaaatttaccaaaggggtttccattaagggttttggcgcccattttaaaaggggggtattttcctcaattttcagaaaaaaaaaattttttttttggccccaccccccaaaaaaattttttttttttcctttttaaaaaaaaaaaaaaaagggggtgtgttttttaaaaaaaaaaaaaaaaaattttttttcccctccccccccgggggggggggccgcccggggnnnnnnnnnnnnnnnnnnnnnnnnnnnnnnnnnnnnnnnnnnnnnnnnnnnnnnnnnng

SEQ ID NO: 25090 - DNA, 713 bp, Zea mays
  misc_feature: Ceres CLONE 1396555-F
  misc_feature: Encodes the peptide sequence at SEQ ID NO. 25091
  misc_feature (429)..(429): n is a, c, t, g, unknown, or other
  misc_feature (568)..(568): n is a, c, t, g, unknown, or other
  misc_feature (695)..(695): n is a, c, t, g, unknown, or other
aagagctggagctccccgcggtggcggccgctctagaactagtggatcccccgggctgcaggaattcgcacgagaccaacctagaacatcctaatcgaaaagaacacgatccctttctcccctttccctgcgtagtgcggagctccagtgaaggaaccaaacagcgcaacacacgaacacaccaggcggcaggctccaccccgtccttttcctgccttttccccccgtcgagttaatccatccagtcgccaaaagctttgctaaatttcacgtgtctcgcctcgagtcgtccctaatccgacgatgccttgttctactcctaaaaaaacccaaagatcctgactttctcttgctgctagcctcccttttcccttctcccttaatcgcactgttggaagctcttcgctgtcacccccacccacctccggngctcttttttagcattttccttgggctctggactccaaaatcccagccttttgtttgcttctctgtctcttgctgattggggtccccgggtccaggactcttgatttgctcctcgcggggggtcggtcccatggcggcngctgcgctggcaatggcagagcaggtgggggccgaactccgagggaggggggagacgccgcccccaatgctgcgcaagggggccgtggaaaatgcccccgagatggccccgggcctggaaaacgacngcggaagcaggtccaaat

SEQ ID NO: 25091 - protein, 51 aa, Zea mays
  misc_feature: Ceres CLONE 1396555-F
  misc_feature (46)..(46): Xaa is any aa, unknown, or other
MAAAALAMAEQVGAELRGRGETPPPMLRKGAVENAPEMAPGLENDXGSRSK

SEQ ID NO: 25092 - DNA, 679 bp, Zea mays
  misc_feature: Ceres CLONE 1396559-F
  misc_feature: Encodes the peptide sequence at SEQ ID NO. 25093
  misc_feature (374)..(374): n is a, c, t, g, unknown, or other
caaagctggagctccccgcggtggcggccgctctagaactagtggatcccccgggctgcaggaattcgcacgagaccattacctagaacatcctaatcgaaaaccggaatggtatcgtgcgacctgtagtcgtcgccagccacctcgctccctcctagacgacacccagctagtgctcccttccacacccaggaaccagccacctaaccccgcccgccatgccgggcctcgccgcctccgacaactcgccccgggcgccggcgccgccgccgcgccggctctcgtcgccgctaccccgtcgcgcgccgtcgtcccccgtcgccgtccgcctcctcgcgcgccaagcctcggaagccctcgccctctcccgcggncttccccaccgacgccgacgactcgctcgacacccgggatctggggcccttcctccttcagcaggcgcgcgacgccatggtgtctaggaagggccgggggccccccccggggactccaagttcgccgagcgcggcgccatggcggtcgagcgaaccggcgagggcgcccagcttgagctcggcaggacctccacgttgccggcggcatcactggggggctccggcggcacggtgaaaccatccccgtccttgaaggggccgtttcagatttcacggcgcccccaaaaggccccgcccaacagaaa

SEQ ID NO: 25093 - protein, 55 aa, Zea mays
  misc_feature: Ceres CLONE 1396559-F
MAVERTGEGAQLELGRTSTLPAASLGGSGGTVKPSPSLKGPFQISRRPQKAPPNR

SEQ ID NO: 25094 - DNA, 641 bp, Zea mays
  misc_feature: Ceres CLONE 1396560-F
  misc_feature: Encodes the peptide sequence at SEQ ID NO. 25095
  misc_feature (121)..(121): n is a, c, t, g, unknown, or other
  misc_feature (129)..(129): n is a, c, t, g, unknown, or other
  misc_feature (315)..(315): n is a, c, t, g, unknown, or other
  misc_feature (358)..(358): n is a, c, t, g, unknown, or other
  misc_feature (361)..(361): n is a, c, t, g, unknown, or other
  misc_feature (428)..(428): n is a, c, t, g, unknown, or other
  misc_feature (433)..(433): n is a, c, t, g, unknown, or other
ccccgcggtggcggccgctctagaatagtggatcccccgggctgcaggaattcgcacgagaccattacctagaacatcctaatcaaaaaagcgaggcagacagcggctgtcccgagctgtncgaaagcngaggcgcggcggcagtcctcgcagggccgaccggtcaaaagcactgctgctccacaccacccccaccatctctttccccaacccccgaagccgagccagcgaatcaccccgcccgcagccgcaagcaagcagccaagcagtgtgaactgaccgtccgttccgtccagcccaccatggaggcgccgncggtaccggagctcatggatctggacgcgccccctcccgccgnagncgacgccgcagccgcggggccgggtccccccgccgtcagcgaccagaaaaagggaggggaagggggnagaanctggttacgggccacatattctcccccaccatttggggggaaaaaacggcaaagccaaaaggggcccttatttaacatggcaaaaacggggttgggggaaacgggccctatttggggaatcccttccccagctaaaagggttttggaaaaatgggaaaaacccttcccccaataaaaaaaggggtgtgcaggaaaaccgggggaaaaa

SEQ ID NO: 25095 - protein, 101 aa, Zea mays
  misc_feature: Ceres CLONE 1396560-F
  misc_feature (5)..(5): Xaa is any aa, unknown, or other
  misc_feature (19)..(19): Xaa is any aa, unknown, or other
  misc_feature (20)..(20): Xaa is any aa, unknown, or other
  misc_feature (44)..(44): Xaa is any aa, unknown, or other
MEAPXVPELMDLDAPPPAXXDAAAAGPGPPAVSDQKKGGEGGRXWLRATYSPPPFGGKKRQSQKGPLFNMAKTGLGETGPIWGIPSPAKRVLEKWEKPFPQ

SEQ ID NO: 25096 - DNA, 710 bp, Zea mays
  misc_feature: Ceres CLONE 1396561-F
  misc_feature (1)..(1): n is a, c, t, g, unknown, or other
  misc_feature (512)..(512): n is a, c, t, g, unknown, or other
  misc_feature (514)..(514): n is a, c, t, g, unknown, or other
  misc_feature (680)..(680): n is a, c, t, g, unknown, or other
  misc_feature (681)..(681): n is a, c, t, g, unknown, or other
naaagctggagctccccgcggtggcggccgctctagaactagtggatcccccgggctgcaggaattcgcacgagaccattacctagaacatcctaatcgaaaaagactcctctcccccgctgcgcaacgcgctatcccccacttcacccgcctcggcgacatggctaagctcgtgctggcgctccacctcctgatgaccgcggatgaccccgagtacggccagcaccgcgagccaccagaatctccacctgcgttgcctcctcctacagcggaacgccgcacggagagacccggcacgcgtgggcaagagcatcacccagtactcgcatgacgaggcactggagctgctggcatctcaccgacgggagttactactcgggaagcactccatgtacgaggcgctcgagtccgcataatgcgcgcgagctgccgccgcggcagcagatacgagaacagccagccgcaagtgtgcaggcacacccctacgcagcgcaggtggtcccacaacatgncntaccgcaaactgaatcagttacaaatccgttcgactggcgaggaacaggggcgggtggacataggacgcgcccctgttctggacaatgtatcggtccctgtgatgacgcagagggtacgacctggatccgggtgtttacgatgaagcgaactgacgatgggacggnngggagggcaagcctagcccacacttatgt

SEQ ID NO: 25097 - DNA, 709 bp, Zea mays
  misc_feature: Ceres CLONE 1396562-F
  misc_feature: Encodes the peptide sequence at SEQ ID NO. 25098
caaagctggagctccccgcggtggcggccgctctagaactagtggatcccccgggctgcaggaattcgcacgagaccattacctagaacatcctaatcgaaaaagatttggatgtggactagatgcttaaggtgtgaacgtgaaagtggggtccccagatcatcacgaagggtgataatgtcagctgaagcacactacctttcatttgggaagttccttgaacttagtttttcaagccactcaaccgctagaaggctgccaatatgcgggcattcactcaatacggattgtctgcgctttttttgggttgggctccaaagttgcaatgttccagtattcctcagtcgaaatttacaatgcctgcaaaccacagcctactcttgagattcacaaccccgatatgcacaaagatgccccaaggttgctgccctcgtgtttcgtgctctgattgttgagtcttcaatgagagctgattccagttatatagaggtgaacaagcttttgattatttcttttgttaatttggtgcaacatatagaggtgaacaagcttattaaaggaagatccttgtacaatcaagagttcatacaatagatgaaacgatattgtgattctctcaatggtggcttcatgagcaagcaatcattcaccttgttcactaaaatttcagactgtagctcagataaggctttgagcattccttggtaga

SEQ ID NO: 25098 - protein, 90 aa, Zea mays; identical to SEQ ID NO: 11994
  misc_feature: Ceres CLONE 1396562-F

SEQ ID NO: 25099 - DNA, 722 bp, Zea mays
  misc_feature: Ceres CLONE 1396566-F
  misc_feature: Encodes the peptide sequence at SEQ ID NO. 25100
  misc_feature (378)..(378): n is a, c, t, g, unknown, or other
  misc_feature (455)..(455): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (479)..(479): n is a, c, t, g, unknown, or other
  misc_feature (480)..(480): n is a, c, t, g, unknown, or other
  misc_feature (482)..(482): n is a, c, t, g, unknown, or other
  misc_feature (483)..(483): n is a, c, t, g, unknown, or other
  misc_feature (486)..(486): n is a, c, t, g, unknown, or other
  misc_feature (487)..(487): n is a, c, t, g, unknown, or other
  misc_feature (489)..(489): n is a, c, t, g, unknown, or other
  misc_feature (510)..(510): n is a, c, t, g, unknown, or other
  misc_feature (521)..(521): n is a, c, t, g, unknown, or other
  misc_feature (615)..(615): n is a, c, t, g, unknown, or other
aaaagctggagctccccgcggtggcggccgctctagaactagtggatcccccgggctgcaggaattcgcacgagaccattacctagaacatcctaatcgaaaaatcacagctagctagcatacagacgaataatctcttcttcacctcactaacaccagctagcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgcntgcagcggggtgcgctcgctcaacagccggcgcgtcgtcggcggcgggaccggcaggccacctgcaactgcctcagnagcatgacgcccggnnntccgggnngnnggnngncagcatgggccaacgccgccnacatccccggnaagtgcgggcgtcctccgtcggcgtgcccatcagccccaccgtcgactgcaccaagatcaactgatcgatggaaccatagtggaggtagctcgntcgttggatggcagcgtacgtggccatcagcaggatgcagtcgtcgtcgtagcagagatgtcctagctacgtgtgggtcatgcatcagactggcaaataataaagaa

SEQ ID NO: 25100 - protein, 179 aa, Zea mays
  misc_feature: Ceres CLONE 1396566-F
  misc_feature (65)..(65): Xaa is any aa, unknown, or other
  misc_feature (90)..(90): Xaa is any aa, unknown, or other
  misc_feature (96)..(96): Xaa is any aa, unknown, or other
  misc_feature (99)..(99): Xaa is any aa, unknown, or other
  misc_feature (100)..(100): Xaa is any aa, unknown, or other
  misc_feature (101)..(101): Xaa is any aa, unknown, or other
  misc_feature (102)..(102): Xaa is any aa, unknown, or other
  misc_feature (109)..(109): Xaa is any aa, unknown, or other
  misc_feature (144)..(144): Xaa is any aa, unknown, or other
MAARSSSSQPQLVAAAAVLAAALLLLAAGAGTASAAVSCGEVTSSVAPCLGYAMGSAASPSAACXQRGALAQQPARRRRRDRQATCNCLXSMTPGXPGXXXXAWANAAXIPGKCGRPPSACPSAPPSTAPRSTDRWNHSGGSSXVGWQRTWPSAGCSRRRSRDVLATCGSCIRLANNKE

SEQ ID NO: 25101 - DNA, 720 bp, Zea mays
  misc_feature: Ceres CLONE 1396572-F
  misc_feature: Encodes the peptide sequence at SEQ ID NO. 25102
  misc_feature (384)..(384): n is a, c, t, g, unknown, or other
  misc_feature (572)..(572): n is a, c, t, g, unknown, or other
  misc_feature (578)..(578): n is a, c, t, g, unknown, or other
  misc_feature (581)..(581): n is a, c, t, g, unknown, or other
  misc_feature (586)..(586): n is a, c, t, g, unknown, or other
  misc_feature (591)..(591): n is a, c, t, g, unknown, or other
  misc_feature (631)..(631): n is a, c, t, g, unknown, or other
caaagctggagctccccgcggtggcggccgctctagaactagtggatcccccgggctgcaggaattcgcacgagaccattacctagaacatcctaatcaaaaggtggttgacggccgcttacccgcaccggcgccatgcgcgcgcgcggctaggtggtcgaggtcaagccaaacgctgcccaccgcctctgcctctgcctcgcatatatcctcgcgcacgttctttgctcgtctcgcactcgcttccttcgacgactcatcgccgatcacaccaggctagctagcccacccacagtcgtagggccaggaccgatcggaggagctcggtttttcgaccaggaccgccgccgccacacccgaagaagccgacgatgcagacgacgnacgtcctcggcggcggcgtcgccgcgcccgcgcgcgcgggcgccgcagtccgtggtggccgagctggagggcgcgctgctccggagcgcggacacgttcccgtacttcatgctcgtggcgttcgaggcgtccgggctgccgcgcttcgcgctgctgctggcgctgtggccgctgctgcggctgctggnagtggncgncccgncgcgncctggcgctgcgcgcccgcgcgttcgtggcccaccgcggncgtgcgccgcgccgaggtgaaggcagtgtcccgcggcgtgctgcccaagtcatgggccgacgacgtcgcccccgccgcgtgggcggcct

SEQ ID NO: 25102 - protein, 52 aa, Zea mays
  misc_feature: Ceres CLONE 1396572-F
  misc_feature (27)..(27): Xaa is any aa, unknown, or other
  misc_feature (29)..(29): Xaa is any aa, unknown, or other
  misc_feature (30)..(30): Xaa is any aa, unknown, or other
  misc_feature (32)..(32): Xaa is any aa, unknown, or other
  misc_feature (47)..(47): Xaa is any aa, unknown, or other
MLVAFEASGLPRFALLLALWPLLRLLXVXXPXRPGAARPRVRGPPRXCAAPR

SEQ ID NO: 25103 - DNA, 700 bp, Zea mays
  misc_feature: Ceres CLONE 1396574-F
  misc_feature: Translation starting site: 244
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
tggagctccccgcggtggcggccgctctatcactagtggatcccccgggctgcaggaattcgcacgagaccattacctagaacatcctaatcgaaaagggtctccgtgtcgtctctgcgactccacttgctcttttcgctggccctggctacttgcggcaactcccatctccacgcgctctcccatccgagatctcaaccgcctcgccggcgagcgactgacgggcggacggtcccgccggctatggggaactgctgctccgatgaggtgagccacgccggtgctcatcccgtcggctccgccaccgccaaagccgcctccgcagcctccgccgcggccgatcgctttctccgctcccgtggtgccggcgcgtccacgcagatcgagttatctctctctgcatcaaatttgggtgatcaagaatattttcccaagagtaatcccatgggtggttgtgtattccaaaaagagagatggtacactagaagaaattgggcgcagtgaagtaattttaaattcattgaaccccattttggacgaccaaaatcagtgtgcagtaccaagtttgaggttcttcaggcaattgggggttcaggtccttgacattcaccagcagttcccgggatgtcagggaaaagaagcttaagctagagggaccagaagttcctggaagaagcccccnnnnnnnnnnnnnnnnnnn

SEQ ID NO: 25104 - DNA, 718 bp, Zea mays
  misc_feature: Ceres CLONE 1396575-F
  misc_feature: Encodes the peptide sequence at SEQ ID NO. 25105
  misc_feature (517)..(517): n is a, c, t, g, unknown, or other
caaagctggagctccccgcggtggcggccgctctagaactagtggatcccccgggctgcaggaattcgcacgagaccattacctagaacatcctaatcaaaaagcacaagccaaacgtgcagctgaggaatcgcaacggcagtgacgtgtgcgcgttgccaaataaagctactatactagtcaccgctcgattgccgtcgcagccgcccgccggccggagatgggtgcgccggcgctgtcgtccgtcgtcgtggtggccacggcggcagtggtttgcctgtgcggggcctttgcgcaggcgcaggacatggacagcgagtgggcgcggccggcctaccgcgggttcttcggcgccccggccgggtcgctgctgccgcagtcggacgtggacctgctggagttcccgctgaacctggagtacctggagacggagttcttctgctggtccgctctggggtacggcctcgacgccatcgacgccacctcacccggcggcgggccggcctccatcggcggncagtccgcgtccctcaccccgtccatccgcgacgtggcaacccagttctgttaccaagaagtcgggcacctcagggcgatcaagaggacggtgaggggcttcccgagggcgttgctggacatcagcgcggccaacttcgggcagatcatcgagcaagcgctgaacgcgacgctggacccgccttcgacccctacgagacag

SEQ ID NO: 25105 - protein, 166 aa, Zea mays
  misc_feature: Ceres CLONE 1396575-F
MGAPALSSVVVVATAAVVCLCGAFAQAQDMDSEWARPAYRGFFGAPAGSLLPQSDVDLLEFPLNLEYLETEFFCWSALGYGLDAIDATSPGGGPASIGGQSASLTPSIRDVATQFCYQEVGHLRAIKRTVRGFPRALLDISAANFGQIIEQALNATLDPPSTPTRQ

SEQ ID NO: 25106 - DNA, 689 bp, Zea mays
  misc_feature: Ceres CLONE 1396578-F
  misc_feature (535)..(535): n is a, c, t, g, unknown, or other
  misc_feature (536)..(536): n is a, c, t, g, unknown, or other
  misc_feature (653)..(653): n is a, c, t, g, unknown, or other
aaagctggagctccccgcggtggcggccgctctagaactagtggatcccccgggctgcaggaattcgcacgagaccattacctagaacatcctaatcgaaaaccgccacgccacctcccctcccctcccgccgtgcgccccgatccctcgccgccccacgccggcctcatctcgccgaggactggatcgccggggggacatcctgggtgtccttcacacacatgcggcgttaggtgatgacgagcttgcctgagaggggagaatcacctgcgccgccactcgattctctgcgccaggactctgccgtgaccgtcctagcggctgccgccgttgcctcttcctccgctggctccgatcgcaaggaagacagcggctccaggcagcccaaggcctccatcctggtccggcgtcttctctcccccttttgccatattcgaggggcagcagcagggctccctcgtcgccggcgtgcgacgccaggtcgacaaagtcgtcctcagggttcctatggtttatccaggattctgaaggaggnntcgtgggcagcggctccatgtggcgacttctgggggtgcggcagggtcttgacctccagggacgtgtggttcctttggtaatgctataaagtgtcgcctgaagaaaaaggagctggncgactccgagcccgacagcggcaatgctgggttttc

SEQ ID NO: 25107 - DNA, 620 bp, Zea mays
  misc_feature: Ceres CLONE 1396579-F
  misc_feature: Encodes the peptide sequence at SEQ ID NO. 25108
  misc_feature (288)..(288): n is a, c, t, g, unknown, or other
  misc_feature (338)..(338): n is a, c, t, g, unknown, or other
  misc_feature (385)..(385): n is a, c, t, g, unknown, or other
  misc_feature (405)..(405): n is a, c, t, g, unknown, or other
  misc_feature (449)..(449): n is a, c, t, g, unknown, or other
  misc_feature (450)..(450): n is a, c, t, g, unknown, or other
  misc_feature (462)..(462): n is a, c, t, g, unknown, or other
  misc_feature (474)..(474): n is a, c, t, g, unknown, or other
  misc_feature (477)..(477): n is a, c, t, g, unknown, or other
caaagctggagctccccgcggtggcggccgctctagaactagtggatcccccgggctgcaggaattcgcacgagaccattacctagaacatcctaatcaaaaaggcagccgccgcaaccttctttctacgatgcctcgcaagcccaaacggaaggctccggcctcaccggcgaggcacgacccttcgccggagccctacccttcccatgcctccccctgctcggcacaatgcctggtagtccgcgatgccctcctcgcgttccacgggttccccgaagagttcgcggncttccgcgtcctccgcctcggtggcctctcgcctaaccgtgaccctcggncttcgtcccccacagtgcttgacggcctcgtcacacgctcctctccnagacactagcgacgcatctnccgcgcgctttcgctcgctcagggcgcttcccctctgggacagnntgtggatgagangggaaagaaggntgnaggaccccatcgggtgcggggcctgggggggacaaggcggcaggtacggccatgcttaggaagtgagggaacggaaggccaaattttgcttcagacttggggaactggccgggatggaagggaaaaaggacttcccgggttca

SEQ ID NO: 25108 - protein, 87 aa, Zea mays
  misc_feature: Ceres CLONE 1396579-F
  misc_feature (53)..(53): Xaa is any aa, unknown, or other
  misc_feature (70)..(70): Xaa is any aa, unknown, or other
MPRKPKRKAPASPARHDPSPEPYPSHASPCSAQCLVVRDALLAFHGFPEEFAXFRVLRLGGLSPNRDPRXSSPTVLDGLVTRSSPRH

SEQ ID NO: 25109 - DNA, 713 bp, Zea mays
  misc_feature: Ceres CLONE 1396582-F
  misc_feature: Translation starting site: 209
  misc_feature: SWISSPROT Homolog: EC 3.2.1.4 Cellulase
  misc_feature (525)..(525): n is a, c, t, g, unknown, or other
  misc_feature (538)..(538): n is a, c, t, g, unknown, or other
  misc_feature (552)..(552): n is a, c, t, g, unknown, or other
  misc_feature (553)..(553): n is a, c, t, g, unknown, or other
  misc_feature (622)..(622): n is a, c, t, g, unknown, or other
  misc_feature (670)..(670): n is a, c, t, g, unknown, or other
  misc_feature (671)..(671): n is a, c, t, g, unknown, or other
aaagctggagctccccgcggtggcggccgctctagaactagtggatcccccgggctgcaggaattcgcacgagaccattacctagaacatcctaatcgaaaagaggaggcagtgcggagacgggagccagtggccagtgacagtgagcggcgacgttccagtgtccactgtccagtaggcgagcgaggaggtggtccattggccggccatggctcgtctccgctgcgtcttcgtcgtcttcgtcctgctctcgtctgccctccgccttccaggcgacgccattgcctcccgggggcaccatggccccgccgcacacgactacagggacgcgctcgtcaagtccatcctcttcttcgagggccagcggtcgggcaagctgccgccgtcgcagcgcgtgtcctggcgcagggactcgggactctccgacggtcactccgccaagggggacctgggtgggcgggtaccacgacgctggtgacaacgtcaagttcgggttcccgatggcgttcagcatgacgatgctgncgtggagcgtggntggaagttttgcgnnctcatgaagtcggagctgcagcacgccagggacgcccgtccgctggggcgccgactacctgctcaaggncacggcgcacccggacacatctacgttccagggtcggtgacgcgacanngaccacgcgttgctgggagcggccggaggacatggaaccccc

SEQ ID NO: 25110 - DNA, 704 bp, Zea mays
  misc_feature: Ceres CLONE 1396583-F
  misc_feature: Encodes the peptide sequence at SEQ ID NO. 25111
  misc_feature (388)..(388): n is a, c, t, g, unknown, or other
  misc_feature (406)..(406): n is a, c, t, g, unknown, or other
  misc_feature (477)..(477): n is a, c, t, g, unknown, or other
caaagctggagctccccgcggtggcggccgctctagaactagtggatcccccgggctgcaggaattcgcacgagaccattacctagaacatcctaatcgaaaaattcctcttctctcctcccctccctcggcctttctcccatccccgttcgaagaagccgccaataccgcggcagtcgaggatggcggcggcggcaccacccgacgggcaggaaaaggtgattgcggcggcgcagcacatcgtcaagtcgctcgccagctccaagaacgccgccgacgacatgatccgcatcctctccggcttcgacaactgcctctcgttcatgtccgacctcttcccttctccccctgccgccaccgtcgttggttccatcctggaggcgagaanggggggacccaggggggnagggggacgagcccgactacgacgaagacgacgccgctgcccgggccgaggggagttgggaacgtgggcgncctgagtgttcgagcgcccgggagtcccccgctgctggggaagcgctggtgttcgactcgcgggagggcgccgaggagaccctcgccgcggtcgccggccttcgcggggtgcgccgggccccgtgcgccgaggccgcgctgccgggcgccttggggcggctcgggggagagtttcgccaccttgctcgggggcgggggggccgccgttcttccccgaggacctccgt

SEQ ID NO: 25111 - protein, 98 aa, Zea mays
  misc_feature: Ceres CLONE 1396583-F
  misc_feature (69)..(69): Xaa is any aa, unknown, or other
  misc_feature (75)..(75): Xaa is any aa, unknown, or other
MAAAAPPDGQEKVIAAAQHIVKSLASSKNAADDMIRILSGFDNCLSFMSDLFPSPPAATVVGSILEARXGGPRGXGGRARLRRRRRRCPGRGELGTWA

SEQ ID NO: 25112 - DNA, 712 bp, Zea mays
  misc_feature: Ceres CLONE 1396585-F
  misc_feature: Encodes the peptide sequence at SEQ ID NO. 25113
  misc_feature (443)..(443): n is a, c, t, g, unknown, or other
  misc_feature (561)..(561): n is a, c, t, g, unknown, or other
aaaagctggagctccccgcggtggcggccgctctagaactagtggatcccccgggctgcaggaattcgcacgagaccattacctagaacatcctaatcgaaaagaaacccctctcttcttcctccttccattggggtcgcgtccaacaagagggtggccagccatcccgcgcgagccacttcctctctcctccccatcggatccagcgccacgcggatccgcaaggcaatccatggcctctacccaggcggaagcggaggcggaggcaccggtcccgcccgaggcggaggaggcgaaggagaaggcaagcagggcgtcgtgctggggcaggctgatggcggccgctcttctcgtgcccgagagacttagagaaccggatgcagcacctggccaaggaggatgcatccgtgattgcccgcatagctcgtcgtacgcacctctancgtggcgatgtgctgcaactgatcgtactctccgtactcgcggaggtggtacgtgtagatgatgccatcatgacgactacaaatgaagatctatctggcaaatgaggccaagacgagngatacgtatgttcattcgtcctggtgcatcctctggcatatattgcacagatgttaatgtcacaaggatgtttgagcaaaaagaccagaaagaccttgaaaaattgaggtctgagaggaaaccaagattgatgagcttaaagagacacaaa

SEQ ID NO: 25113 - protein, 56 aa, Zea mays
  misc_feature: Ceres CLONE 1396585-F
  misc_feature (22)..(22): Xaa is any aa, unknown, or other
MQHLAKEDASVIARIARRTHLXRGDVLQLIVLSVLAEVVRVDDAIMTTTNEDLSGK

SEQ ID NO: 25114 - DNA, 683 bp, Zea mays
  misc_feature: Ceres CLONE 1396586-F
  misc_feature: Encodes the peptide sequence at SEQ ID NO. 25115
  misc_feature (1)..(1): n is a, c, t, g, unknown, or other
naaagctggagctccccgcggtggcggccgctctagaactagtggatcccccgggctgcaggaattcgcacgagaccattacctagaacatcctaatcaaaagaagccgcatctgcggtgtttcataatcccaaaattctcgcacgcaacagagaacggagggagatggagagagagccgcgggagctgagggagaaagaagctgggcgcggcgctgggagatccggtgagccgagagggaggctgcgcgccgtgggagctggagcagcgcgcgacacagagaaccggagggcgcgcaggccgggttcagggtaaagctcggcgaaggtggtcaatcatagccgccaacaagaccacgccggcggcaaggtcggcaggtcgatgagttgcccggagcgagagagcggaggaaataggcgcaaagtatgcgggtgcactgcagaaagaaacatccatcgatggcagagcgatggcgagaaccgaaggacgaagggccggtaacccccaacacataaatggctgaagctgggcgcatgaccacgacctcgaacccggaatgcggcccctccccttctttcaaaaaattcggactttcattggggtgggggaggagggaaggttaaaaaaccggtggggggggaaattctttcctatggggggaattattctttttaaaaaaaaaa

SEQ ID NO: 25115 - protein, 49 aa, Zea mays
  misc_feature: Ceres CLONE 1396586-F
MEREPRELREKEAGRGAGRSGEPRGRLRAVGAGAARDTENRRARRPGSG

SEQ ID NO: 25116 - DNA, 681 bp, Zea mays
  misc_feature: Ceres CLONE 1396587-F
  misc_feature: Encodes the peptide sequence at SEQ ID NO. 25117
  misc_feature (445)..(445): n is a, c, t, g, unknown, or other
  misc_feature (446)..(446): n is a, c, t, g, unknown, or other
  misc_feature (554)..(554): n is a, c, t, g, unknown, or other
  misc_feature (555)..(555): n is a, c, t, g, unknown, or other
  misc_feature (602)..(602): n is a, c, t, g, unknown, or other
  misc_feature (622)..(622): n is a, c, t, g, unknown, or other
  misc_feature (631)..(631): n is a, c, t, g, unknown, or other
  misc_feature (662)..(662): n is a, c, t, g, unknown, or other
tggagctccccgcggtggcggccgctctagaactagtggatcccccgggctgcaggaattcgcacgagaccattacctagaacatcctaatcgaaaacccccacagaaccgtctccccagcccggcgcctcacggtcgcaatttattgcttgcgcaccgcctcgccgctttggcgtggggcgtttgcctgtgtggcgctgggcatgtgccgtgcccgtggcttgcttcgtcgtgctcactagtcacgagagagggaggaggctctgcttctgctgccgcttcttcttctcctgctgctcttccggagataagcagggggccgggacagctgactagctgagaggcatggggatggacgccggcggcggcaagctgccgtacagctacgccggccagcaggacggcgggaagctggtgaagagcgtcagccgcgtggagccgcgcnnagttcggctgggcctcgtggcgggcttcctcgtcgtcacctgcgcctacttctccaccggccagttcgacgccatccagatcgccatgaccagccgacctgtctcagnnaatgcggttgggcgtcggagtcgctctgcttgggaagtggccgccgncgccgtcgacacctccacgnctccagggnagggattagatttgggcgcgatggtcatggnccgaggaagggaagcgagg

SEQ ID NO: 25117 - protein, 112 aa, Zea mays
  misc_feature: Ceres CLONE 1396587-F
  misc_feature (34)..(34): Xaa is any aa, unknown, or other
  misc_feature (70)..(70): Xaa is any aa, unknown, or other
  misc_feature (86)..(86): Xaa is any aa, unknown, or other
  misc_feature (93)..(93): Xaa is any aa, unknown, or other
  misc_feature (96)..(96): Xaa is any aa, unknown, or other
  misc_feature (106)..(106): Xaa is any aa, unknown, or other
MGMDAGGGKLPYSYAGQQDGGKLVKSVSRVEPRXVRLGLVAGFLVVTCAYFSTGQFDAIQIAMTSRPVSXNAVGRRSRSAWEVAAXAVDTSTXPGXGLDLGAMVMXRGREAR

SEQ ID NO: 25118 - DNA, 702 bp, Zea mays
  misc_feature: Ceres CLONE 1396589-F
  misc_feature: Encodes the peptide sequence at SEQ ID NO. 25119
aaagctggagctccccgcggtggcggccgctctagaactagtggatcccccgggctgcaggaattcgcacgagaccattacctgaacatcctaatcgaaaaacgaaatggttttgccttcgcttttgcttatgcgtacgcgcggcgaatcacggcgcccaccttccaaccggacttgagtcacttgactccgccgcgggattccccgccagatctcattctcgccccaaccctaaccgccgacggtggccatgatggccaccgagcccttgtccccggggaatctcgtcgaggacgtcgaaacactacccctggactcctcctccactctcgcggctacgacggacccgctgctccgcccacctcccccctcgtccaccttctctcccaccgccggtgagaaccatggcgcttttctggacgaggaggatgaggacgtggtggatgacttcacgcctccgctggctcccatgccgctacgccgcgacgagtcccgcgaggcggcaccgtggttcgctgagatcactgtctccgaggctaggaagcacgcggagcccgcgacggaagccgagggcgtcattcccggctcggacagctacgtctcctactcatcgccactcagggggccgacggaggccgagttccgcgtgcgaccccaattccgagaaggcggggggctcgccgaaccgactcggggaaacca

SEQ ID NO: 25119 - protein, 150 aa, Zea mays
  misc_feature: Ceres CLONE 1396589-F
MMATEPLSPGNLVEDVETLPLDSSSTLAATTDPLLRPPPPSSTFSPTAGENHGAFLDEEDEDVVDDFTPPLAPMPLRRDESREAAPWFAEITVSEARKHAEPATEAEGVIPGSDSYVSYSSPLRGPTEAEFRVRPQFREGGGLAEPTRGN

SEQ ID NO: 25120 - DNA, 703 bp, Zea mays
  misc_feature: Ceres CLONE 1396590-F
  misc_feature: Encodes the peptide sequence at SEQ ID NO. 25121
  misc_feature (395)..(395): n is a, c, t, g, unknown, or other
  misc_feature (488)..(488): n is a, c, t, g, unknown, or other
  misc_feature (508)..(508): n is a, c, t, g, unknown, or other
  misc_feature (659)..(659): n is a, c, t, g, unknown, or other
  misc_feature (700)..(700): n is a, c, t, g, unknown, or other
ggagctccccgcggtggcggccgctctagaactagtggatcccccgggctgcaggaattcgcacgagaccattacctagaacatcctaatccaaaagaaggggaggaatcccttcctccgcgagtcgcgagccgtggagatccgtcccactccacccctccgctccgccccagacctcgctacaaacctgccgcgaaaatagcagccgcccgtttgctctctcccgtctccgcactcctcccgcgatgagcgacccgcggggccgcgccgccggtcccgaccgctacggggacgaaccgcacgacctcccgctcgccgaggacgcaaacggcgaggaagcgtggcagacgcccgagaaagaggcggttgccgtgtcggaaggggccgctgcgcgnagtggggatacgaccccggacgctgaacaggagagcgatgacggagaggaaggagtgggctccccggatcaggcggaacccaatgcgagcggngagggcgtaccgcccgtggncgcgactgtggagccggatgggattgttagcggcgcaaaggtggagacgaacagcgaggacgccatcagccatgacgccgacgagggaggaggaggacgacgaccatgactccacccaggatgcgtctccgatagccaaggtgaatggggnaggcgaaaagtgcccccttcaccggctggaggtggcaccgncac

SEQ ID NO: 25121 - protein, 123 aa, Zea mays
  misc_feature: Ceres CLONE 1396590-F
  misc_feature (88)..(88): Xaa is any aa, unknown, or other
MSDPRGRAAGPDRYGDEPHDLPLAEDANGEEAWQTPEKEAVAVSEGAAARSGDTTPDAEQESDDGEEGVGSPDQAEPNASGEGVPPVXATVEPDGIVSGAKVETNSEDAISHDADEGGGGRRP

SEQ ID NO: 25122 - DNA, 651 bp, Zea mays
  misc_feature: Ceres CLONE 1396591-F
  misc_feature (386)..(386): n is a, c, t, g, unknown, or other
  misc_feature (481)..(481): n is a, c, t, g, unknown, or other
aaagctggagctccccgcggtggcggccgctctagaactagtggatcccccgggcttgaggaattcgcacgagaccattacctagaaatcctaatcgaaaaacgatacaaaacacaagttctcgggggacagagaagtagcgcagctagatccagcgttcggcgccagagacacccgacatccttcgtcattgtctccggttgcaatcaagggagtagtgatggacggtgcttgtggcggtggcggcagtggccgccgccgtggtgttgtgcttcatcttgcggcggtggcgcgcggcagcttgcagtgggttctacacacgagctgccccacccgagtcctggtccgcagggcgtggcgagcgcttcgtcacgattcgggatcgncgcgggctcatccgctcatttcacgactgcttcgtcaggggttggacgcatcggtgttgtcacttccgcaacacaggggggagggggagcgccgnccaacaaaccgaggcctccaggggttcccaggggatcaaacccgcgaaaaggggcggggggaaccaaaaatttcccccaaaaaaggggttctttggggcgaaaattttataatctttttgggggggggggggaagatttttatctcttccggggagaaatctttggttta

SEQ ID NO: 25123 - DNA, 673 bp, Zea mays
  misc_feature: Ceres CLONE 1396594-F
  misc_feature: Encodes the peptide sequence at SEQ ID NO. 25124
  misc_feature (252)..(252): n is a, c, t, g, unknown, or other
  misc_feature (259)..(259): n is a, c, t, g, unknown, or other
  misc_feature (269)..(269): n is a, c, t, g, unknown, or other
  misc_feature (288)..(288): n is a, c, t, g, unknown, or other
  misc_feature (302)..(302): n is a, c, t, g, unknown, or other
  misc_feature (379)..(379): n is a, c, t, g, unknown, or other
  misc_feature (406)..(406): n is a, c, t, g, unknown, or other
  misc_feature (425)..(425): n is a, c, t, g, unknown, or other
  misc_feature (430)..(430): n is a, c, t, g, unknown, or other
aaagctggagctccccgcggtggcggccgctctagaactagtggatcccccgggctgcaggaattcgcacgagaccattacctagaacatcctaatcgaaaaaccttgtctacaagggttttccgctgtcttatcccttcgtccacgctccctgcagccgccgcccaaaccctagcaacccgtcctccgccatggccgacgaccactactcctctaagaggaagtacgacgacccctcgccgccgccgcggngcacggngttctcttcnggcccgccgcctggctcgncgctcgcggggggngccccgtcgtacaacagcgtggcaccgccccccgatgagatccagctcgcgaagcagcgcgcgcaggaggatcgcgncgcggatcttaaaacgcgcagagggcnaggcgtcctcgcgtcgacnacggngacgatgacagcgcgggctttcggggaggcctgggcagacttggggggcggtgcccgcatcgggggggggaggaatcggtttttcgtcccttggggggggggggggaacgggggttttcaatccccaattatttttcttgaggaaggggcacctcgaactcccctttaggggggggattccgggggccccggcaaaaggattggattcccaagggggggggggtggggggttttctattggaa

SEQ ID NO: 25124 - protein, 135 aa, Zea mays
  misc_feature: Ceres CLONE 1396594-F
  misc_feature (21)..(21): Xaa is any aa, unknown, or other
  misc_feature (23)..(23): Xaa is any aa, unknown, or other
  misc_feature (33)..(33): Xaa is any aa, unknown, or other
  misc_feature (63)..(63): Xaa is any aa, unknown, or other
  misc_feature (72)..(72): Xaa is any aa, unknown, or other
  misc_feature (80)..(80): Xaa is any aa, unknown, or other
MADDHYSSKRKYDDPSPPPRXTXFSSGPPPGSXLAGGAPSYNSVAPPPDEIQLAKQRAQEDRXADLKTRRGXGVLASTTXTMTARAFGEAWADLGGGARIGGGRNRFFVPWGGGGNGGFQSPIIFLEEGAPRTPL

SEQ ID NO: 25125 - DNA, 713 bp, Zea mays
  misc_feature: Ceres CLONE 1396596-F
ggagctccccgcggtggcggccgctctagaatagtggatcccccgggctgcaggaattcgcacgagaccattacctataacatcttaatcaaaaaatgcgaccggcggcggcccaaggttcatcgatcgccgatcatcgcctagtgaggatgaaactagggatcaactcaccagggatgaactacgtcgacgcccgaatgcaattgacccaagtggcggtgccgcagcttgttcattaccagcgccgaccaccgacatcggcctgagtggcaaaggacgggtgcaaacgcgatgatacaacgacggcggcgtgagtaactccaccaggaggtggaacagctgaatccagtggctatcccaccagcagacggcgcacattatcctgtagcgcgccctgcagcccagtagctccatggccgtcgccaacttctgcgtcttcgtccccccccaggtcgaggagctgcttggggaaactgctgttgtcgaaggaaaagaccgccaagctggaggaccagaaaaaaaggaggaaaaagtccgccgccccctaattttcgacagaagccgaatcaatgcaagaccatgttccttcttcacccaggacagggaaagctgaagaagtacctgcgtcacggttgttggacctagcaaaccgaatttcccctggtgcgtcggcagccaaaaaggcccttggcggtggttcggagaaaaaaaat

SEQ ID NO: 25126 - DNA, 743 bp, Zea mays
  misc_feature: Ceres CLONE 1396599-F
  misc_feature: Encodes the peptide sequence at SEQ ID NO. 25127
  misc_feature (279)..(279): n is a, c, t, g, unknown, or other
  misc_feature (280)..(280): n is a, c, t, g, unknown, or other
  misc_feature (297)..(297): n is a, c, t, g, unknown, or other
  misc_feature (309)..(309): n is a, c, t, g, unknown, or other
  misc_feature (326)..(326): n is a, c, t, g, unknown, or other
  misc_feature (704)..(704): n is a, c, t, g, unknown, or other
  misc_feature (705)..(705): n is a, c, t, g, unknown, or other
ggagctccccgcggtggcggccgctctagaactagtggatcccccgggctgcaggaattcgcacgagaccattacctagaacatcctaatcgaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccnnactctccgatgcgctgnaacagatcaggntcgagagtctcactgancagagcaggctcgatgcgcagcctgagcttttcatccaccttggccaagacaaggcacgaacccgctttccatatcgaagggggtttcggaatggacaagcccaactttgaaaaaaacccgggaaccttccccggggcgggaccaaagagtttttggaaccctttccgcccgcggtcttggtgccccttttggggcaataggggggggggttttttcggttcaccaccccgcccccaaaaaagtgggggcccccccccaaccaaaaaaaaaaaaaaaaagggggggggcccccccggggggggggttttttttttttctcttggccccggggggggcagggggggggggggaagcaaaaaacctttcttccttccccnnaaattttttttttttttgtgggggggcgcccccccgag

SEQ ID NO: 25127 - protein, 90 aa, Zea mays
  misc_feature: Ceres CLONE 1396599-F
  misc_feature (39)..(39): Xaa is any aa, unknown, or other
  misc_feature (45)..(45): Xaa is any aa, unknown, or other
  misc_feature (49)..(49): Xaa is any aa, unknown, or other
  misc_feature (54)..(54): Xaa is any aa, unknown, or other
MASETETFAFQAEINQLLSLIINTFYSNKEIFLRELISXLSDALXQIRXESLTXQSRLDAQPELFIHLGQDKARTRFPYRRGFRNGQAQL

SEQ ID NO: 25128 - DNA, 712 bp, Zea mays
  misc_feature: Ceres CLONE 1396602-F
  misc_feature: Encodes the peptide sequence at SEQ ID NO. 25129
  misc_feature (276)..(276): n is a, c, t, g, unknown, or other
  misc_feature (358)..(358): n is a, c, t, g, unknown, or other
  misc_feature (393)..(393): n is a, c, t, g, unknown, or other
  misc_feature (406)..(406): n is a, c, t, g, unknown, or other
  misc_feature (407)..(407): n is a, c, t, g, unknown, or other
  misc_feature (412)..(412): n is a, c, t, g, unknown, or other
  misc_feature (413)..(413): n is a, c, t, g, unknown, or other
  misc_feature (418)..(418): n is a, c, t, g, unknown, or other
  misc_feature (435)..(435): n is a, c, t, g, unknown, or other
tcaccgcggtggcggccgctctagaactagtggatcccccgggctgcaggaattcgcacgagaccattacctagaacatcctaatcgaaaaattgccatctctttcaatcaccttcttcgtttcatcctctgattctccccctgctggtctgctctgctcccatcccatggagcccgacgccgcccaaaaccctagccccagccccgtccccccgcccatctccgcctactaccagacgcgcgccgaacaccacgccgtcgtaactagcgactggntcgcccacgccgccgccgcagccgcagccttccccggcgccgataccgcccgatgcgccccgcccccgtcccccgggggcgncgccgtgatcgaagagttcaacttctggcgccgcnagcccgaagccgnncgagnncgtgncggcatcatggttctcngcgccgtcttccggtccggagggccacaacatgatggaggtcgagatcgagctcaagaaggatttgaacagctccaaggctgggaggcaacaaccttttcctttcgggggttgggaattggcccgggggtttgaaccagggcccccatttttggaaaaggaaattttgagcgccaaaatcccggttatttgggcggggaaaaaaatttgggaaaaatttttaagggcccccaaaaaattggagggttttaccggtttttttttttgggggggccaaa

SEQ ID NO: 25129 - protein, 82 aa, Zea mays
  misc_feature: Ceres CLONE 1396602-F
MMEVEIELKKDLNSSKAGRQQPFPFGGWELARGFEPGPPFLEKEILSAKIPVIWAGKKIWEKFLRAPKKLEGFTGFFFWGGQ

SEQ ID NO: 25130 - DNA, 775 bp, Zea mays
  misc_feature: Ceres CLONE 1396603-F
  misc_feature: Translation starting site: 231
  misc_feature (399)..(399): n is a, c, t, g, unknown, or other
  misc_feature (416)..(416): n is a, c, t, g, unknown, or other
  misc_feature (432)..(432): n is a, c, t, g, unknown, or other
  misc_feature (435)..(435): n is a, c, t, g, unknown, or other
  misc_feature (439)..(439): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (465)..(465): n is a, c, t, g, unknown, or other
  misc_feature (466)..(466): n is a, c, t, g, unknown, or other
  misc_feature (468)..(468): n is a, c, t, g, unknown, or other
  misc_feature (475)..(475): n is a, c, t, g, unknown, or other
  misc_feature (545)..(545): n is a, c, t, g, unknown, or other
  misc_feature (546)..(546): n is a, c, t, g, unknown, or other
  misc_feature (559)..(559): n is a, c, t, g, unknown, or other
  misc_feature (577)..(577): n is a, c, t, g, unknown, or other
  misc_feature (619)..(619): n is a, c, t, g, unknown, or other
  misc_feature (657)..(657): n is a, c, t, g, unknown, or other
  misc_feature (668)..(668): n is a, c, t, g, unknown, or other
  misc_feature (671)..(671): n is a, c, t, g, unknown, or other
  misc_feature (677)..(677): n is a, c, t, g, unknown, or other
  misc_feature (678)..(678): n is a, c, t, g, unknown, or other
  misc_feature (685)..(685): n is a, c, t, g, unknown, or other
  misc_feature (686)..(686): n is a, c, t, g, unknown, or other
  misc_feature (690)..(690): n is a, c, t, g, unknown, or other
  misc_feature (691)..(691): n is a, c, t, g, unknown, or other
  misc_feature (708)..(708): n is a, c, t, g, unknown, or other
  misc_feature (712)..(712): n is a, c, t, g, unknown, or other
  misc_feature (722)..(722): n is a, c, t, g, unknown, or other
  misc_feature (747)..(747): n is a, c, t, g, unknown, or other
aagctggagctccccgcggtggcggccgctctagaactagtggatcccccgggctgcaggaattcgcacgagaccattacctagaacatcctaatcaaaaaaccggagagatctggtctgccattccctcgctccttcccgtgaaccacaaacctaacgcggagcggcgcgggccggccgccgggcgaggtgcgcgtagctgccgtcgattgtcgccggatccatccaccatgggcggtggcaacggccagaagtccaagatggcccgcgagcgcaacttggagaagaacaagggggccaaggggagccagctcgagaccaacaagaaggccatgagcatccagtgcaaagtgtgcatgcaaacattcatgtgtaccacgactgaagtgaaggccgggnccaacgccgaggcaagnttttcctccagggaanggntttntnnnntttgttttccccctttttggnncnggttccnggccctggtccttcctcggccggtggccggggtttgggcgcctcgcggtctttttccggggcgccgcggnnctgcccccctcgntgtggcctctgggggcgngggcccgtggcccggcgtccggggtcctccggggccccggcncggggggcgggggtcccttccggccggtcggggttttnggggtctgccnggngaaagnngtttggnncccnnggtttgcccccctggcntggntggggtgccnttttcgttccttccggcccttttgncgggggttgggaggggctccttttctgg

SEQ ID NO: 25131 - DNA, 649 bp, Zea mays
  misc_feature: Ceres CLONE 1396606-F
  misc_feature: Encodes the peptide sequence at SEQ ID NO. 25132
cgctcttgaactagtggatcccccgggctgcaggaattcgcacgagaccattacctagaacatcctaatcgaaaaaaaccctaaccccatcccgcactccccccctcccccaacacgcgcgtgctttcttagccgctaagcatatccctccccgccacgatctcgatggtggagatgtctgtggtggagctcaggacgctgccgctcggcttccgcttccaccccaccgacgaggagctcgtcacccactacctcaagggcaagatcaccggcaggatcaactccgagtccgaggtcatccccgagatcgacgtctgcaagtgcgagccgtgggacctcccagataagtccctgatccggtccgacgatcctgagtggttcttcttcgcccccaaggaccgcaagtaccccaacggtagcaggtcgaacagggccaccgaggcgggatactggaaggctactggcaaggacaggataatcaaatccagggcgacaagcgcaagcagcataccatcggtatgaagaagaccctcgtcttcccacgtggtcgtgcccccaagggcgagcgcacggggtggattatgcacgagtaccgcacccacgagcctgagttcgagtccgcgaagcagggttggttatgttctttatc

SEQ ID NO: 25132 - protein, 118 aa, Zea mays
  misc_feature: Ceres CLONE 1396606-F
  misc_feature (12)..(116): Pfam Name: NAM Pfam Description: No apical meristem (NAM) protein
  misc_feature: The sequence is a functional homolog of SEQ ID NO 1402 in the 10/666,642 US patent application
  misc_feature: The sequence is a functional homolog of SEQ ID NO 2016 in the 10/374,780 US patent application
  misc_feature: The sequence is a functional homolog of SEQ ID NO 262 in the 10/714,887 US patent application
  misc_feature: The sequence is a functional homolog of SEQ ID NO 262 in the 11/435,388 US patent application
  misc_feature: The sequence is a functional homolog of SEQ ID NO 322 in the 10/412,699 US patent application
  misc_feature: The sequence is a functional homolog of SEQ ID NO 78 in the 10/286,264 US patent application
MVEMSVVELRTLPLGFRFHPTDEELVTHYLKGKITGRINSESEVIPEIDVCKCEPWDLPDKSLIRSDDPEWFFFAPKDRKYPNGSRSNRATEAGYWKATGKDRIIKSRATSASSIPSV

SEQ ID NO: 25133 - DNA, 699 bp, Zea mays
  misc_feature: Ceres CLONE 1396607-F
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (588)..(588): n is a, c, t, g, unknown, or other
  misc_feature (589)..(589): n is a, c, t, g, unknown, or other
aagctggagctcaccgcggtggcggccgctctagaactagtggatcccccgggctgcaggaattcgcacgagaccattacctagaacatcctaatcgaaaaatccccatcgcgatcgcctctctccagctaagcgatgaagaaccctaaccctcctccctcgcgtccctccgccgcaggcaaggagccccccgcaggcatggcgccgccccgcaaatctcgctggggcccaccgccaccgggcgttgccggcgacaaggccgcgccatccacctccgcccgccgcaccccgaccccgacccccacccgcacagcggactccaggcgccatccgggggcccctcacgcgccagcaccgcacgcccgcaaccccgggtcgcaggcggtcgctctccggccgcaggctcgtccgcaacctccggcggtggagactcctcccccgcagccgtacggcttccacaacctggaccgccgcgtcatgcccctcgccgacggcaccgtccgaacctacttcgccctgccccctgactacagctttcgagccggtgcccctggcacccctcccacacgcctcctccccgnnngcgcnncggactctggccgccgcgctacatttgcagatgcccgcgcacgaggctaggcgcaacaccctgcgaacaggacgagggcttcgcgagcacccaagcagcggcggctcgac

SEQ ID NO: 25134 - DNA, 693 bp, Zea mays
  misc_feature: Ceres CLONE 1396611-F
  misc_feature: Encodes the peptide sequence at SEQ ID NO. 25135
  misc_feature (505)..(505): n is a, c, t, g, unknown, or other
  misc_feature (506)..(506): n is a, c, t, g, unknown, or other
ggagctccccgcggtggcggccgctctagaactagtggatcccccgggctgcaggaattcgcacgagaccattacctagaacatcctaatcgaaaaagagaccagagagaggccaatgcgagggagtagctcgcggcggaccagagaccagagagcgagagcgagcaaagctcacaaggcgaagcggaattgattgcgaccaccaccaccacgtcttctccacctccgtccgatccgtcgtcaccaagccaccatcattggcgccaccgcgccgcccgcccagctgcgcattcttaactgtttctctcttggcttatcggcgaagtgttgcggttgcgggggtactggagtgcggagagcagcgcggcggtacgtgtgcgttgctgcgctgtgctgccacagtgagctagggggagagcgagggggaggaagcaccacccaccacaccacctccattagaggggctcacgcgccgcccctccgcctccacgaaaaagcgaggcgnnagcgagtgagcaggggcgtacgtccgtcgtcaaggccatctctctcctcctcacttcctcccctcacggggacagccacgtacaaaggcagctcggcaacgcccagcacctccctcgccgtgcgcctttaaagacagcgcgcgacaagcttaaagctgcagaggaggtgcacagagggcagagccgt

SEQ ID NO: 25135 - protein, 42 aa, Zea mays
  misc_feature: Ceres CLONE 1396611-F
GAPRGGGRSRTSGSPGLQEFARDHYLEHPNRKRDQREANARE

SEQ ID NO: 25136 - DNA, 716 bp, Zea mays
  misc_feature: Ceres CLONE 1396612-F
  misc_feature: Encodes the peptide sequence at SEQ ID NO. 25137
  misc_feature (591)..(591): n is a, c, t, g, unknown, or other
  misc_feature (665)..(665): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (695)..(695): n is a, c, t, g, unknown, or other
  misc_feature (696)..(696): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
aagctggagctccccgcggtggcggccgctctagaactagtggatcccccgggctgcaggaattcgcacgagaccattacctagaacatcctaatcgaaaaaccaaaagaaagaaaccaactaaaatcccaaaagagaggaaaggcataaacagacggtagaaggaagaaagggacgctcgtctcggctcgtcacgtgccgccgccatggctgctctgggccgtggcctgcccctcctcctgctcctcctcctcgccgtagcgggggccgccaacgccgcggcggcgcccggcggcatgtccatcatcacctacaacgaggagcacggcgcgcgggggctggagcggacggagccggaggtgcgggccatgtacgacctctggctcgcggagcacggccgcgcctacaacgcgctgggcgagggcgagggcgagcgcgaccgccgcttcctcgtcttctgagacaacctccgcttcgtcgacgcgcacaacgagcgcgccggcgcccgcggcttccgcctcgggatgaaccagttcgccgacctcaccaacgacgagttccgcgccgcgtacctcggcgccatggtcccgncgccgccccgggaagccgttctggggggggaagagtactgccacgactgcgccgccgagagctgctgagagtanttttnnnnnnnaaaaaaaaaaaaaggcccnnctnnnccccccaaaagaaaa

SEQ ID NO: 25137 - protein, 84 aa, Zea mays
  misc_feature: Ceres CLONE 1396612-F
  misc_feature: SWISSPROT Homolog: EC 3.4.22.14 Actinidain
MAALGRGLPLLLLLLLAVAGAANAAAAPGGMSIITYNEEHGARGLERTEPEVRAMYDLWLAEHGRAYNALGEGEGERDRRFLVF

SEQ ID NO: 25138 - DNA, 710 bp, Zea mays
  misc_feature: Ceres CLONE 1396613-F
  misc_feature: Translation starting site: 184
  misc_feature (605)..(605): n is a, c, t, g, unknown, or other
  misc_feature (687)..(687): n is a, c, t, g, unknown, or other
  misc_feature (697)..(697): n is a, c, t, g, unknown, or other
tggagctccccgcggtggcggccgctctagaactagtggatcccccgggctgcaggaattcgcacgagaccattacctagaacatcctaatcgaaaacccttttttcctgcgaccaatccgcgcgcttttgtttttgttcctgctcctcggccctcgcaccgcgcgccgccgacgccgcatccatgaacggtgacggcagcaaggaggacgccaacaggcgcctcgagtgggccaccttgaacatggagcgcgccgtcgtcgtgagcgagacgacgaagggcgacggcaatggcaatgcaggccggaaggcgccgataagcatcgtccggctcttcttggcctgcatggtctccggcggatccagtacggctgggcgctgcagctctccctcctctcgccctactctcagactcttgggatctcgcacagctacgtgtctctgacatggatctgcgggcctatcgccgggatttgtggtgcaacccatcgtgggctactacagcgaccggggcacctcgaagatgggggccggaggaggccctccatccctcgcgggatgcatcatctctgcctctctgggggtggggggatcgggtttctcggncggacatcggggcggcgcctcggcgacaccagggagcactgcagtacgttcacgggctcccgctggtcccgcccgcgccgtnctacattggncggattctgggtc

SEQ ID NO: 25139 - DNA, 678 bp, Zea mays
  misc_feature: Ceres CLONE 1396615-F
  misc_feature: Encodes the peptide sequence at SEQ ID NO. 25140
  misc_feature (545)..(545): n is a, c, t, g, unknown, or other
  misc_feature (581)..(581): n is a, c, t, g, unknown, or other
  misc_feature (644)..(644): n is a, c, t, g, unknown, or other
ggagctccccgcggtggcggccgctctagaactagtggatcccccgggctgcaggaattcgcacgagaccattacctagaacatcctaatcgaaaagtttcctctctccaattcccacccgcgtcaaggagcttctcgtctgagcccgagctaacaagctcaccggcgggcaggatgctggcggcgtccaccaaggtcggctctaggctggcctctccgcacgcctccttgtccgccggtgctgcagcggcggcgctggcgagctcccccgtgctgggctctgggatgctcccaggcgccgggttcggcgagacggggagtcaccacgcggcggacgcgccgccgccgctgccttgcagttcctcgggcgattcaagggaatattatcagtggaagagactggtgaatcaaaggcagtcaacgctagatggaggcaaagtgcctgctgcattgggccaccatggtttttggtgcgggcttttcctcacggaaccaacatatctacagatatttttcatcttctcatcaagggagtatatgggccngggagcaaggttctacatgacctgccagggtatgtnaaaaattgtggaactagggccacgagatggtctacagaatgagaaggacatcgtgccacaccntgtaaagggtgagcttatacgaagattggcacat

SEQ ID NO: 25140 - protein, 168 aa, Zea mays
  misc_feature: Ceres CLONE 1396615-F
  misc_feature: SWISSPROT Homolog: EC 4.1.3.4 Hydroxymethylglutaryl-CoA lyase
  misc_feature (124)..(124): Xaa is any aa, unknown, or other
  misc_feature (136)..(136): Xaa is any aa, unknown, or other
  misc_feature (157)..(157): Xaa is any aa, unknown, or other
MLAASTKVGSRLASPHASLSAGAAAAALASSPVLGSGMLPGAGFGETGSHHAADAPPPLPCSSSGDSREYYQWKRLVNQRQSTLDGGKVPAALGHHGFWCGLFLTEPTYLQIFFIFSSREYMGXGARFYMTCQGMXKIVELGPRDGLQNEKDIVPHXVKGELIRRLAH

SEQ ID NO: 25141 - DNA, 698 bp, Zea mays
  misc_feature: Ceres CLONE 1396616-F
  misc_feature: Translation starting site: 243
  misc_feature: SWISSPROT Homolog: EC 2.7.7.27 Glucose-1-phosphate adenylyltransferase
aaagctggagctccccgcggtggcggccgctctagaactagtggatcccccgggctgcaggaattcgcacgagaccattacctagaacatcctaatcaagaaccggctcgcaccgtcgcggccaccgattctctctcgtccatggcatcgctccggctcccagcgcaatcgatccatccgtccctaggtgtgcttcagctatgcagctcagcaacgtgcttcccctatagggaaaagcgtgtatgagcccagtgaggagaggcagtgcacgttatgacagcgaaaggacgaggaacaactgctgcagcatcaggcgcaacaaggcactgacgaggatgtgtttcagtgcaagggatgctgtgagcagcgcgcagtgtgtgctcacatcagatgctggtgcagacactcttgcctgtcgaacatcctttccgaggaattatgctgatcctaatgaagacgctgccgtcattttgggtggtgccaccggtactacatctgttccctctcacaagcacgaggcccacccctgctgttcctattggaggatgttacaggcttattgatatccccatgagcgactgtttcacagtgacacaaacacgatattagttatgactcagtacgactcagcttctcttgaccgtcagattcatcgtcactatcttggtgctgagatcaacttcacagctggatcaggg

SEQ ID NO: 25142 - DNA, 695 bp, Zea mays
  misc_feature: Ceres CLONE 1396617-F
  misc_feature (331)..(331): n is a, c, t, g, unknown, or other
  misc_feature (452)..(452): n is a, c, t, g, unknown, or other
  misc_feature (462)..(462): n is a, c, t, g, unknown, or other
  misc_feature (695)..(695): n is a, c, t, g, unknown, or other
ggagctccccgcggtggcggccgctctagaactagtggatcccccgggctgcaggaattcgcacgagaccattacctagaacatcctaatcgaaaagacccaggcaagaggcaacacagcaagcagcagaaaacatctccgggagtccgaaccacccacaggcggcaggccacaccacaggttccgcttccgcacagctgctagctagctagcgttcgcaagtagcagtagcgttccatcgaggtcgaggcaatgacggtgatggccgaagtagtctcgaccaccggcgcggcgctccggagcccggcctcgcagccgctgccggccgcgntgaagaacgcagacgctgagaagctccagttcatcgaggagatgacctccaacgtggacgccgtgcaggagcgcgtgctgggggagatcctcgcccgcaacgccggcaccgagtacctcgncaagtacggnctcgccgccgctactacggaccgcgccatcttcccgcgccaaggtggcgatggcgacgtacgaagacctgcagccgtacatccgccgcattgccgacgcggaccgctcgcccatcctggtcggggcacccggtctccgagtttcttcacagctccgggacgtccgccggggagcgcaagctcatgcccaccatcgaggacgagctcaaccgcccgcaggtgctgtaacagctn

SEQ ID NO: 25143 - DNA, 675 bp, Zea mays
  misc_feature: Ceres CLONE 1396620-F
  misc_feature: Encodes the peptide sequence at SEQ ID NO. 25144
  misc_feature (292)..(292): n is a, c, t, g, unknown, or other
  misc_feature (296)..(296): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (525)..(525): n is a, c, t, g, unknown, or other
aaagctggagctccccgcggtggcggccgctctagaactagtggatcccccgggctgcaggaattcgcacgagaccattacctagaacatcctaatcaaaaatgccacattgccaccaagccacagttccacctttcgattcatgcacgctcagtcatgggcgccctccggagtttagccattctcctaacccggagttcctcgtggccgggctgtgcttcgtctcccttctcggccctgcgccacgcgatgcgtgagcggcggcaacgcgcccccctgagctggcctgtgntggncatgctcccgttcgtgctcgcgaacccctcggcgctctacggacgcatcaccgacgcccttcacggnnntcggtgcacgctcatgttccgcgggccgtggctcgcccgggcggacttcttgctgactggggacccggggggccgtcagcactgcctggggttcaaccacggggctacgaaaggggcccagactttggggaaaaagtcgacctctgggcgacggctgtgnttgcgagccccccccctgggggcggcccaagggaagttcccgccaccgctcgaaacccccgggggtttggggtttttcccttgggaccatggggcaaaaaaaggggggggtttttttggctttttttggatggggccccggaaaaaaaaa

SEQ ID NO: 25144 - protein, 173 aa, Zea mays
  misc_feature: Ceres CLONE 1396620-F
  misc_feature (46)..(46): Xaa is any aa, unknown, or other
  misc_feature (47)..(47): Xaa is any aa, unknown, or other
  misc_feature (70)..(70): Xaa is any aa, unknown, or other
  misc_feature (123)..(123): Xaa is any aa, unknown, or other
MGALRSLAILLTRSSSWPGCASSPFSALRHAMRERRQRAPLSWPVXXMLPFVLANPSALYGRITDALHGXRCTLMFRGPWLARADFLLTGDPGGRQHCLGFNHGATKGAQTLGKKSTSGRRLXLRAPPLGAAQGKFPPPLETPGGLGFFPWDHGAKKGGGFFGFFWMGPRKKK

SEQ ID NO: 25145 - DNA, 670 bp, Zea mays
  misc_feature: Ceres CLONE 1396624-R
  misc_feature: Translation starting site: 546
  misc_feature: SWISSPROT Homolog: EC 3.4.23.12 Nepenthesin
ccgattgggtaccgggccccccctcgaggtcgacggtatcgataagcttgttttgttttttttttgaaacccaaaccaagccacggctttcaataacttaatagtagtactagatgacagtaaatttagttttttattaccaggacacgagcgctaacaaaagatcaagcagccagcttttggaattggaatttggagtgttacgtggactggactctggagtaattactggcctccactccgatccccgccatgccgacgtcgtgagacctcacgacggcgacgacgtgcatgactgccggcagaaccccagcctctccttctccagggcgtactccaccaggtagttctgctgctggaagctgccgaggatgatggccgggccgctgccctcgttcccagccccggagcctccaccgaagtcggtgaccactgcgaggcagatggcctcgacggcgccgcgccccgcgaccacaaaatagttctcgaccgggagctgcatcaccgccccgccctcgaagtggaacgacagctccggcagcgccatggacctggcgccctgcggcagcgcgaaacaagggtgcagccccagcccgtcctccgcgtccttggaccgcttgtaccgtccgaccaccgtagccaccaccgagtccgccacgggctggaacac

SEQ ID NO: 25146 - DNA, 698 bp, Zea mays
  misc_feature: Ceres CLONE 1396631-F
  misc_feature: Translation starting site: 417
  misc_feature (456)..(456): n is a, c, t, g, unknown, or other
  misc_feature (481)..(481): n is a, c, t, g, unknown, or other
  misc_feature (510)..(510): n is a, c, t, g, unknown, or other
aagctggagctccccgcggtggcggccgctctagaactagtggatcccccgggctgcaggaattcgcacgagaccattacctagaacatcctaatcgaaaaattgttgattgattgatcctccccgcctcactcctttggctcctcgcctcgtgctcgctcggtcccctcggcctggggaggagggcagcagaaaccctaacggctcaggccgagagggggttagatgctccaaggttcgagagggaaggttaggatagagatgcgccatcgactatgggctgcgtcttcggacggccgtctgcgtcatccgctgcagcgccgaagaacaatggagtcaaggggaggtctgccccgcattcctaagtgccgtggccatccgcagtcgcagccacaggaaaggacgacaggccgcgtatggacgctaacggcgcacatgatcacggcaccgatcggntccgcgtcgctgctgctgccgtggncgatgacgtagctggcgtgtgtgcacggngcgttgaccctgctgctcttcaggccatcaccttcgacaccctgcgcctcctcgcagactgcaacagcgtgggagactccgtgacgggcaagcgaaatacggctacgccgggggcgaaaaagagaaactggggagcctggaacttaagggttctggggtttctgccagtacggcaaaatggttcgaaa

SEQ ID NO: 25147 - DNA, 721 bp, Zea mays
  misc_feature: Ceres CLONE 1396634-F
  misc_feature: Translation starting site: 283
  misc_feature (393)..(393): n is a, c, t, g, unknown, or other
  misc_feature (450)..(450): n is a, c, t, g, unknown, or other
  misc_feature (494)..(494): n is a, c, t, g, unknown, or other
  misc_feature (529)..(529): n is a, c, t, g, unknown, or other
  misc_feature (557)..(557): n is a, c, t, g, unknown, or other
  misc_feature (558)..(558): n is a, c, t, g, unknown, or other
  misc_feature (566)..(566): n is a, c, t, g, unknown, or other
aaactggagctccccgcggtggcggccgctctagaacaagtggatcccccgggctgcaggatttcgcacgagaccattacctaaaacattcctaaatcgaaaaaaggagggggtgtcgcttaaactagcgaatccttccgccaagattccgtgcacctcgaccgccgccgccgctattctgtttgtccccgcccccgcgaccgcggcagcctagcaggaggggaggatccatgtctagtttctagagcagctgcttgcgtcccttgcaaatcacatcgaccgatggggatacccagcgacgacgtggtgcaaatccgccacgccgacgccgctggcgagcccaccgtcgtcaccgtcagctgccccgacaagacgggcctcggctgcgacctnctgccgggtcgtcctcctcttccgcctcagcgtcgtcaagggagacatgagcacggnacgggcggtggtgctacatcgtgctctgggtttctgccacgcgnggggcggccggtgcccgtgccatgggacctactcnaaggacaggttgcttcagctctgcccgnncgcgccgnccgttcggatttcgacacgcgtaccctcggcagcgctggcctaacaggaccttgcgcctccccccacaaagctcttcttgctcaagctatgctgctttccaccggatgggactctttgcatgatgtgaaccccgtggtctgtgcgagctaagctc

SEQ ID NO: 25148 - DNA, 684 bp, Zea mays
  misc_feature: Ceres CLONE 1396636-F
  misc_feature (480)..(480): n is a, c, t, g, unknown, or other
  misc_feature (545)..(545): n is a, c, t, g, unknown, or other
  misc_feature (548)..(548): n is a, c, t, g, unknown, or other
  misc_feature (621)..(621): n is a, c, t, g, unknown, or other
  misc_feature (644)..(644): n is a, c, t, g, unknown, or other
  misc_feature (648)..(648): n is a, c, t, g, unknown, or other
  misc_feature (649)..(649): n is a, c, t, g, unknown, or other
tccccgcggtggcggccgctctagaactagtggatcccccgggctgcaggaattcgcacgagaccattacctagaacatcctaatcaaaaagatctacctgtctgttcttcgatcgagtctgagagatttgggaggaggagggaaacaaagcgaaagagcccatcttttttgtctttttggttcggtttcgtggttgcttcttttggaccccgcggaggagcccaccgtttctacaaaaacccaatctttgctgccttctcagcggtcgagatcgataggtttccagatctgaggctccgtgttctggctgtgagatcggaggcgcagcaatccgagcacgcagctagtagggaaagtatccgagaaaagttgcagattttgctgggggcaacggagcgagaacaagttactgcagaaggaaagggcaaaggtgggggaggcgcccgagatgagggatgctatcagctctgatggattanttgaaatcttgctcgggtccggcatcaccggctgggcgtccccgcaaggatcggatgccaccggnccngcagacgggctcctgtggtacaaggacggcgggcaggtcgtcgatgttgagttctccatgggcgtgtcccagncataacctattggaggacatagncagnntgaatcggggcgctagcacatcggagcctgactgg

SEQ ID NO: 25149 - DNA, 716 bp, Zea mays
  misc_feature: Ceres CLONE 1396637-F
  misc_feature: Encodes the peptide sequence at SEQ ID NO. 25150
  misc_feature (361)..(361): n is a, c, t, g, unknown, or other
  misc_feature (519)..(519): n is a, c, t, g, unknown, or other
  misc_feature (543)..(543): n is a, c, t, g, unknown, or other
  misc_feature (559)..(559): n is a, c, t, g, unknown, or other
  misc_feature (579)..(579): n is a, c, t, g, unknown, or other
  misc_feature (596)..(596): n is a, c, t, g, unknown, or other
  misc_feature (603)..(603): n is a, c, t, g, unknown, or other
  misc_feature (642)..(642): n is a, c, t, g, unknown, or other
  misc_feature (662)..(662): n is a, c, t, g, unknown, or other
  misc_feature (712)..(712): n is a, c, t, g, unknown, or other
tccccgcggtggcggccgctctagaactagtggatcccccgggctgcaggaattcgcacgagaccattacctagaacatcctaatcaaaaaacctgcaagcctcgagtggagctcttccacggccgcggtggagatggcggcgaatctggaggacgtgccgtcactggatctgatgcacgagctgctccgccgcatgaagtgcagctccaagcccgacaagcgcctcatcctcatcggtccacctggctctggaaagggaactcagtctcctattatcaaggatgaatattgcttgtgccatttagccactggtgacatgctgagggctgctgtggcggccaagacacctctaggtatcanagctaaagaagctatgaataagggagagcttgtttcagatgatttggttgtgggcattattgatgaagctatgaagaaaccctcatgccagaaaggtttcattcttgatggctttcctagaactgtgactcaagcacagaagcttgatgagatgttgncaaagcaagttgccaatggtgacnaagtcctgaactttgncattgatgatgctgtattgnaagaacggattactggntcgttgnatccactcagccagtggtaggacttaccactcaaaattngcacctccaacgtctccagnagttgatgatgtaactggagagcattgattcaaaggaagatgacacgctnaaag

SEQ ID NO: 25150 - protein, 162 aa, Zea mays
  misc_feature: Ceres CLONE 1396637-F
  misc_feature (33)..(156): Pfam Name: ADK Pfam Description: Adenylate kinase
  misc_feature: SWISSPROT Homolog: EC 2.7.4.3 Adenylate kinase
  misc_feature (76)..(76): Xaa is any aa, unknown, or other
  misc_feature (129)..(129): Xaa is any aa, unknown, or other
  misc_feature (137)..(137): Xaa is any aa, unknown, or other
  misc_feature (142)..(142): Xaa is any aa, unknown, or other
  misc_feature (149)..(149): Xaa is any aa, unknown, or other
  misc_feature (157)..(157): Xaa is any aa, unknown, or other
MAANLEDVPSLDLMHELLRRMKCSSKPDKRLILIGPPGSGKGTQSPIIKDEYCLCHLATGDMLRAAVAAKTPLGIXAKEAMNKGELVSDDLVVGIIDEAMKKPSCQKGFILDGFPRTVTQAQKLDEMLXKQVANGDXVLNFXIDDAVLXERITGSLXPLSQW

SEQ ID NO: 25151 - DNA, 707 bp, Zea mays
  misc_feature: Ceres CLONE 1396638-F
  misc_feature: Encodes the peptide sequence at SEQ ID NO. 25152
  misc_feature (257)..(257): n is a, c, t, g, unknown, or other
  misc_feature (258)..(258): n is a, c, t, g, unknown, or other
  misc_feature (259)..(259): n is a, c, t, g, unknown, or other
  misc_feature (315)..(315): n is a, c, t, g, unknown, or other
tggagctccccgcggtggcggccgctctagaatagtggatcccccgggctgcaggaattcgcacgagaccattacctagaacatcctaatcgaaaaacagtcagtccacacagcctacggcctgctctggctctgcctgtagagggctagacctacaagctacaactctgaaagtctgaacagtgcgccgcccaaccagagatggcgccgcatacccaccgcagccgccggcggcggcggtgtcgaggaggcgctgnnnagagccagcactctccggcaccgccacagcgctgccaaaggacgcgtcgaggaggnccagtccaacaacggggtcgcctgcgccgccgacgacgacgtggtaggggaacgcgctgtctgtggagcgcgcgttcgcggacccagcgattctgtcgtggcaggagcaactgacgttgcgcgccttcgtggtcatcttcttcctgggcatcatggtcagcgtcatcctgatgaagctcaacctcaccacggggatcatcccctcgatcaacgtctccgggagggtcctcggtttcttctttctaacgctctggaccgcgccatcaagagggttgagctctcaagtagtccttccggggccaggagaccccgtcatcccgacctggtgtgcccaacctacaaatcgccttcagggggggagttggctcctaacttgtttggatgaaccgaca

SEQ ID NO: 25152 - protein, 80 aa, Zea mays
  misc_feature: Ceres CLONE 1396638-F
MVSVILMKLNLTTGIIPSINVSGRVLGFFFLTLWTAPSRGLSSQVVLPGPGDPVIPTWCAQPTNRLQGGSWLLTCLDEPT

SEQ ID NO: 25153 - DNA, 678 bp, Zea mays
  misc_feature: Ceres CLONE 1396640-F
  misc_feature: Encodes the peptide sequence at SEQ ID NO. 25154
  misc_feature (405)..(405): n is a, c, t, g, unknown, or other
  misc_feature (543)..(543): n is a, c, t, g, unknown, or other
ggagctccccgcggtggcggccgctctagaactagtggatcccccgggctgcaggaattcgcacgagaccattacctagaacatcctaatcgaaaaaccacggccagaccagaccaccagagtgcctccaccctcgaggcctccagtgtccactgcctactcgccccacgccacccaaatcccgtcgggacgacgaagaagccaagccggtgcgccgtataaatctaaccaatcgccatccgcccaccccccaaatcccaccacccttttccccttccaaccctcgggatctctccggcccgccatggaagtgttctactacctcgtgttcggcgcgctcgccgccatcgtggcggcgctggagctcgccaagtccggcaaggaccgcgtcgccacctccccggncttcaactcatttaagaacaactacatcctcgtttactccctcatgatgtctggggactggctgcaggggccctacgtgtactacctctacagccagtacggcttcgacaagggcgacattgggcgcctcttcatcgncggcttcggttccctcatgctcttcggcaccatcgtcggatccctcgcggatagcaggggcggaaagaggcgtgggtcacgtactgcatcacctacttcctcagttggatcacaagcattctcccagtacaaggt

SEQ ID NO: 25154 - protein, 124 aa, Zea mays
  misc_feature: Ceres CLONE 1396640-F
  misc_feature (4)..(123): Pfam Name: DUF791 Pfam Description: Protein of unknown function (DUF791)
  misc_feature (34)..(34): Xaa is any aa, unknown, or other
  misc_feature (80)..(80): Xaa is any aa, unknown, or other
MEVFYYLVFGALAAIVAALELAKSGKDRVATSPXFNSFKNNYILVYSLMMSGDWLQGPYVYYLYSQYGFDKGDIGRLFIXGFGSLMLFGTIVGSLADSRGGKRRGSRTASPTSSVGSQAFSQYK

SEQ ID NO: 25155 - DNA, 702 bp, Zea mays
  misc_feature: Ceres CLONE 1396643-F
  misc_feature: Encodes the peptide sequence at SEQ ID NO. 25156
  misc_feature (271)..(271): n is a, c, t, g, unknown, or other
  misc_feature (492)..(492): n is a, c, t, g, unknown, or other
  misc_feature (510)..(510): n is a, c, t, g, unknown, or other
  misc_feature (578)..(578): n is a, c, t, g, unknown, or other
  misc_feature (630)..(630): n is a, c, t, g, unknown, or other
aagctggagctccccgcggtggcggccgctctagaactagtggatcccccgggctgcaggaattcgcacgagaccattacctagaacatcctaatcgaaaaaaatcgaattcgccatgggcatggctgctccgcgcgcgccgctgcctctcccccaactgctgctcctcctcgttgccgcgctcctcgccgccgctcccctccctagggcggccagggcggacgagttcgacgtccgccgccacctctccaccgtcaccaggtatgatgtnggccaggagtccagtagtgtcatctccatgccgtcaatcccagacgggtgccgtgtcattcacctcaatttagtggcaagacatgggactcgcgctcctaccaagaagcgcatcaaggagctggatagattggcagttcgactggaagcccttctgaaagaggcaaatcaggtccttgatagtgattctctgaagaaaattccatcctggattaaaggctnggaatcacgctggaaggntaggactaaaggtggtgagctgaattaagtgaaggggaaagagagctttaccatttagctaccagaantgagggagaggtttcaagatctatttgatgacgaatatcaccctgatgtatnatcaataagagcaacccagggtcctcgagcatcagctagtgcagtggcatttgggttgggactactttctgt

SEQ ID NO: 25156 - protein, 140 aa, Zea mays
  misc_feature: Ceres CLONE 1396643-F
  misc_feature: SWISSPROT Homolog: EC 3.1.3.8 3-phytase
  misc_feature (126)..(126): Xaa is any aa, unknown, or other
  misc_feature (132)..(132): Xaa is any aa, unknown, or other
MGMAAPRAPLPLPQLLLLLVAALLAAAPLPRAARADEFDVRRHLSTVTRYDVGQESSSVISMPSIPDGCRVIHLNLVARHGTRAPTKKRIKELDRLAVRLEALLKEANQVLDSDSLKKIPSWIKGXESRWKXRTKGGELN

SEQ ID NO: 25157 - DNA, 694 bp, Zea mays
  misc_feature: Ceres CLONE 1396644-F
  misc_feature: Encodes the peptide sequence at SEQ ID NO. 25158
  misc_feature (592)..(592): n is a, c, t, g, unknown, or other
  misc_feature (670)..(670): n is a, c, t, g, unknown, or other
aaagctggagctccccgcggtggcggccgctctagaactagtggatcccccgggctgcaggaattcgcacgagaccattacctagaacatcctaatcgaaaaattcgtccatcccacctaccatggccaccgcctccggcactgacgccggtgcccagccgcgcgacgaccccagcctcctccccttcgcgtccttctcgctcggcctctccatccgcgcgccggccacccccacactcgcctccgtcccctccaccctccacctccccactcaaatctctacactcgccgtctgcctccacccctccgccgcgcagccctcctcccgccgcaccacccgcctcaattccgccacctcctccgtcatcgccccgctgccctcctcaacgcccggcctctcccgctccttcccttcgggcgcgcccgccgcagcagggcgccgccgcacgctcgtctggttccgcgccgacctccgcctccacgaccatgagccgtttcacgccgcagcgggggcgtcgtcctccctccctcccgttttcgtcttcgatccgcgggacttcggcaagtccccctcggggttcgaccggacggncccgtacgcgccaacttctgctcgatcggtcgcgacctgcgcggagctccggggcccgcggtgggaactggtggtgcncgtggtaggcccgaagtgtcatcc

SEQ ID NO: 25158 - protein, 190 aa, Zea mays
  misc_feature: Ceres CLONE 1396644-F
  misc_feature (157)..(157): Xaa is any aa, unknown, or other
  misc_feature (183)..(183): Xaa is any aa, unknown, or other
MATASGTDAGAQPRDDPSLLPFASFSLGLSIRAPATPTLASVPSTLHLPTQISTLAVCLHPSAAQPSSRRTTRLNSATSSVIAPLPSSTPGLSRSFPSGAPAAAGRRRTLVWFRADLRLHDHEPFHAAAGASSSLPPVFVFDPRDFGKSPSGFDRTXPYAPTSARSVATCAELRGPRWELVVXVVGPKCH

SEQ ID NO: 25159 - DNA, 702 bp, Zea mays
  misc_feature: Ceres CLONE 1396646-F
  misc_feature: Encodes the peptide sequence at SEQ ID NO. 25160
  misc_feature (317)..(317): n is a, c, t, g, unknown, or other
  misc_feature (395)..(395): n is a, c, t, g, unknown, or other
  misc_feature (593)..(593): n is a, c, t, g, unknown, or other
  misc_feature (598)..(598): n is a, c, t, g, unknown, or other
  misc_feature (683)..(683): n is a, c, t, g, unknown, or other
aaagctggagctccccgcggtggcggccgctctagaactagtggatcccccgggctgcaggaattcgcacgagaccattacctagaacatcctaatcgaaaactcgtgttcttgttcgtctccgcctcaggcaactccacacggtcacacctcgctcgctctcgctcccgtatcgcggtttccttttcgaagccttgctaggtttagctggggcctctgtctatcctgtcaatggccccttaggcggctgtacttcagacttcagaggtgacgtgaggcgtggggacgcgcgtagctgattggttcgaggaggcggngatggacccggacttctcgccggcgagtgggggcccgagctttgagttcgccttcaactcggtcaacttctctgaccnggtggtgcagatcgagatcgtcgctggggatgacgccctcgggggccagggcgccaccggcgaggggtgctcatctcttgccgactgggcgtgccaccgcaagcgacgacgggaggagctccgacgcgacaagaatctagaaatacatggcagatccagcaaactgggcaagtgaagctgaaagatgtgatgcctacnagaanggcatgagcctgtagctatgatagaaggatctcccgctgatattgagcagatggtgaggatgaaaaaagcagcgactctactgtnaaaatggagggactcgggt

SEQ ID NO: 25160 - protein, 83 aa, Zea mays
  misc_feature: Ceres CLONE 1396646-F
  misc_feature (26)..(26): Xaa is any aa, unknown, or other
MDPDFSPASGGPSFEFAFNSVNFSDXVVQIEIVAGDDALGGQGATGEGCSSLADWACHRKRRREELRRDKNLEIHGRSSKLGK

SEQ ID NO: 25161 - DNA, 641 bp, Zea mays
  misc_feature: Ceres CLONE 1396648-F
  misc_feature: Encodes the peptide sequence at SEQ ID NO. 25162
tatgccccacaccattacctagaacatcctaatcgaaaagagattcgccgtctcaccctttccctgcctgctccctcgtctaagaaaagcgggcagagcagagacggcggcggcaggccatcgcggactcccgctcaccctcgtctgccaccgcctcccaggtcaggggccgacggcgacgggtggggaggggcggcagaggtagtccgaggggaggctgtggagcggagggcggagagaggccacgccgtccggagtctccagttccgtcgccacagcttcctgccgcgcctgggccgaggtaaacgagagggatcgaggaagaagtatcccccggagccccttcccccgaacccgaaggctccggaatggcgcactgggttagcgacagtgatggcagtgacaactttgaatgggatagtgatggcaatggggaggagccagcgaacttcaatgctgctggtgccggttcatcagctctgagatcaacgaacactgatgctccaggtccatcaacacgggttgctaatggcaatgggaaggctgggccatctgcctccttggttcaaaagtatatggacatgggtttcacggaagagattgttcggaaggccatgagggacaatggggataatggagca

SEQ ID NO: 25162 - protein, 91 aa, Zea mays
  misc_feature: Ceres CLONE 1396648-F
MAHWVSDSDGSDNFEWDSDGNGEEPANFNAAGAGSSALRSTNTDAPGPSTRVANGNGKAGPSASLVQKYMDMGFTEEIVRKAMRDNGDNGA

SEQ ID NO: 25163 - DNA, 697 bp, Zea mays
  misc_feature: Ceres CLONE 1396649-F
  misc_feature: Encodes the peptide sequence at SEQ ID NO. 25164
  misc_feature (600)..(600): n is a, c, t, g, unknown, or other
ggagctccccgcggtggcggccgctctagaactagtggatcccccgggctgcaggaattcgcacgagaccattacctagaacatcctaatcgaaaaaagccccccattcccattctaccaccgacccgtcccgtcccactgcctgccagcgtctcccccgctccctctcctcgagagatctcgcgctccggcgatcgggcgcggcgggcggagggtcgcgaagtgccctgcccacccccgatgctcttcccgaagcgcatcaactacgtggccccgatgctcgcctccgccgccatcctgctcctcctcctctcgggctacttcgagctcccctccatctccaccccggcgccgctcctcgcgggcgcagcgcgcttccccaccgcgctcgactccgtcggatcgcgcgaccgcgaccccttcacctcgctcctcgaggccttcgcgtcctgggacgccgccgtcggctgcccccgcgtctgcgccaagctcgccgccgcggggctggggctgggcccgggcctgcccgctgcgagtgcgagcgccagcgccagcgctaacggcaccgcggaggaccctgcggcggcgtccgtcagcggnggcgccgcgtggcgcggaaccgcgaggtgcgaggacttgcagcgcgcccacgcgggttgctcgccagggcttggacctgaatccctgacgcgctcca

SEQ ID NO: 25164 - protein, 152 aa, Zea mays
  misc_feature: Ceres CLONE 1396649-F
MLFPKRINYVAPMLASAAILLLLLSGYFELPSISTPAPLLAGAARFPTALDSVGSRDRDPFTSLLEAFASWDAAVGCPRVCAKLAAAGLGLGPGLPAASASASASANGTAEDPAAASVSGGAAWRGTARCEDLQRAHAGCSPGLGPESLTRS

SEQ ID NO: 25165 - DNA, 692 bp, Zea mays
  misc_feature: Ceres CLONE 1396650-F
  misc_feature: Encodes the peptide sequence at SEQ ID NO. 25166
  misc_feature (391)..(391): n is a, c, t, g, unknown, or other
  misc_feature (439)..(439): n is a, c, t, g, unknown, or other
  misc_feature (440)..(440): n is a, c, t, g, unknown, or other
  misc_feature (469)..(469): n is a, c, t, g, unknown, or other
  misc_feature (548)..(548): n is a, c, t, g, unknown, or other
  misc_feature (604)..(604): n is a, c, t, g, unknown, or other
  misc_feature (610)..(610): n is a, c, t, g, unknown, or other
tccccgcggtggcggccgctctagaactagtggatcccccgggctgcaggaattcgcacgagaccattacctagaacatcctaatcaaaagtttaaggcagcaagcaggagcagacaggaggcgccgagagcccagcgtcggagatctccgccgccatggagacgctggccagcgccatgcggcgcgagaaccgccggtccaaggccccgccctcctcctctgcttcctccgccctcgcctcgggcagggtccctctcgtcatggccttcctctcctgcctcgcctggctctacgtcgccggccgtttgtggcaggacgcgcagacccgggcgatcctgtccggcctcctcgagaagagctctaccagcgtcccgaaggtgctctcggtgnaggacaagcttaggaaccttgggtgcaaggcgattggaaggaaaattnngtgagcggagatggacctgaccaaggccnagagcgaggggtacctgtgggggaacaggactgcagctggtgactccgacaagaagcagcagcttctttgcgtcatggnagtttacactgggtttggctcccgtctcaagagaaacgtcttccgtggctcctggnatgcangaggtgatgctctggaagaagcttgagggaaaggggtggacctattcggtttggtatgggtcggagtgcgaatcgaggtgat

SEQ ID NO: 25166 - protein, 94 aa, Zea mays
  misc_feature: Ceres CLONE 1396650-F
  misc_feature (79)..(79): Xaa is any aa, unknown, or other
METLASAMRRENRRSKAPPSSSASSALASGRVPLVMAFLSCLAWLYVAGRLWQDAQTRAILSGLLEKSSTSVPKVLSVXDKLRNLGCKAIGRKI

SEQ ID NO: 25167 - DNA, 692 bp, Zea mays
  misc_feature: Ceres CLONE 1396651-F
  misc_feature: Encodes the peptide sequence at SEQ ID NO. 25168
  misc_feature (324)..(324): n is a, c, t, g, unknown, or other
  misc_feature (346)..(346): n is a, c, t, g, unknown, or other
  misc_feature (350)..(350): n is a, c, t, g, unknown, or other
  misc_feature (355)..(355): n is a, c, t, g, unknown, or other
  misc_feature (367)..(367): n is a, c, t, g, unknown, or other
  misc_feature (375)..(375): n is a, c, t, g, unknown, or other
  misc_feature (444)..(444): n is a, c, t, g, unknown, or other
  misc_feature (496)..(496): n is a, c, t, g, unknown, or other
  misc_feature (584)..(584): n is a, c, t, g, unknown, or other
ggagctccccgcggtggcggccgctctagaactagtggatcccccgggctgcaggaattcgcacgagaccattacctagaacatcctaatcgaaaaagcaaagtaggaatggcgtcggcgagcatgctcgcgcgctcccttctccgcaccccagaccctacccaaacgagccacccgaaccgccggagcgccgctgtcgtctccttcccccgccgccaccgccgcctgtccgtgcgcgcctccgtctccacggcctccccttccccaccgccacagcccgcggcggcggctgccggcgtgccgaagcactgcttccggcgcgangccgatggctacctgtactgcnaggnagtgncggtggaggacncgatgacngctgccgagcgcagccccttctacctctacagcaagccacagatcctccgcaacctcgccgcttaccgngatgctctccaggggctccgctccatcatcgggtatgccgtgaaggccaacnaacacctccccgtgctacgcgtcctgcgtgagcttggctgcggcgcccttctcgtcagcggcaacgagctccgactcgcccctcaggngggatccgaccccgccagtgtatatttaccgaaaatgggaagaccctcgaagatcttaaatagctgctgaaaggggagaattgaaaatggggaaagcgaatttgattg

SEQ ID NO: 25168 - protein, 181 aa, Zea mays
  misc_feature: Ceres CLONE 1396651-F
  misc_feature: SWISSPROT Homolog: EC 4.1.1.20 Diaminopimelate decarboxylase
  misc_feature (72)..(72): Xaa is any aa, unknown, or other
  misc_feature (80)..(80): Xaa is any aa, unknown, or other
  misc_feature (81)..(81): Xaa is any aa, unknown, or other
  misc_feature (83)..(83): Xaa is any aa, unknown, or other
  misc_feature (87)..(87): Xaa is any aa, unknown, or other
  misc_feature (130)..(130): Xaa is any aa, unknown, or other
  misc_feature (159)..(159): Xaa is any aa, unknown, or other
MASASMLARSLLRTPDPTQTSHPNRRSAAVVSFPRRHRRLSVRASVSTASPSPPPQPAAAAAGVPKHCFRRXADGYLYCXXVXVEDXMTAAERSPFYLYSKPQILRNLAAYRDALQGLRSIIGYAVKANXHLPVLRVLRELGCGALLVSGNELRLAPQXGSDPASVYLPKMGRPSKILNSC

SEQ ID NO: 25169 - DNA, 736 bp, Zea mays
  misc_feature: Ceres CLONE 1396652-F
  misc_feature: Encodes the peptide sequence at SEQ ID NO. 25170
  misc_feature (318)..(318): n is a, c, t, g, unknown, or other
  misc_feature (433)..(433): n is a, c, t, g, unknown, or other
  misc_feature (496)..(496): n is a, c, t, g, unknown, or other
  misc_feature (499)..(499): n is a, c, t, g, unknown, or other
  misc_feature (506)..(506): n is a, c, t, g, unknown, or other
  misc_feature (513)..(513): n is a, c, t, g, unknown, or other
  misc_feature (522)..(522): n is a, c, t, g, unknown, or other
  misc_feature (523)..(523): n is a, c, t, g, unknown, or other
  misc_feature (533)..(533): n is a, c, t, g, unknown, or other
  misc_feature (538)..(538): n is a, c, t, g, unknown, or other
  misc_feature (561)..(561): n is a, c, t, g, unknown, or other
  misc_feature (599)..(599): n is a, c, t, g, unknown, or other
  misc_feature (618)..(618): n is a, c, t, g, unknown, or other
  misc_feature (645)..(645): n is a, c, t, g, unknown, or other
  misc_feature (721)..(721): n is a, c, t, g, unknown, or other
  misc_feature (723)..(723): n is a, c, t, g, unknown, or other
  misc_feature (731)..(731): n is a, c, t, g, unknown, or other
tccccgcggtggcggccgctctagaatagtggatcccccgggctgcaggaattcgcacgagaccattacctagaacatcctaatcgaaaagaagaaagttgccggcctgccgctgcctgctcgcagttgccagcccccgccgccgcggaggacggaaggaagcgaatcaaccgcgactgtctccgacgggaataaagcaggcgaggccagccggtcgcggaccccccaattctcagctgcgggcggcgatcgagtcggttccgtcccgcgccgatgcggatcccgcggcggaagggcggggccgggccgctcgctgtncgggtgcccagcaggcgggcgcaggtcgccgcggtcttcgcgctcgccgcactgctgggggtctccgtgctctacgacaacgcccacatcgcccgctcgctgcggagggcacggncggccgaggacgtacgccagctctccttccttccggaagccggcaccgctgttcccagcatcnacnaaggaangaggcgncgggcggcnngtggcccggncaacnggagtcgggtgccggtgccacgncggcgaatcgggcccgactccccccccgcacgagcggnaagggaggaggatcgaggnaccgcccatccgagccctggagcgacngggcgggagctcccctgaaggacgcgccgttaatccaagggaggggttgcagggaagaagcgagcccccccacctntnaaaagggntgggc

SEQ ID NO: 25170 - protein, 129 aa, Zea mays
  misc_feature: Ceres CLONE 1396652-F
  misc_feature (54)..(54): Xaa is any aa, unknown, or other
  misc_feature (75)..(75): Xaa is any aa, unknown, or other
  misc_feature (76)..(76): Xaa is any aa, unknown, or other
  misc_feature (78)..(78): Xaa is any aa, unknown, or other
  misc_feature (84)..(84): Xaa is any aa, unknown, or other
  misc_feature (87)..(87): Xaa is any aa, unknown, or other
  misc_feature (89)..(89): Xaa is any aa, unknown, or other
  misc_feature (109)..(109): Xaa is any aa, unknown, or other
MRIPRRKGGAGPLAVRVPSRRAQVAAVFALAALLGVSVLYDNAHIARSLRRARXAEDVRQLSFLPEAGTAVPSIXXGXRRRAAXGPXNXSRVPVPRRRIGPDSPPARAXREEDRGTAHPSPGATGRELP

SEQ ID NO: 25171 - DNA, 705 bp, Zea mays
  misc_feature: Ceres CLONE 1396654-F
  misc_feature: Encodes the peptide sequence at SEQ ID NO. 25172
tggagctccccgcggtggcggccgctctagaactagtggatcccccgggctgcaggaattcgcacgagaccattacctagaacatcctaatcgaaaaggaatgtcccgttagaagaacttgttgtttgaaaggcgaaacctacgtgctcccgtttggctggctacggcggcatgcagcgagatcgtgaggttttgcttattaacaggaaggtggtgctgctcggttacatctaccgtgctcccaggtaggaagatctgtagtctcgtcgacggcgcggccgtggagctgcgcgtccccgagggcgtcggcggccccgcgatgctggtgaagaacctctacctatcctgcgacccttacatgcgcggctggatgcggaacttccgcaactcctacatcccgcccttcaaacctgtatcacctattgaaggtttgccgtgcgggagggtggtcgactccactcatccaggattagtgcagctgactatgtttccggaatgactggatgcgaggactacagtctgatcccaatcctgacagctcatgaagatcgagcagagcgacataccactctcctatcatctggggccttcttgtcatgcctggctttacagacttatgttggattctatgagatctgatcacaaagagaggcggaggtttgctttttgtttctgcggcattggcagcagttggagaaaatggtg

SEQ ID NO: 25172 - protein, 59 aa, Zea mays
  misc_feature: Ceres CLONE 1396654-F
MLVKNLYLSCDPYMRGWMRNFRNSYIPPFKPVSPIEGLPCGRVVDSTHPGLVQLTMFPE

SEQ ID NO: 25173 - DNA, 695 bp, Zea mays
  misc_feature: Ceres CLONE 1396657-F
  misc_feature (322)..(322): n is a, c, t, g, unknown, or other
  misc_feature (416)..(416): n is a, c, t, g, unknown, or other
  misc_feature (437)..(437): n is a, c, t, g, unknown, or other
tccccgcggtggcggccgctctagaactagtggatcccccgggctgcaggaattcgcacgagaccattacctagaacatcctaatcgaaaaaaataaaaaaaatcggacgacctacgcacacgctcagacaggtttacgcgctgacaagctgcccttccgcgaactacacgttcgacgaaatgccgccgcgagacctcttcatcgtcaactgagattcgcctcgcatcttctcggattccttcccccactttcgtccccatcagcggacctactcgagatcgacgagacacgtcggagcccggttcctaagcgtcccagcgnccgactggatctcctggctcgggccggcttgatggtccctggggtcggtccggggtggagttcgaagcgatgaacaagcttgcgtcggggctcngcgcttgcggaggtcctcctnccaatgggaggtgcgtggggtccgggctcgcgtcatgcgggctaatggttttctcgcagctcgccctgggggaagggtccccggctctttcctttttctctccctcctcggcatgctcccatggggggggtggggggtcatcaccggtaattgggctctgcgcccggggaagggaggtcttcggggggggggggggtgggcccccggtttttgggtgtcttaaaaatcccccatagggggggggggttaccgaattcg

SEQ ID NO: 25174 - DNA, 700 bp, Zea mays
  misc_feature: Ceres CLONE 1396658-F
  misc_feature: Encodes the peptide sequence at SEQ ID NO. 25175
  misc_feature (412)..(412): n is a, c, t, g, unknown, or other
  misc_feature (668)..(668): n is a, c, t, g, unknown, or other
gagctccccgcggtggcggccgctctagaactagtggatcccccgggctgcaggaattcgcacgagaccattacctagaacatcctaatcgaaaagacttcatactgctcgcctcgccgtctttcccccaatctgttgctcctccaagctgcgggcgatcgccgtaccccggccgccgcagggaaccccctcgccatggccttgcaggggaagaagctcatcaacaaccccgacgatgtggtgacggagttcatcgaagggttggtggagacttacccgggtctgcagtacctcgacgggttccctcagattaaggtcgttcttcgtgctgatgtccagcgcggttcctatgacaaaagtgcagtcatctcgggtggtggaagtggccatgaaccttcccatgctggatttngtgggcccagggatgtgacagctgctgtttctggagatgttttcgcctctccacctggtgattctattttagctgctattcgagctgtaactggtcccatggggtgccttctaatataaagaactacactggtgatagactcaattttggattagctgctgagcaggcaaaatctgaaagctataagatggagatggtcattgttgaagatgattgtgccctttctccacctagaggatagctggaagaagagttnacctggaacaattcttgggaataggttgctgc

SEQ ID NO: 25175 - protein, 111 aa, Zea mays
  misc_feature: Ceres CLONE 1396658-F
  misc_feature: SWISSPROT Homolog: EC 2.7.1.29 Glycerone kinase
  misc_feature (73)..(73): Xaa is any aa, unknown, or other
MALQGKKLINNPDDVVTEFIEGLVETYPGLQYLDGFPQIKVVLRADVQRGSYDKSAVISGGGSGHEPSHAGFXGPRDVTAAVSGDVFASPPGDSILAAIRAVTGPMGCLLI

SEQ ID NO: 25176 - DNA, 761 bp, Zea mays
  misc_feature: Ceres CLONE 1396660-F
  misc_feature: Encodes the peptide sequence at SEQ ID NO. 25177
aagctggagctccccgcggtggcggccgctctagaactagtggatcccccgggctgcaggaattcgcacgagaccattacctagaacatcctaatcgaaaaatggagaagcttccttcagtgagtcctccctttccgtttaaggcagcaagtcatgagcagacaggaggcgccgagagcccagcgtcggagatctccgccgccatgtagacgctggccagcgccatgtggcgcgagaaccgccggtccaaggccccgccctcctcctctgcttcctccgccctcgcctcggggagggtccctctcgtcatggtcttcctctcctgcctcgcctggctctacgtcgccggccgtttgtggcagacgcgcagacccgggagatcctgtccggtctcctcgagagagctctaccagggtcccgatggtggtctcggtggatgacaagcttagaacccttggttgaaggtgattggcaagaaaaattgttgagggggagatggaccttgccccgggctaaaagccaggggtccttgggggggaacagaactgcattttgtggatccccaaccaagaaaaaaggggtttttgcgggtctttgggagataacccgtgggtttggggtccccgaaacaaaaggaaaggcccttccgggggctccctgggggcccaaagggggggttttctttaaaaaaatttggggagaaaaacgggggcacccatatccctttttggagatagggggcgcgcggggaaaaataaagg

SEQ ID NO: 25177 - protein, 71 aa, Zea mays
  misc_feature: Ceres CLONE 1396660-F
MWRENRRSKAPPSSSASSALASGRVPLVMVFLSCLAWLYVAGRLWQTRRPGRSCPVSSRELYQGPDGGLGG

SEQ ID NO: 25178 - DNA, 677 bp, Zea mays
  misc_feature: Ceres CLONE 1396661-F
  misc_feature: Encodes the peptide sequence at SEQ ID NO. 25179
  misc_feature (306)..(306): n is a, c, t, g, unknown, or other
  misc_feature (318)..(318): n is a, c, t, g, unknown, or other
  misc_feature (324)..(324): n is a, c, t, g, unknown, or other
  misc_feature (325)..(325): n is a, c, t, g, unknown, or other
  misc_feature (399)..(399): n is a, c, t, g, unknown, or other
tggagctccccgcggtggcggccgctctagaactagtggatcccccgggctgcaggaattcgcacgagaccattacctagaacatcctaatcgaaaaatttcccaccttcccaaacgccacttaaaagagaaaggagagcatcgcagtggcacacgcgcaatggaaggctcgccggtgacgcgcctcccggaggctaactccctccccgacggcttcgttcccgactccgagagccctggcacggacgcgacgtttcccttctccgcgcccatcgttgatgatgcgctcaactccgatatccccgncgcgaccaaccnaggggnngaggaaaccctaaacgatccccccctccctgcggtcaggggcgaggatgcctcctcggccgccgctgctgaaanccttgggcaacatttcccctgaaccctgccccccaaacaaaaacggctttaaaagggaaagggaccccccggggtttaaaagggggaaacttcctttaaaaaatttgggcaaaaaagttaggggccctccattggcaaaaagggggggtttacccaaaaaagggggtggaaaaccaaaaattttaaaaaaaaaaaaagttttttaacccccccccaacacaaaaaattttttaaaaaagggggccccccttttggtaaaaaaaaaaaaaatttttttt

SEQ ID NO: 25179 - protein, 86 aa, Zea mays
  misc_feature: Ceres CLONE 1396661-F
  misc_feature (49)..(49): Xaa is any aa, unknown, or other
  misc_feature (53)..(53): Xaa is any aa, unknown, or other
  misc_feature (55)..(55): Xaa is any aa, unknown, or other
  misc_feature (80)..(80): Xaa is any aa, unknown, or other
MEGSPVTRLPEANSLPDGFVPDSESPGTDATFPFSAPIVDDALNSDIPXATNXGXEETLNDPPLPAVRGEDASSAAAAEXLGQHFP

SEQ ID NO: 25180 - DNA, 584 bp, Zea mays
  misc_feature: Ceres CLONE 1396663-F
  misc_feature: Encodes the peptide sequence at SEQ ID NO. 25181
  misc_feature (325)..(325): n is a, c, t, g, unknown, or other
  misc_feature (326)..(326): n is a, c, t, g, unknown, or other
  misc_feature (347)..(347): n is a, c, t, g, unknown, or other
  misc_feature (348)..(348): n is a, c, t, g, unknown, or other
  misc_feature (361)..(361): n is a, c, t, g, unknown, or other
  misc_feature (362)..(362): n is a, c, t, g, unknown, or other
  misc_feature (416)..(416): n is a, c, t, g, unknown, or other
  misc_feature (445)..(445): n is a, c, t, g, unknown, or other
tccccgcggtggcggccgctctagaactagtggatcccccgggctgcaggaattcgcacgagaccattacctagaacatcctaatcgaaaaaacaacaaaaaaaatctccgcggcgcggggggaggtggtctgttcaccttggggagcagcggcgggccgtcggccgagaaatgcccggtggcgccttcctcctcaacggcagcggcggcggcatggcggactacggcggcggcctcaccgtccccgtcgtcgtgacctgcctcatggcggcctccggcggcctcatcttcggctacgacattggcatctcaggaggtgtgtcgnnagatggaggatttcctgaacnnagtcttcccccgnngttgctcagaggacggcgcgcgccaaacaaggacgtgtactgcattttacacancaggcgctgacggccctcacggtcgtcgnctgtacgggtccgggaatggggggggaacgctggtttggcaagccccggtgaaccggggggttgggggggggcaaggccgttatgggtgaactggggggggggccttggtttttgggcgggggggcccttggtaaaaag

SEQ ID NO: 25181 - protein, 84 aa, Zea mays
  misc_feature: Ceres CLONE 1396663-F
  misc_feature (52)..(52): Xaa is any aa, unknown, or other
  misc_feature (59)..(59): Xaa is any aa, unknown, or other
  misc_feature (64)..(64): Xaa is any aa, unknown, or other
  misc_feature (82)..(82): Xaa is any aa, unknown, or other
MPGGAFLLNGSGGGMADYGGGLTVPVVVTCLMAASGGLIFGYDIGISGGVSXDGGFPEXSLPPXLLRGRRAPNKDVYCILHXRR

SEQ ID NO: 25182 - DNA, 679 bp, Zea mays
  misc_feature: Ceres CLONE 1396666-F
  misc_feature: Encodes the peptide sequence at SEQ ID NO. 25183
  misc_feature (222)..(222): n is a, c, t, g, unknown, or other
  misc_feature (237)..(237): n is a, c, t, g, unknown, or other
  misc_feature (373)..(373): n is a, c, t, g, unknown, or other
  misc_feature (374)..(374): n is a, c, t, g, unknown, or other
gctctagaactagtggatcccccgggctgcaggaattcgcacgagaccattacctagaacatcctaatcgaaaaatagaccggattaaaaccctaggccctagccaccgcccaccgtcgcctcagcaaatcctcctcccgtttcaccatgccgccctgctgctcccccaccacctccgccgtcaccgctgcggcggcatctcccggcgcctcgcgcagcggnggcctcctgcgccgntcgcgcccaagccccgccggcgtgaattgaaaaaagattgattctctgaggccaatcaattggagcaccacccttggatttcggtggtcaaaagggttcttacccccctcccggggggggggggggggtttcccgnnaatccaaaaaaatgaggaaccgaacccgagggctccccccatcctttttccggggacgcccaaatcccttccctttttcccagggaaataacaaacgttatttgggggcgaaaaaacttggggaaaaaatacccccaaaaccgggttttccccgagggccaaataatatggtcccaccttcaaaaaaggggccgcgggggtcagaaacttttttcctggtgggaaccgatcggacgccccccggagaagaacgagcgtctatagggcgcgttttcgccacagccccgcgcgccgtgaagcaaaaa

SEQ ID NO: 25183 - protein, 39 aa, Zea mays
  misc_feature: Ceres CLONE 1396666-F
MPPCCSPTTSAVTAAAASPGASRSGGLLRRSRPSPAGVN

SEQ ID NO: 25184 - DNA, 719 bp, Zea mays
  misc_feature: Ceres CLONE 1396667-F
  misc_feature: Encodes the peptide sequence at SEQ ID NO. 25185
  misc_feature (528)..(528): n is a, c, t, g, unknown, or other
  misc_feature (565)..(565): n is a, c, t, g, unknown, or other
  misc_feature (671)..(671): n is a, c, t, g, unknown, or other
  misc_feature (672)..(672): n is a, c, t, g, unknown, or other
aaagctggagctccccgcggtggcggccgctctagaactagtggatcccccgggctgcaggaattcgcacgagaccattacctagaacatcctaatcgaaaatcctttcccctcctccctcctcggctcgtctctgttcccctttccctcctgcgcacccgtcttctcctccccgcgacaaaccccagcacaaaaagtaaccgcccgccgcctcctcgttcctctcccgaatcagccgtcgcggtgcctaatccggccgatcccccctccgatccgcgggtgcccgccgcagaggcgaagcctccggacctcccccgatgtatagcaacttcaaggagcaggcgatcgattacgtcaagcacgcgcaccgggaggacaatgccggaaactacgtgaaggagatccctctctacatgaacgagctcgagtacttccaaacccacctcaaggacgagaagaaccacaagatcaaggaggccatcaccgccaagtttcccgagtacctccgccgcgccgaggagatccggncgctcctcgatgaggacgccccagggcctggggtccnccggtgataacgcggttgtccccgcgccccccaagaccaagggattagacggggaccgaggcaacgttgtgtgatgactccgaccaatccaatctgaggggcgggnntcaactcccaccatagtccccaaaaccccaacaataaattggaacca

SEQ ID NO: 25185 - protein, 84 aa, Zea mays
  misc_feature: Ceres CLONE 1396667-F
  misc_feature (5)..(73): Pfam Name: MIT Pfam Description: MIT (microtubule interacting and transport) domain
  misc_feature: SWISSPROT Homolog: EC 2.7.11.1 Non-specific serine/threonine protein kinase
  misc_feature (71)..(71): Xaa is any aa, unknown, or other
  misc_feature (83)..(83): Xaa is any aa, unknown, or other
MYSNFKEQAIDYVKHAHREDNAGNYVKEIPLYMNELEYFQTHLKDEKNHKIKEAITAKFPEYLRRAEEIRXLLDEDAPGPGVXR

SEQ ID NO: 25186 - DNA, 653 bp, Zea mays
  misc_feature: Ceres CLONE 1396668-F
  misc_feature: Encodes the peptide sequence at SEQ ID NO. 25187
  misc_feature (318)..(318): n is a, c, t, g, unknown, or other
  misc_feature (322)..(322): n is a, c, t, g, unknown, or other
  misc_feature (333)..(333): n is a, c, t, g, unknown, or other
  misc_feature (375)..(375): n is a, c, t, g, unknown, or other
  misc_feature (443)..(443): n is a, c, t, g, unknown, or other
  misc_feature (489)..(489): n is a, c, t, g, unknown, or other
  misc_feature (497)..(497): n is a, c, t, g, unknown, or other
  misc_feature (585)..(585): n is a, c, t, g, unknown, or other
tccccgcggtggcggccgctctagaactagtggatcccccgggctgcaggaattcgcacgagaccattacctagaacatcctaatcgaaaactctcgattcggaaaaccctccaaccctagccgggatccgacaacgcctccatccctagccgcctcctgcaagtttcagagctcaagagtcggggcgccatggcgacagagacggagactttcgcctttcaggctgagatcaaccagctgctctcactcatcatcaataccttctattccacgaggagatctgcctccgggagctcatttccaactcttccgatgcngtgnacaaatcaggntcgagagcctcactgacaagagcaagctcgatgcgcagccgnagctggtcatccacattgtaccagacagggcttcgaacacgctctccatcatcgacagcggcatcgtnatgacccagtccgaccttgtcaacacctcggtaccatcgccgggtnccgggacnaggagttcatggaaagcccttgctgctggcgctgatgggtctatgatggggcaagtccggtgtccggtttcaactctggccaccctcncccccaaaggggtcctccgggccccccaggattacggttgccgagccgtccggggggggatccccagg

SEQ ID NO: 25187 - protein, 70 aa, Zea mays
  misc_feature: Ceres CLONE 1396668-F
  misc_feature (16)..(16): Xaa is any aa, unknown, or other
  misc_feature (48)..(48): Xaa is any aa, unknown, or other
MTQSDLVNTSVPSPGXGTRSSWKALAAGADGSMMGQVRCPVSTLATLXPKGVLRAPQDYGCRAVRGGIPR

SEQ ID NO: 25188 - DNA, 675 bp, Zea mays
  misc_feature: Ceres CLONE 1396671-F
  misc_feature (222)..(222): n is a, c, t, g, unknown, or other
  misc_feature (348)..(348): n is a, c, t, g, unknown, or other
  misc_feature (367)..(367): n is a, c, t, g, unknown, or other
  misc_feature (377)..(377): n is a, c, t, g, unknown, or other
  misc_feature (402)..(402): n is a, c, t, g, unknown, or other
  misc_feature (412)..(412): n is a, c, t, g, unknown, or other
  misc_feature (423)..(423): n is a, c, t, g, unknown, or other
  misc_feature (425)..(425): n is a, c, t, g, unknown, or other
  misc_feature (426)..(426): n is a, c, t, g, unknown, or other
  misc_feature (431)..(431): n is a, c, t, g, unknown, or other
  misc_feature (481)..(481): n is a, c, t, g, unknown, or other
gagctccccgcggtggcggccgctctagaatagtggatcccccgggctgcaggaattcgcacgagaccattacctagaacatcctaatcaaaaaagctttcaaagcgttgggagagatggcagaggagacgcaaccagaggccgcagccgccgccgcgcccgccgcggacgaggtagtcgtgaccgaagctgcgccggcgtaggcggaggtgcctgcgtcgncggaagctgaagccgaggccaggatgataagatagtgacgaggcgtagctcactgcgatgacgcgttggtggggaccggctcgatcaaggaggaaagcaacctggtggaagacctgccggacccgnagaagaagcgctcgacgangtcaagcagntgatcgctgctgccctcggcgacgntgagttcaanctggctacccngnncgcgnctgcgaaggcaaggaaacagaagtggagggagccagggccgagagtctgncaaagaaaagctcgcggcggagggggagaaaccaagggccaggtggttgcgaatgccccgggttgggggagggcaaaaaggaaggtcccccccgcccgaggaggcctagctaaaaaccttggtttagaaaacaagccttccaagcccagcccaagaaaaaaaaccctcgggccccttgggggggaacctccccc

SEQ ID NO: 25189 - DNA, 673 bp, Zea mays
  misc_feature: Ceres CLONE 1396672-F
  misc_feature: Encodes the peptide sequence at SEQ ID NO. 25190
  misc_feature (262)..(262): n is a, c, t, g, unknown, or other
  misc_feature (344)..(344): n is a, c, t, g, unknown, or other
  misc_feature (492)..(492): n is a, c, t, g, unknown, or other
  misc_feature (493)..(493): n is a, c, t, g, unknown, or other
ggagctccccgcggtggcggccgctctagaactagtggatcccccgggctgcaggaattcgcacgagaccattacctagaacatcctaatcgaaaagatttcctcgtcatttctctcatccgctgcgctccctctcccactcggcgaagaagggggaaaaaagctcgaaagcgggagccggcgagcgagatgggcgcagggagcagccgcgcggacgcgccgtcgcggcgccgggcgcgcctcagcctcggcgggtgcttcngggccggatcctcctcgtccgcgcacgacggcgggagcttcgcccgcggcgggccctcctcctcgcgcggcatcgaggtacnatcacgacagtcaggggcgacagtgagtgcccctgaattttcaggcttctctagctgctaaggatctccagggtttccagtgagtcaaatccaaggctggcatcgtcttcagcaccataagccatcatctcagattcaatcacttcanntaccatgaaaacaaggaagatggcctggggtctgaaaacgctgaaacaattggccttcaaagctcatctagggaaacctgtcatggaaaggggaagcctcataagtgaggctgttgtggtggccatatcggaagagggaatagtttctgtaggatcaggggtggaaaaggtcccaacccc

SEQ ID NO: 25190 - protein, 71 aa, Zea mays
  misc_feature: Ceres CLONE 1396672-F
  misc_feature (25)..(25): Xaa is any aa, unknown, or other
  misc_feature (52)..(52): Xaa is any aa, unknown, or other
MGAGSSRADAPSRRRARLSLGGCFXAGSSSSAHDGGSFARGGPSSSRGIEVXSRQSGATVSAPEFSGFSSC

SEQ ID NO: 25191 - DNA, 669 bp, Zea mays
  misc_feature: Ceres CLONE 1396676-F
  misc_feature (554)..(554): n is a, c, t, g, unknown, or other
  misc_feature (575)..(575): n is a, c, t, g, unknown, or other
ggagctccccgcggtggcggccgctctagaactagtggatcccccgggctgcaggaattcgcacgagaccattacctagaacatcctaatcgaaaaatagatagaggttttttttcgccatgtgcttgtgttgggacctgtctgccgcctaactaaagtaaccacaccaccacaccatcgaggcgggggaaggcgcggcgcggcgcggcgcggcggacttcgctcgtcgaggctgtaagtctagggtggcgacctgcactctctacaacccgcatctctccgtccccggcgacgactgcgtgagcagccgcagcactactaagagcggacagcggactatggaggtggaggccatccgagttcccttcgaagcttctcgaggataggtacgcggaagatagcttcgtcgtcaccattgcggcatcgtagaagtgcttagcaagaaagagctccaggacctttctgcagagggcagccagatgctggtgcgtgctgcaagtgctagaggaaatcggatcctcgaggtcggcgatgagatggaagggatgctgcanccacacgggcgaatggattcntccgagagcagcaaataggggtaagaattatccagcggagtggaaagaaatggacagtgaagtgggggaatgccccgacccgagggaggtgcaa

SEQ ID NO: 25192 - DNA, 563 bp, Zea mays
  misc_feature: Ceres CLONE 1396677-F
  misc_feature (230)..(230): n is a, c, t, g, unknown, or other
  misc_feature (237)..(237): n is a, c, t, g, unknown, or other
  misc_feature (239)..(239): n is a, c, t, g, unknown, or other
  misc_feature (241)..(241): n is a, c, t, g, unknown, or other
  misc_feature (242)..(242): n is a, c, t, g, unknown, or other
  misc_feature (303)..(303): n is a, c, t, g, unknown, or other
  misc_feature (304)..(304): n is a, c, t, g, unknown, or other
  misc_feature (372)..(372): n is a, c, t, g, unknown, or other
  misc_feature (410)..(410): n is a, c, t, g, unknown, or other
  misc_feature (478)..(478): n is a, c, t, g, unknown, or other
  misc_feature (482)..(482): n is a, c, t, g, unknown, or other
aaagctggagctcaccgcggtggcggccgctctagaactagtggatcccccgggctgcaggaattcgcacgagaccattacctagaacatcctaatcgaaaaatccatccccgcgacgactcgcaccacccacccctgcagtctgcagcatccccttccccactcccggctggtctgctgcggccaccctgcgccgatccacctccgctgcttcctgcctcaatatattncgcccgncntnncgtcgcctcccgaaccccggccacagaagggccttccaagaaccttccgaaccctcacctnncgggtccggccccgttccaattctcctccctccgggggcggggccgacttccgatgggcccggtcgtnaaaggcccgccgaaaaacgaacacaagccggggcccgnccgttttcaaaaaaggaagccacccgggcgcgcgggccttttggcctttttacccccccaaaaccccngggngaaaaccgccaaaaaaaagggggaaaattttggggagaaccttttttttttcccaaaaaatttacacccccccccgggggg

SEQ ID NO: 25193 - DNA, 680 bp, Zea mays
  misc_feature: Ceres CLONE 1396678-F
  misc_feature: Encodes the peptide sequence at SEQ ID NO. 25194
  misc_feature (292)..(292): n is a, c, t, g, unknown, or other
  misc_feature (480)..(480): n is a, c, t, g, unknown, or other
  misc_feature (492)..(492): n is a, c, t, g, unknown, or other
  misc_feature (504)..(504): n is a, c, t, g, unknown, or other
ggcggccgctctagaactagtggatcccccgggctgcaggaattcgcacgagaccattacctagaacatcctaatcaaaaacctcctctgcctgccgcttctcctgctgcgggcggtcacggctgcaagtactagaggaggacatccgcttccattactgcgcctgcggaggatcggaggaaccagtagcggaggcttcgattttcggcgggcgcaataaatttcccgcatggctcggagggccgcgtcctcgctcgtctcccgctgcctcctggcgagggcccctgccggngcgccgcccgctgccccctctgcgctgcgcaggacagtgcctgcagatgggatgcacaggctgttgccaggtgtccttcagaaggtcagcactgcagcagcagtagaggagcccatcacgccgtcagtccatgtgaactacacaaagctcctcattaatggccaacttttgtgattccggcatcgggnaagactttcccnactctggacccntctaacagggaaggtgattgctcatggggctgaggtggaccaaaagaaattaacccgggcaaaacctgcggctcccagggttttttgaggaaaggccatggcccaaaaaatactgcccattaaaaggccccaaccctaatggcggttttgttagatttaaaaaaaaaaccacatgg

SEQ ID NO: 25194 - protein, 78 aa, Zea mays
  misc_feature: Ceres CLONE 1396678-F
  misc_feature: SWISSPROT Homolog: EC 1.2.1.3 Aldehyde dehydrogenase (NAD(+))
MARRAASSLVSRCLLARAPAGAPPAAPSALRRTVPADGMHRLLPGVLQKVSTAAAVEEPITPSVHVNYTKLLINGQLL

SEQ ID NO: 25195 - DNA, 629 bp, Zea mays
  misc_feature: Ceres CLONE 1396679-F
  misc_feature: Encodes the peptide sequence at SEQ ID NO. 25196
  misc_feature (337)..(337): n is a, c, t, g, unknown, or other
  misc_feature (340)..(340): n is a, c, t, g, unknown, or other
  misc_feature (398)..(398): n is a, c, t, g, unknown, or other
  misc_feature (399)..(399): n is a, c, t, g, unknown, or other
ggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcgntgntgcaaagcagcgtgcgagtggcagtacggaaaggacaccccgcggaagaagggatgcnnagagcgagtgccgcgagcggcaccagcaagctgacgcgggcgaggaacgcgacagcgggcgtggaacgctacgtctcccgctccggaaaggggccgagtggccgccccagtgcctgcccccgcacgaggggccagccgtggaaaaacccaggagtgcatggagggggggccccccccccggaattgggccctccaaatggaaaaaaaaaaacggccgcggaaacaaaaaa

SEQ ID NO: 25196 - protein, 74 aa, Zea mays
  misc_feature: Ceres CLONE 1396679-F
  misc_feature (44)..(44): Xaa is any aa, unknown, or other
  misc_feature (64)..(64): Xaa is any aa, unknown, or other
MGKGSVGASWWAFLLLAGVLLVVAATAGAEDGVVERDRKEDLRXCKAACEWQYGKDTPRKKGCXERVPRAAPAS

SEQ ID NO: 25197 - DNA, 728 bp, Zea mays
  misc_feature: Ceres CLONE 1396681-F
  misc_feature: Encodes the peptide sequence at SEQ ID NO. 25198
  misc_feature (418)..(418): n is a, c, t, g, unknown, or other
aagctggagctccccgcggtggcggccgctctagaactagtggatcccccgggctgcaggaattcgcacgagaccattacctagaacatcctaatcgaaaaaaactaccgaagtctacttccattccttcctttctcctttcatatacccgcgtcgcccacgagcccgccgtgccgacagaggtgtggacctcgccggagcagaggctatggggccaccgcagccagccagccccggcgtcatcaacatcgaggcctgcgcgcgggcgatcgccgtcgaccaccgcatcagccttccctactacttccgcatcgcgggcagcctcctccgacaggctaatatatatcgggacgagagtaacttcctcgacctatatgtcatccttctgagatactcgagcttgctgtgtgaaacattnccgagggatcgtgatttacatgcccttcaagttaagagaaaggcattttttgataaacttggtgatgttatcaaagaacttgagacattgaaggccggttgggcagccggaaattggccaatcatataagagggggtactggggaaatctaatatgaacagggctaagggagaaaatggtacaactcaaaggaaaggagaagcatactcccaggttcttaaactcccaacggcatttgggagggaacccctagagggaagctctccaaaaaatccctttcctgggtggggaggacaggtggcaattattg

SEQ ID NO: 25198 - protein, 112 aa, Zea mays
  misc_feature: Ceres CLONE 1396681-F
  misc_feature: SWISSPROT Homolog: EC 3.1.2.15 Ubiquitin thiolesterase
  misc_feature (70)..(70): Xaa is any aa, unknown, or other
MGPPQPASPGVINIEACARAIAVDHRISLPYYFRIAGSLLRQANIYRDESNFLDLYVILLRYSSLLCETXPRDRDLHALQVKRKAFFDKLGDVIKELETLKAGWAAGNWPII

SEQ ID NO: 25199 - DNA, 784 bp, Zea mays
  misc_feature: Ceres CLONE 1396686-R
  misc_feature (38)..(38): n is a, c, t, g, unknown, or other
  misc_feature (39)..(39): n is a, c, t, g, unknown, or other
  misc_feature (784)..(784): n is a, c, t, g, unknown, or other
tgttttttgtgtttttgtttttttttttttattttatnnacaccaaactttttttctatatgggtaccaggccccccctcgaggtcgacggtatcgatattttttttttttttttttaggggaaacaattttcaaggaaggaaatgcatcaacggtttagcacacaactcctatcacctaatgcatcaaacaaggtgataaagattttaaaacatcaaggaggtggcgaatgcaccggggcttgcctgaaaaacactaggttagtatttgttaggcgatgtccacttgacgatcatctttgtccttgcacttgatcaagcatgttcgtccatcagcatcatcctgcggattagcccgtgcttggggtcaacttagatcgtcttccacataacccgattatttatcgtacctcatgagatgcacggtgcaccatgtatgagcaccagtataaatagtacaagatagattatttaccctgaaaaggacgaaacacttataacctataacctagcaaacttttatataaaataccaataacatactttaaaacttaaaagaccttaatttgtttatactccattactttattacaacacaccctaccattttgaacccaaaccaaataaattccaatgtcaacttgtactccttaactattccgaaattcccaatccaacagatttattccaaaaccattgataatccaccccacacacacattatgaaatattcattaccccatgtttttagtactcatcacccctataaaactaaccttattatn

SEQ ID NO: 25200 - DNA, 758 bp, Zea mays
  misc_feature: Ceres CLONE 1396692-F
  misc_feature: Encodes the peptide sequence at SEQ ID NO. 25201
agaactggagctccccgcggtggcggccgctctataactagtggatcccccgggctgcaggaattcgcacgagaccattacctagaacatcctaatcgaaaaaatcgctcgcctcgtttcatcacctgagctctcctaatctcattcaccgttgcttgctctttgaattgcctttgcccccatttgctttcctgtttcttccatcccatccgtaccagctgacggtgcccgggttccatgcccagcggccagcgccttgtgacctgatccgcggctcgtccattcctccctccgtgaatggctcctccagcagggtctggggcagcgacggagggagggccggcacggcggcgcggcaccggcaccggtaccagccccggccgcaccaaagtgtgggtcgagccgccgggcaagagccaccaccagaccccggcgcgatcgctgcccccgccctcgccccctgccccgtacttggagaccaaaaggctgtacgaggtgtactacctttgccgcaaccgccatctggagcacccgaacttaatctaagcgccgatcgactgcacggaggaatgtctctacctgcgagatgtgattaaccgcctcaacgtgctgcccgtcaaggccttgtcctccaaatattcctggacttgcaagatgagctacaagaacggctgctggtggaacaatttgtccgaccacgacttggaggttcaccgttgaggcaaataacttcctcctctagggctccaaaacttctg

SEQ ID NO: 25201 - protein, 82 aa, Zea mays
  misc_feature: Ceres CLONE 1396692-F
MAPPAGSGAATEGGPARRRGTGTGTSPGRTKVWVEPPGKSHHQTPARSLPPPSPPAPYLETKRLYEVYYLCRNRHLEHPNLI

SEQ ID NO: 25202 - DNA, 687 bp, Zea mays
  misc_feature: Ceres CLONE 1396697-F
  misc_feature: Encodes the peptide sequence at SEQ ID NO. 25203
aaagctggagctccccgcggtggcggccgctctagaactagtggatcccccgggctgcaggaattcgcacgagaccattacctagaacatcctaatcgaaaaggtgatagttctgattcccaggcaaggaaccctcttatcccttctcgtctcctgtcccgggaccggggaggccgggatcgagaaggggaacgagcgcgtcccgtgctcgccactcctcgccgatggcgtcctccactctgccagcctcccccttccgtatgtctcttcccggactacgagccccggaccctgctaaggttaagcacgtatccgttcgaacccccgctcgccgtcttcccgttgcagcctccgcggcaccatcaggcgccgcggcggcggcggcgagggagcgcaggcgtttcctggagcgctacgggctcaacccaaacgacttcgaggaagatgcagaggataatccgagggtctactccaattattctgaacttattcgtaatgcttgtcgctgcgaattggtgtgattttgagtgggatgctttctcttttcattttttgcaggaggagagaaaggacaggcggagggcggaggcagtcggggagaggggagcaaactgcggaagcggcagtgactccagcgaaggtggaggagcctcgggagactcacaaaatgctccaggtgctaggtgg

SEQ ID NO: 25203 - protein, 98 aa, Zea mays
  misc_feature: Ceres CLONE 1396697-F
MASSTLPASPFRMSLPGLRAPDPAKVKHVSVRTPARRLPVAASAAPSGAAAAAARERRRFLERYGLNPNDFEEDAEDNPRVYSNYSELIRNACRCELV

SEQ ID NO: 25204 - DNA, 749 bp, Zea mays
  misc_feature: Ceres CLONE 1396699-F
  misc_feature: Encodes the peptide sequence at SEQ ID NO. 25205
aaagctggagctccccgcggtggcggccgctctataactagtggatcccccgggctgcaggaattcgcacgagaccattacctagaacatcctaatcgaaaaactcgcagcgtcggatctgatttccaatttcaaatccttcgatcgcgcagcgccgcccgccctctcgtagctctctccgatggcccgcatgaatcatacggggaggaagtctactggtggcgaggcggcgcggaagcagctcgccaccaaggcggggcgcaagtcggctccgggcagcggaggggtggagaagccgcagaggttccgccccggcaccgtcgctctccgcgagatccgcaagtaccacaagaggacggagctggtcatccggaagctgcccttccaacgactggtgcgtgagatcgcgcaagacttcaagaccgaccttcggttctcagtcctccgctgtcgtcgcgctgtaggaggtcgccgacgcgtatctggaggctctctttgaggacactcaagctctgctccatccacgccaagagggtcacactcgtgcccaaggacatccagatggcgcgccgcatcatgcttgagagggcctgattgctgctctgtcatcctgtttctgtaatgactgaactaggcgatggactctatcgcttcatgacctgcaatcgcgtaccgatgtgcttgccatagtcatttggctgttatgaacgtgattcaatgatttgatttataaaatataaaaaactaca

SEQ ID NO: 25205 - protein, 105 aa, Zea mays
  misc_feature: Ceres CLONE 1396699-F
MARMNHTGRKSTGGEAARKQLATKAGRKSAPGSGGVEKPQRFRPGTVALREIRKYHKRTELVIRKLPFQRLVREIAQDFKTDLRFSVLRCRRAVGGRRRVSGGSL

SEQ ID NO: 25206 - DNA, 733 bp, Zea mays
  misc_feature: Ceres CLONE 1396700-F
  misc_feature: Encodes the peptide sequence at SEQ ID NO. 25207
gctcttgaactagtggatcccccgggctgcaggaattcgcacgagaccattacctagaacatcctaatcgaaaaaacgacaaacacgagcgcgggcgcgcacaagttcgccaacccccaccccccgcgtgctgcgcgtcgttggaaccaaggcttggattaccctcgccgaggaggaggtggtggtcggcgaggggctcgcggggatggggatctcgaggccccttgtggtggcgatggcggtggcgctgctgatcgccgtcgccggtgcgaccgccgaggagcaggagcccctgctggcggcggacgcggtggccggcgcggtggaggcgcggctcaggcccgagctggggcaaactccgggcgaaagatctcggcgctagagtcacacctacaacagcgatctcaaaacctgaagaataacgatgatggcctcatgaacctggagaaaggccttgcagacaagtcaaaggctatttactctatgctggacgaaaatgcttcccctccagcccaaaggttctgcacctgccgaggagcaggctaaaaaggccaatgccaaggtttgtgcgccttgaaaagcccgtttgcccaggaccaaaaagcattttgaagcaccaccccagccagtaaagcagcacttaactatcagcgccaacgttgcccaaaaacaaagggccacactcccgaatgaaaacgttttaatccatccccaaaggtaagggtgttgataa

SEQ ID NO: 25207 - protein, 58 aa, Zea mays
  misc_feature: Ceres CLONE 1396700-F
MGISRPLVVAMAVALLIAVAGATAEEQEPLLAADAVAGAVEARLRPELGQTPGERSRR

SEQ ID NO: 25208 - DNA, 666 bp, Zea mays
  misc_feature: Ceres CLONE 1396703-F
  misc_feature: Encodes the peptide sequence at SEQ ID NO. 25209
  misc_feature (558)..(558): n is a, c, t, g, unknown, or other
aaagctggagctccccgcggtggcggccgctctagaactagtggatcccccgggctgcaggaattcgcacgagaccattacctagaacatcctaatcgaaaagctcaagtcaattcataaactcacaatggcggcaacggcataccccactgtggtgctcatcccactatgcgtcccaggccacctcgcgtccatgatcgaagccggcaagcggctgctcggcagaagccgctgccccatgtccctcaccgtgctcatcacgcagatgaccatgtccgccaacctgatgtccgacgtcgacgacatcatgcgacgggaagccgactccggcctggacatccgcttcgtccacctccccgccgtggagctccccaccgtccaccacggcctcgaggacttcatgatgcgcttcatacagctccacgcgacgcacgtcaaggaggccgtctccggcatgtcgtccccggtcgccgcggtcgtggtggactacttctgcacaccctattcgacgtcgcgcgcgagctcgcgctgccggggtacgcctacatgccgtccggngcgtcaatgtcgcgctcatgctgcggtaaccgccctggaacgggaagttgcccgggaacttcaagcgaaggaaggaaacggccatttacagggaaggccgccggggcc

SEQ ID NO: 25209 - protein, 179 aa, Zea mays
  misc_feature: Ceres CLONE 1396703-F
  misc_feature: SWISSPROT Homolog: EC 2.4.1.115 Anthocyanidin 3-O-glucosyltransferase
  misc_feature (144)..(144): Xaa is any aa, unknown, or other
MAATAYPTVVLIPLCVPGHLASMIEAGKRLLGRSRCPMSLTVLITQMTMSANLMSDVDDIMRREADSGLDIRFVHLPAVELPTVHHGLEDFMMRFIQLHATHVKEAVSGMSSPVAAVVVDYFCTPYSTSRASSRCRGTPTCRPXRQCRAHAAVTALEREVARELQAKEGNGHLQGRPPG

SEQ ID NO: 25210 - DNA, 755 bp, Zea mays
  misc_feature: Ceres CLONE 1396707-F
  misc_feature: Encodes the peptide sequence at SEQ ID NO. 25211
aaagctggagctccccgcggtggcggccgctctataactagtggatcccccgggctgcaggaattcgcacgagaccattacctagaacatcctaatcgaaaaataaatccccaatctccgcgctttccttccgccccacactcgtccactcaccccctctttgctctgcctcgccgcgccgcagagcagagcatggcgcccccacgccctctcctcgccgccgtcttcctcgccgcggaggttctgctcctcctttctccggcagaggcggggacggtgggcgtgaactacggccgcgtggcgaacaacctgcccaacccagcggcggttgtgcagctgctcaagcagcagggcgtcgcgcaggtgaagctgtacgacgccgaccccaccgtgctgcgcgccctcgcgaacaccggcatcaaggtggtggtggcgctgcccaacgagcaggtcgcggcggcggcgtcgcgcgcgtcctacgcgctgctgtgggtgcgccggaacgtgacggcgtaccacccggccacgcagatccagggcatcgccgtgggcaacgaggtgttcgcgtcagccaagaaacgtgacgctgagttggtcacggccatggccaacgtgcacaccgagcctgtcaggctcggcctcgacggcgacgaaaaaggttcggtcgcccatcggcgttctcggtcctggtgtcagcctacccgtcctctgcgggggggtgccccggaagaccgccccaaagccggcactaaacc

SEQ ID NO: 25211 - protein, 187 aa, Zea mays
  misc_feature: Ceres CLONE 1396707-F
  misc_feature (29)..(187): Pfam Name: Glyco_hydro_17 Pfam Description: Glycosyl hydrolases family 17
  misc_feature: SWISSPROT Homolog: EC 3.2.1.39 Glucan endo-1,3-beta-D-glucosidase
MAPPRPLLAAVFLAAEVLLLLSPAEAGTVGVNYGRVANNLPNPAAVVQLLKQQGVAQVKLYDADPTVLRALANTGIKVVVALPNEQVAAAASRASYALLWVRRNVTAYHPATQIQGIAVGNEVFASAKKRDAELVTAMANVHTEPVRLGLDGDEKGSVAHRRSRSWCQPTRPLRGGAPEDRPKAGTK

SEQ ID NO: 25212 - DNA, 628 bp, Zea mays
  misc_feature: Ceres CLONE 1396711-F
  misc_feature (53)..(53): n is a, c, t, g, unknown, or other
  misc_feature (261)..(261): n is a, c, t, g, unknown, or other
agagctggagctccaccgcggtggcggccggctctagaactagtgggatcccnccgggctgcaggaattcgcacgagaccattacctagaacatcctaatcgaaaaccatccatggctcgcttccagaaatccccctacctacggcgcagcgtcgcagtccggaatccacccccaaaatcactacccactctgcggcgatggaagggaatcgaaacgcgtgcttccccctttccatctcggcgttgcgcggattgcatggncatcgtttcgcgccccaatccgtcgatgcaaggacacgtgcttccccctttcatcctcgacgctgggcgaattgcagaatggcgaaatggcatgggccaatcggtttccccccccaatttcattggcccgggtaaaaaagggaaggggggcccccaaatgggccccccccccctaaagggggggggggggccttttctgggggggggaccccccaaaaaaaaaggaaaaccccccctaaaaagggccccctttttgggggggcgccaagaaacaccaaccaaacccggggggggggggggggcccccccccccccccaaaaaaaaaaaacatccccccccccccggggggagggggggggcgccccc

SEQ ID NO: 25213 - DNA, 574 bp, Zea mays
  misc_feature: Ceres CLONE 1396712-F
  misc_feature: Encodes the peptide sequence at SEQ ID NO. 25214
tctgaactagtggatcccccgggctgcaggaattcgcacgagaccattacctagaacatccgaatcgaaaaatcgcagaaattctccgcaacttcacagcggatcatcgttttccagtcgctcctactcctatcatccagaaaatctgagcggtattgatggcgcccaaggcggagaagaagccggcggcgaagaaggtggcggaggaggagccctcggagaaggcggctccggcggagaaggcccccgcggggaagaaggccaaggcggagaagcggctacctgcgggcaagtccgccggcaaggaggcggccgacaagaaggggaggaagaaggcgaaggaggagggggggagacctacaagatctacatcttccaggggctccggtctcccccaattccggcttcagcctcgccgcttcctcctttggcccgcaccggttggacgtcctccttccgggggggggaagctcggccgggaggaccccccccggggctttttggggagggggccctccccaggatttttttaacccctccggaaagggcccgcccgtggttttgggtcgggcaa

SEQ ID NO: 25214 - protein, 124 aa, Zea mays
  misc_feature: Ceres CLONE 1396712-F
MAPKAEKKPAAKKVAEEEPSEKAAPAEKAPAGKKAKAEKRLPAGKSAGKEAADKKGRKKAKEEGGRPTRSTSSRGSGLPQFRLQPRRFLLWPAPVGRPPSGGGKLGREDPPRGFLGRGPSPGFF

SEQ ID NO: 25215 - DNA, 740 bp, Zea mays
  misc_feature: Ceres CLONE 1396715-F
  misc_feature: Encodes the peptide sequence at SEQ ID NO. 25216
agagctggagctccccgcggtggcggccgctctataactagtggatcccccgggctgcaggaattcgcacgagaccattacctagaacatcctaatcgaaaactcccaaccgccgcgcgcgcgcgcagaaccaaccaacttaaaccgccaacaccgagcccaaggcacaaacgttcccatggcgcggctggtgtcgacggcgacgaaggcaatggcggtcgtggtcctcgcggcggcgtcggcagcgctggccgcgcacgactacggtgacgccctccacaagagcatcctcttcttcgaaggccagcggtccggccggctgccaccgaaccagcgcctccggtggcggcaggactcggccatccacgacggcgccgaggcgggggtggacctgacgggcgggtactacgacgcgggcgacaacgtgaagttcgggttccctatggcgttcacggcgacgctcatgtcgtggggcctgatcgacttcggtcgcagcttcggcgcgcacgaggcggaggcccggcacgcggtgcggtgggcgacggactacctgatgaaggcgacggcgacgccgggggtggtgtacgtgcaggtcggggacgcgtcccgggacccgcgtgctgggagcggccggaggacatggacaccccgcgcaccgtgtacagggtggacgcgccgcccccggcgtccgacgtggccgccgataaccgcgaggtgctggcggtcgggctccatctgtt

SEQ ID NO: 25216 - protein, 187 aa, Zea mays
  misc_feature: Ceres CLONE 1396715-F
  misc_feature (28)..(187): Pfam Name: Glyco_hydro_9 Pfam Description: Glycosyl hydrolase family 9
  misc_feature: SWISSPROT Homolog: EC 3.2.1.4 Cellulase
MARLVSTATKAMAVVVLAAASAALAAHDYGDALHKSILFFEGQRSGRLPPNQRLRWRQDSAIHDGAEAGVDLTGGYYDAGDNVKFGFPMAFTATLMSWGLIDFGRSFGAHEAEARHAVRWATDYLMKATATPGVVYVQVGDASRDPRAGSGRRTWTPRAPCTGWTRRPRRPTWPPITARCWRSGSIC

SEQ ID NO: 25217 - DNA, 738 bp, Zea mays
  misc_feature: Ceres CLONE 1396717-F
  misc_feature: Encodes the peptide sequence at SEQ ID NO. 25218
caaagctggagctccccgcggtggcggccgctctagaactagtggatcccccgggctgcaggaattcccacgagaccattacctagaacatcctaatcgaaaaatcacaattcacagcgctcaagttctcgcgcccacagccaaatttttctccactcaatcgcgggataagctgcactgcagccatggacgccagcggagccggtagcaaggcgaagaagggggcggctgggcgcaaggctggcggccccagcaagaagtcggtgccgcgggccgacaagggcgggctgcagttccccgtcgaccggatcgggcgctacctcaagaaggggcggtacacgcagcgcgagggcaccggcgcccccgactatctcgccgccgtgcttgagtacctcgccgccgaggagctggagctggtcgggaacgctactaacgacaacaagaagacgcgcatcgtcccgcgacacttgctcctgggcgattcgcaacgacgttgagctcggcaagctgctgtctggcgtcaccatcgcgcacggcggaggcctccccaacatcaacccggttctcctgcccaagaatgtggcgcacaaggcgtccagcgtgggaagcaacgagagcaagtcccctaagaaggccgccaagaccccaaagaaggcatccaacgacccgaagaaggcttagaaattacgcacttcactagcgctctgctgtatcatgtccgagtccagatctgtggaa

SEQ ID NO: 25218 - protein, 103 aa, Zea mays
  misc_feature: Ceres CLONE 1396717-F
  misc_feature (29)..(102): Pfam Name: Histone Pfam Description: Core histone H2A/H2B/H3/H4
MDASGAGSKAKKGAAGRKAGGPSKKSVPRADKGGLQFPVDRIGRYLKKGRYTQREGTGAPDYLAAVLEYLAAEELELVGNATNDNKKTRIVPRHLLLGDSQRR

SEQ ID NO: 25219 - DNA, 735 bp, Zea mays
  misc_feature: Ceres CLONE 1396721-F
aaagctggagctccccgcggtggcggccgctctataactagtggatcccccgggctgcaggaattcgcacgagaccattacctagaacatcctaatcaaaaaactgtcatgggagcgtgtcctcctatcacctgagctccagacactcacacacagagacttggacgggcaagcaaaaattacttcatatatgcacgctcggtagtaggagatctcccccatcactgcgagccgcatcgcgacaagatggagcaactgcaagctcagtgtagacctccatgcagtacgacgacaccgtatctacggtgcgttgcatcatcttgacttgcatgcagtgcatggtcaacgaggcctatgaggtctacgacgtcaggtacccaaccgcccagccgccgccgtcggctcttctcctgtcgcggcgacatgcatcaacctgctgcctacggcgcgaggactcctacccccgctgccaggtggacgccacacatatcgatggtttcggatagcgacataaagatatatagcatcacggttacatgttagacaacgacatccaagggactatccatctgcaacgacaacgctcctcctctgcataaccactctggcacaaagctgcaacaggactcctgccttggagctgatgccaacgccgctgcctgcaacagcgccaagagccacctctgaaaccagacctcatgggagacatcattcacgaatactgcatctgaagat

SEQ ID NO: 25220 - DNA, 742 bp, Zea mays
  misc_feature: Ceres CLONE 1396722-F
  misc_feature (440)..(440): n is a, c, t, g, unknown, or other
  misc_feature (452)..(452): n is a, c, t, g, unknown, or other
  misc_feature (650)..(650): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
aaagctggagctccccgcggtggcggccgctctattaactagtggatcccccgggctgcaggaattcgcacgagaccattacctagaacatcctaatcaaaaagagggcgcgcattactctgcagcgcggacacgcccggcacggcaagccagccactcttctcgcgtgaagctgccaggacgagagagagagaggaggaggattagcttagccattcttgcggctgggcaaggaaactgctgaagccactagccggctgcctgctctacttcctccgaaccgaacgaggtgcatcgtgaggaagcagcagcagggggggcagtggacgggcgggatgacgggcagggaggtcgtgtcggcgtgggacgctgagctggattaggactcagcggcggtggcgaacaccgtggtggtgaccccgctcagcgagaacctttgnaagggaccgggncggcccccaagggcgcccggggacctcccccggggaattgtctggcccccccgaaacgccgcaaacctccccgtggacgaaggagcttcggtatccgggaaaacacaggccccggccgcaagggtcttccccgggccacgccccaaggcccggaacccctcccccccccccccgggggccccctccgggtcttcccanaaaaaccccggtctggtgnnnnagcctcccatgcgggagcgcccctttcgctggtatacccctttttttttttaagggggcaccccccctcg

SEQ ID NO: 25221 - DNA, 745 bp, Zea mays
  misc_feature: Ceres CLONE 1396723-F
  misc_feature: Encodes the peptide sequence at SEQ ID NO. 25222
aaagctggagctccccgcggtggcggccgctctataactagtggatcccccgggctgcaggaattcgcacgagaccattacttagaacatcctaatcgaaaacaaagcctttcttcctcctgtgaagccaactcgtcccctcgggccaacgcgaggccaaaaccaatctcacatctcctccccctcccaccaccgaggacccttccccaagaactgctccgagtcctggagcgggagagaggtcgagggaggagcccaataagagtttctcctcgcctctctctctctctttctgctcgaaaaattattgtcgcattggtttggttcccttgccaaaggaggctgcttttctgtcctccctgatctaacatgatggcgagcaccgcatcagcgaccgccgccgccgccgccgtggcattcggggcagccgccaaggcgcggggaccggcggatgaggcgctccgcgcaagggtgcctgccggcggtaggcggagctccggcgtggaggtgcgctgcgacacccgcgtggagatccaggcgcacgcggcgggcaaggacgccagcatcgtcgcgctcgagcagatcaagatctccgcagaccgctacatgaaggaaaggagtaacgtacctgtgctaggtcacagtgaacacacagcaccagcggatatgcgtgaaatacttgcgctggcagaagaactatgaacccgtgctattcaagaactgactagtctacatcatatcgaag

SEQ ID NO: 25222 - protein, 109 aa, Zea mays
  misc_feature: Ceres CLONE 1396723-F
  misc_feature: SWISSPROT Homolog: EC 1.2.1.70 Glutamyl-tRNA reductase
MASTASATAAAAAVAFGAAAKARGPADEALRARVPAGGRRSSGVEVRCDTRVEIQAHAAGKDASIVALEQIKISADRYMKERSNVPVLGHSEHTAPADMREILALAEEL

SEQ ID NO: 25223 - DNA, 662 bp, Zea mays
  misc_feature: Ceres CLONE 1396724-F
  misc_feature: Encodes the peptide sequence at SEQ ID NO. 25224
aaagctggagctccccgcggtggcggccgctctagaactagtggatcccccgggctgcaggaattcgcacgagaccattacctagaacatcctaatcgaaaaaaaaatatgataacacatcaattgccagtcgtcgtccccaccgctggccgcgcggaagcccgcgaagatgtccctcggcgggaccagcggcccgcgcgtctgcgcccggatctgcaagctcgccggacgccgccagcggatgctcctccgcctcctcgtctccgtcgccgtggcattctgcttcctcttctcatcacttgtcagtaaagacgaagatgcatcacctggtgttgagaccatgcttgtgttttctgatcatgtccggagctttgtgaaccctgtttggacatcgtcaggcagaccagttgatagaaaacgcactggaccacgaccttgtccagtttgttatttgccagttgagcaagcactggcactgagaccagctaaaccatcattgtcaccagtccttcaaagcttaaattatgttcttgaagagattttgattcctaaagagtccaagagcggttctttgtttggaggttttccatccctggaggaacgagataagtcttatgacataaaagactcgatgagtgtacattgtggatttgtaagaggga

SEQ ID NO: 25224 - protein, 164 aa, Zea mays
  misc_feature: Ceres CLONE 1396724-F
MSLGGTSGPRVCARICKLAGRRQRMLLRLLVSVAVAFCFLFSSLVSKDEDASPGVETMLVFSDHVRSFVNPVWTSSGRPVDRKRTGPRPCPVCYLPVEQALALRPAKPSLSPVLQSLNYVLEEILIPKESKSGSLFGGFPSLEERDKSYDIKDSMSVHCGFVRG

SEQ ID NO: 25225 - DNA, 678 bp, Zea mays
  misc_feature: Ceres CLONE 1396726-F
  misc_feature: Encodes the peptide sequence at SEQ ID NO. 25226
  misc_feature (293)..(293): n is a, c, t, g, unknown, or other
aaagctggagctccccgcggtggcggccgctctagaactagtggatcccccgggctgcaggaattcgcacgagaccattacctagaacatcctaatcgaaaagaggaggcagtgcggagacgggagccagtggccagtgacagtgagcggcgacgttccagtgtccactgtccagtaggcgagcgaggaggtggtccattggccggccatggctcgtctccgctgcgtcttcgtcgtcttcgtcctgctctcgtctgccctccgccttccaggcgacgccattgcctcccggnggcaccatggccccgccgcacacgactacagggacgcgctcgtcaagtccatcctcttcttcgagggccagcggtcgggcaagctgccgccgtcgcagcgcgtgtcctggcgcagggactcgggactctccgacggtcactccgccaaggtggacctggtgggcgggtaccacgacgctggtgacaacgtcaagttcgggttcccgatggcgttcagcatgacgatgctggcgtgcagcggggtggagtttggcggcctcatgaagccggatctgcagcacgccagggacgccgtcccctggggcgccgactacctgctcagggccacggcgcacccggacacccatctacgtccagggtcggtgaaccgaccaaggaccccgtc

SEQ ID NO: 25226 - protein, 156 aa, Zea mays
  misc_feature: Ceres CLONE 1396726-F
  misc_feature (37)..(156): Pfam Name: Glyco_hydro_9 Pfam Description: Glycosyl hydrolase family 9
  misc_feature: SWISSPROT Homolog: EC 3.2.1.4 Cellulase
  misc_feature (29)..(29): Xaa is any aa, unknown, or other
MARLRCVFVVFVLLSSALRLPGDAIASRXHHGPAAHDYRDALVKSILFFEGQRSGKLPPSQRVSWRRDSGLSDGHSAKVDLVGGYHDAGDNVKFGFPMAFSMTMLACSGVEFGGLMKPDLQHARDAVPWGADYLLRATAHPDTHLRPGSVNRPRTP

SEQ ID NO: 25227 - DNA, 718 bp, Zea mays
  misc_feature: Ceres CLONE 1396732-F
  misc_feature: Translation starting site: 129
  misc_feature: SWISSPROT Homolog: EC 3.2.1.4 Cellulase
  misc_feature (494)..(494): n is a, c, t, g, unknown, or other
  misc_feature (521)..(521): n is a, c, t, g, unknown, or other
  misc_feature (565)..(565): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
caaagctggagctccccgcggtggcggccgctctagaactagtggatcccccgggctgcaggaattcgcacgagaccattacctaaaacatcctaatcgaaaaatcacaagcaatcgatagagctagcatggcggtgaaggtgtgggtgttcgccgtggctctgatgatgtgcgctggtgtacggcttggagctgacgacgacggcggcagccgccttattagccgctgtcgtctgagctcgcccaactaccgcggcgccctggcaaaggccatcctcttcttcgaggggcagcggtcggggcggctgccggcaaaccagagagtcaggtggcgcggggactcggcgctcaccgacggccaacccgaaaacgtgaacttgacgggtggctactacgacgccggagacaacgtcaagttcggtttcccgatggcgttcagcgtcaccctcctgagctggagcgccgtcgagtaccgcgacgaggtggcgggcggncggtcagctccgccacccctccgtcgncatccagtggggcgccgacttccttttctcgtgcccacacacgncgaccaccctctacactcagggtggcgacggcaacgccgaccaccaatgctgggagcggccagaggacatggacacgccgcggacgctgtacaagatcacccggagctcgcccgatcgagcgccnnnannnngggggggggggggctctcccc

SEQ ID NO: 25228 - DNA, 656 bp, Zea mays
  misc_feature: Ceres CLONE 1396733-F
  misc_feature: Encodes the peptide sequence at SEQ ID NO. 25229
  misc_feature (645)..(645): n is a, c, t, g, unknown, or other
  misc_feature (654)..(654): n is a, c, t, g, unknown, or other
aagctggagctccccgcggtggcggccgctctagaactagtggatcccccgggctgcaggaattcgcacgagaccattacctagaacatcctaatcgaaaaaatgaccattgcgtgatagatcgcaccggtctcggtctccgtgtctcactctcaagttgcagcagccagtcatttcgttggcaaccagggcagaaataaatatccgtggataagagctgcgctgtgtgctgctgagatatcaagaacggtagggtggaagacaaggccccgttctcgattaacccaagccaaagagtcagagggagagagagagagagagtcgtattggtcgtcacctgtcgaaggttttcggtgtctcctgagccacagctgctgctgctgctggaaccatggagatggaggccgtggagtcgcacggcggcgccggtcgccggacgcccaagagggatcgcggcatctcctgggcctgcgtcttcatcctggcgagtaactgcttccagttcatcgcctacttcgccgtgtcgacgaacctggtgaactacctcaaggaccgcctgcaccagggcagcaaagccgccgcgaacggcgtcaccaactggatgggcacgagcgccatcacgccgctcgtcgccgcctttctcgncgacgcttnct

SEQ ID NO: 25229 - protein, 87 aa, Zea mays
  misc_feature: Ceres CLONE 1396733-F
  misc_feature (85)..(85): Xaa is any aa, unknown, or other
MEMEAVESHGGAGRRTPKRDRGISWACVFILASNCFQFIAYFAVSTNLVNYLKDRLHQGSKAAANGVTNWMGTSAITPLVAAFLXDA

SEQ ID NO: 25230 - DNA, 729 bp, Zea mays
  misc_feature: Ceres CLONE 1396734-F
  misc_feature: Encodes the peptide sequence at SEQ ID NO. 25231
  misc_feature (25)..(25): n is a, c, t, g, unknown, or other
  misc_feature (28)..(28): n is a, c, t, g, unknown, or other
  misc_feature (29)..(29): n is a, c, t, g, unknown, or other
  misc_feature (31)..(31): n is a, c, t, g, unknown, or other
  misc_feature (36)..(36): n is a, c, t, g, unknown, or other
aaagctggagctccccttcggtggnggnngngcggntttaccgtttatctttgggggtgcaggattttccacaacaccattagctagaacatccgaatcgaaaaatcgcagaaattctccgctacttcacagcgtatcatcgttttccatcgctcctactcctatcatccagaaaatctgagcggtattgatggcgcccaaggcggagaagaagccggcggcgaagaaggtggcggaggaggagccctcggagaaggcggctccggcggagaaggcccccgcggggaagaaggccaaggcggagaagcggctacctgcgggcaagtccgccggcaaggagggcggcgacaagaaggggaggaataaggcgaagaagagcgtggagaccgacgagatctacatcttcaaggtctccgttctcccccaattcgccttcacctcgccgcttcctccttgaccgccaccgttgacgtcgtcttccggcgaggtagctcgccggaagacctcacctggacttttccgacgcaccctccacacactctttaaccctccggaatggccgcctgcttctagctcgtcgacgccccaatctccgcttgcttcctcgacagccccatccgcctcttctcgctctcgctacggctcctctgcctgttcgccatggcgatccgcatcaccgtctcctactccggctacgtggcgcagaacctcgccgcgtcgctcgggcac

SEQ ID NO: 25231 - protein, 88 aa, Zea mays
  misc_feature: Ceres CLONE 1396734-F
MAPKAEKKPAAKKVAEEEPSEKAAPAEKAPAGKKAKAEKRLPAGKSAGKEGGDKKGRNKAKKSVETDEIYIFKVSVLPQFAFTSPLPP

SEQ ID NO: 25232 - DNA, 508 bp, Zea mays
  misc_feature: Ceres CLONE 1396738-F
  misc_feature: Encodes the peptide sequence at SEQ ID NO. 25233
  misc_feature (257)..(257): n is a, c, t, g, unknown, or other
  misc_feature (276)..(276): n is a, c, t, g, unknown, or other
  misc_feature (279)..(279): n is a, c, t, g, unknown, or other
agagctggagctccccgcggtggcggccgctctagaactagtggatcccccgggctgcaggaattcgcacgagaccattacctagaacatcctaatcgaaaaccatccatccatccagttagttagttagtaagttagttgagggagaagaagcaggggaggggagcgatgagcacatgctgcggctcgccgccgctggacctctgcaggtggtgctcttcgccgctgtgctcctcgtcgtcgtcgccgacgccggngtgacgagccagtaccggncgnaagcttggaggcgacggtgggaaatggccactgaaacgcccgaaaagttcttttccggggtcccggcggggggtaaaattgcgccccgcaaacaggggggccaatccacgttggggtggacccagaagggccccgggaaataattcggtgcccgggggggaagcgccaaatgggttttgggcacaaaacacccccttttttttaaagggaggggggtccccccggaacc

SEQ ID NO: 25233 - protein, 81 aa, Zea mays
  misc_feature: Ceres CLONE 1396738-F
  misc_feature (34)..(34): Xaa is any aa, unknown, or other
  misc_feature (35)..(35): Xaa is any aa, unknown, or other
MLRLAAAGPLQVVLFAAVLLVVVADAGVTSQYRXXAWRRRWEMATETPEKFFSGVPAGGKIAPRKQGGQSTLGWTQKGPGK

SEQ ID NO: 25234 - DNA, 690 bp, Zea mays
  misc_feature: Ceres CLONE 1396745-F
  misc_feature: Encodes the peptide sequence at SEQ ID NO. 25235
aaagctggagctccccgcggtggcggccgctctagaactagtggatcccccgggctgcaggaattcgcacgagaccattacctagaacatcctaatcaaaaaactgccccatggcccattgcttacgcataactgcggcggggacacgcgacgctaccgacttcgccgccgcctccttccttccgcccgtcgagtcgaccgatcgattgttcgcggcctccctcctagtcagatccactcaatcccaagaggccaagtccaaaccctacccaccacccttctcaaccagcgatgatggcagcggagcactcgccgtcggttccctccaccgccgctgacgccctggaaaccctcgccctcgactcatcctcgtcgtccgccgccgctaccgcctccacttccaccgaccccctcctccggccacctacctccccgaccgccgccgcgagcgacgacctatttgtcatcgacgacttcgacgaggacgacttctccaccgccccggcgcccaacgtcgcccgcctgccgcgcgctgcgcgtggcgatgcggcgtccccagtgttcgccaaaatcaccgtatcggatcccaagaagcacgcggagcccagcggcgggggtgccgccggtgtgatcccggggtccggtagctacttctcttacctcatcccaccgtttggggcgggggggggg

SEQ ID NO: 25235 - protein, 133 aa, Zea mays
  misc_feature: Ceres CLONE 1396745-F
MMAAEHSPSVPSTAADALETLALDSSSSSAAATASTSTDPLLRPPTSPTAAASDDLFVIDDFDEDDFSTAPAPNVARLPRAARGDAASPVFAKITVSDPKKHAEPSGGGAAGVIPGSGSYFSYLIPPFGAGGG

SEQ ID NO: 25236 - DNA, 737 bp, Zea mays
  misc_feature: Ceres CLONE 1396747-F
  misc_feature: Encodes the peptide sequence at SEQ ID NO. 25237
  misc_feature (1)..(1): n is a, c, t, g, unknown, or other
  misc_feature (11)..(11): n is a, c, t, g, unknown, or other
  misc_feature (12)..(12): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (29)..(29): n is a, c, t, g, unknown, or other
  misc_feature (30)..(30): n is a, c, t, g, unknown, or other
  misc_feature (32)..(32): n is a, c, t, g, unknown, or other
  misc_feature (33)..(33): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
ncccccccccnncccnnnnnnnccctccnntnngggggattgagagcnnnnccagagctggagctccccgcggtggcggccgctctagaatagtggatcccccgggctgcaggaattcgcacgagaccattacctagaacatcctaatcgaaaagacaacacagcctgcgctccccttctttcccgttcggctcacagcgaagaaggaagccggttagggtttccacctcctttcccctcctctccttcagcgacgaccgcaggccacaccctcgatatccttcccctcggacccggaggcgagcagcagcctccagcgcctgccacgcctgcccgtctcgttattgggaggattcgccatgtctgacatggagtccgtcgcagctcttatgaactcgacaagctccaagatacagcagcttcggggagggggggtgctgagcttgagagccagagcacggtttccatgaacctcaagtggaagcatcttgaagaccactttcgtggtcttgaacagtccctcaagaaaaagtttgacgagctaaaagagcagggagaaggagttccaggagactgtcgcaaaatcagagcagattctggagcagcgggaggcagctgttgtggcaaaggaactgacctctttggagaagttgcaggagaagagggaagctgcattagctatgatctttagcaaggccaggctttccttacctgttcctaccatcaaccaatggaaa

SEQ ID NO: 25237 - protein, 36 aa, Zea mays
  misc_feature: Ceres CLONE 1396747-F
MSDMESVAALMNSTSSKIQQLRGGGVLSLRARARFP

SEQ ID NO: 25238 - DNA, 734 bp, Zea mays
  misc_feature: Ceres CLONE 1396751-R
  misc_feature (21)..(21): n is a, c, t, g, unknown, or other
  misc_feature (32)..(32): n is a, c, t, g, unknown, or other
  misc_feature (33)..(33): n is a, c, t, g, unknown, or other
  misc_feature (35)..(35): n is a, c, t, g, unknown, or other
  misc_feature (39)..(39): n is a, c, t, g, unknown, or other
gggttttttgtggtggggggnggtcgattttnncnatancaataattcaacatatcgaattgggtaccgggccccccctcgaggtcgacggtatcgataagcttttttttttttttttttcggcgtatcagaacatttttaattcctatctccgagattccaaatgttataatctgtagtgttacactgatgatgaattgatgatggctgatgagcaaacaccagacagcttcgtcgaagcctgatgctaatggttcgatgtttcagcaacaacacatggcaaaaaagaaaagaaaaagtctttctggattcctagcatacaaaatcgttgtccttgttgaatatggtcaggtctaactcctgccagttggttcgcagggtgatgaaaaagaggacgcggttctggcagaggaggctggatatatgccccatccacagccccttggtttggaaggcgagcgtgaatccgagaggatggcgagcggcaagccgatgacatagaaggccaccaggttggtccacgctgccaggtgctgccacccgcagcccatcataaatccaatacgttgaatccaaacgatttcttaaaccacttctcctttcctggggtataagtttgcaaactggcacttttctcccatccgcaaagaccatcacacccccataattattagcatgcattgtcagatcaatgcaaacaacagctactactacttgtattcgacccttaaaca

SEQ ID NO: 25239 - DNA, 752 bp, Zea mays
  misc_feature: Ceres CLONE 1396752-F
  misc_feature: Encodes the peptide sequence at SEQ ID NO. 25240
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (30)..(30): n is a, c, t, g, unknown, or other
  misc_feature (31)..(31): n is a, c, t, g, unknown, or other
  misc_feature (38)..(38): n is a, c, t, g, unknown, or other
  misc_feature (39)..(39): n is a, c, t, g, unknown, or other
  misc_feature (47)..(47): n is a, c, t, g, unknown, or other
nnnnnnnnnnnnnnnnnnnggggggggggnnggggggnncgggacgnggggcaaagtgggactccaccgcggtggcggccgctctagaactagtggatcccccgggctgcaggaattcgcacgagaccattacctagaacatcctaatcgaaaaaaggcttcgttctgctctccggctctcccgcatccaccccgtctcatccccaatccgaccacctcatccctcgcctccatggccctacccctcgcgtcaccggcgggggcatgagccggtgactgctcacgcggcctcgtctgtctgcgcacgcgcgcggggtcggcgagtgagcattgcggcggtccgcgatcgcccgtgggggagcatggcgtcggcggcggggtcggccggcggggccggcgcggggtctggcgggctgaagacctacttcaagacccccgaggggcggcacaagctgcagtatgagaagacgcactcccccgccgtcgtgcactacagccacagcggcaagaccgtctcccagatggacagtggcatatttgaaggagaagccaggaggccagggttccacgccttcaacaccaagtgctggtagggggatgcggtctgcaggctgcaagacttctcggcactggggagggggaggcgggcacttaagctttcggagcaatggtacccagcaggggttggtctcaggaaagcacccgcatggggtgggagggaattgggggggtcccaccaagtgggggggggg

SEQ ID NO: 25240 - protein, 76 aa, Zea mays
  misc_feature: Ceres CLONE 1396752-F
MASAAGSAGGAGAGSGGLKTYFKTPEGRHKLQYEKTHSPAVVHYSHSGKTVSQMDSGIFEGEARRPGFHAFNTKCW

SEQ ID NO: 25241 - DNA, 759 bp, Zea mays
  misc_feature: Ceres CLONE 1396753-F
  misc_feature (21)..(21): n is a, c, t, g, unknown, or other
  misc_feature (24)..(24): n is a, c, t, g, unknown, or other
  misc_feature (55)..(55): n is a, c, t, g, unknown, or other
  misc_feature (57)..(57): n is a, c, t, g, unknown, or other
  misc_feature (59)..(59): n is a, c, t, g, unknown, or other
  misc_feature (89)..(89): n is a, c, t, g, unknown, or other
  misc_feature (114)..(114): n is a, c, t, g, unknown, or other
  misc_feature (575)..(575): n is a, c, t, g, unknown, or other
  misc_feature (634)..(634): n is a, c, t, g, unknown, or other
acagctggagctccccttggnggngggggggggggtttacgttgtctgggggggngnangaattacacaaccaccatgggcgagaacancctaatcaaaaagagggggaggcanagagcttggcatcccaagcaaagggtccctctccttccccacctcgcgctcaacccccctcatcctcccacatccgattggggcctgcgctctggcggtctcttatccaagatttcgccggcggcggctcagggagcggacaaagattggttttttttcgggctatggagacgagggctgattcattcagccccgggcggtggagtggcttcctgaccgggtctgattcgtattgggtcaaatgatctgggcggcttaattgggtggggggggttccaccggggaatcggagctagggctgtggtttggtggccggctggtggattcgtcgggttgggtctggtgagatcttgagggtttctgggtcagcacacgggccgcaggtctgcggagatcccctcttcgattccgtggcggatttggttaggggtttgggttgaggctgggggaagatgattaancagatccttgggcaggctgccgaggaacccgggggaaggctgggggataacacggaaanctgctgctggcgggggatgggaactgagcccctcccaatttcctacaagtggttggggaggggggattggacccaggggaaccaaaagggggtgggaaatgggagaactatccagggttccatcg

SEQ ID NO: 25242 - DNA, 700 bp, Zea mays
  misc_feature: Ceres CLONE 1396758-F
  misc_feature: Encodes the peptide sequence at SEQ ID NO. 25243
  misc_feature (540)..(540): n is a, c, t, g, unknown, or other
aaagctggagctccccgcggtggcggccgctctagaactagtggatcccccgggctgcaggaattcgcacgagaccattacctagaacatcctaatcaaaaacgaatcaccaacaccctctcctccaccttccatcccgatcaccgccgccaccgctttcgttccacgtcccgatggcaccggtagatctaacccccaggcagccccggaaggcgtatggcggcgacgccggcgcctactacgagtggagcccagccgacctgcccatgctcggcgtcgcctccatcggcgcagccaagctctccctcgccgccggtgggctctcgctccccagctactccgactcttccaaggtcgcgtacgttcttgaaggcactggcacctgcggcatcgtcctgccggaggcgaccaaggagaaggtgctggccgtgaaggagggcgacgccctcgcgctccccttcggcgtggtcacgtggtggcacaacggccccgccgcgcccgaccagctcacggtcctcttcctcggcgacacctcaaggnccacaggccgggggcagtccaccaactccagctgacgggggggaaggggatcttcacggggtttccccccgaaatccggtgcccggggctgggaacctgccggaggggaaaaacccccgggccttggttaaaacccaaccgggggtgggaatttacgggg

SEQ ID NO: 25243 - protein, 133 aa, Zea mays
  misc_feature: Ceres CLONE 1396758-F
  misc_feature (6)..(132): Pfam Name: Cupin_1 Pfam Description: Cupin
  misc_feature (123)..(123): Xaa is any aa, unknown, or other
MAPVDLTPRQPRKAYGGDAGAYYEWSPADLPMLGVASIGAAKLSLAAGGLSLPSYSDSSKVAYVLEGTGTCGIVLPEATKEKVLAVKEGDALALPFGVVTWWHNGPAAPDQLTVLFLGDTSRXTGRGQSTNSS

SEQ ID NO: 25244 - DNA, 713 bp, Zea mays
  misc_feature: Ceres CLONE 1396762-F
  misc_feature: Encodes the peptide sequence at SEQ ID NO. 25245
  misc_feature (397)..(397): n is a, c, t, g, unknown, or other
aaagctggagctccccgcggtggcggccgctcttgaactagtggatcccccgggctgcaggatattcgcacgagaccattacctagaacatcctaatcgaaaaacacacaaaccgccgccgccgctaccttcaccactgcggactgcaccagctgcccgccgactactccgtttctcttcctagtacattgccgcgtcgaaggcgaggtcctcagcagcgccggcggactccgctcgcacgccatactcagcctactccgtcttcccctgtctagcagacaccctcttcccctctccactcccaatcttatcgtcgcctccctcgacgtcgctgctgcctccacttcaccatggcgcttcacgccccggtcctcgttctgaaggactcgctgaagcnggagtctggcgcgaaggttcaccaagccaacatccaggcggccaaggctgtcgctgacatcatacgcactacattgggtcccagatccatgctgaaaatgcttctggatgctaggggagggattggggttacaaatgagggtaaagccattttgagggaaaaaaaattgcccaccctgctgccaaagctatgatcaaactaagtcctacccaggatgaaaaatttggggagggacaaaatccggcattgtccaaaggggaaaaaggcaaatggtgcacaggattttcctcaaaaaaacccccctcccccgtgtttt

SEQ ID NO: 25245 - protein, 79 aa, Zea mays
  misc_feature: Ceres CLONE 1396762-F
  misc_feature (16)..(16): Xaa is any aa, unknown, or other
MALHAPVLVLKDSLKXESGAKVHQANIQAAKAVADIIRTTLGPRSMLKMLLDARGGIGVTNEGKAILREKKLPTLLPKL

SEQ ID NO: 25246 - DNA, 676 bp, Zea mays
  misc_feature: Ceres CLONE 1396763-F
  misc_feature: Encodes the peptide sequence at SEQ ID NO. 25247
  misc_feature (428)..(428): n is a, c, t, g, unknown, or other
aaagctggagctccccgcggtggcggccgctctagaactagtggatcccccgggctgcaggaattcgcacgagaccattacctagaacatcctaatcgaaaaacattagattttttgtatgaaacgcccgtaaccgacttgctcctcaagcctccctgcctgccagctcactcgccttcttcctcccattcccctcgaatcaaccagcagcgattcagatcgaaacgaaacgaaccaaaccaaccaactcgccaccctccaaagccgcagccccaatcccaccgccggccaggcaggcagagcgcgccccgcgccatgtcagccacgtcgtcgttcacagcgggggagtcgtctcgagctggcgagcaaccggagcgcgacgaggtggtcgagttcctggactgcccttgggtagcactctcctccgncatcgtcgtcatcggcgccaacgacgagcgggcacggatgctcccggcccggtgccttcgaaaattttttctagacctccaggccccccggggggggggggcgccccaaatttgggcttggccaaaggaatttggccccaaaagggttttgggtgcaccccccggggttgtggcccgggggacaaaggccccccttttgggggaatacaaacaagggggtgtaaaaaaccccccttttttttccggac

SEQ ID NO: 25247 - protein, 120 aa, Zea mays
  misc_feature: Ceres CLONE 1396763-F
  misc_feature (38)..(38): Xaa is any aa, unknown, or other
MSATSSFTAGESSRAGEQPERDEVVEFLDCPWVALSSXIVVIGANDERARMLPARCLRKFFLDLQAPRGGGAPQIWAWPKEFGPKRVLGAPPGVVARGTKAPLLGEYKQGGVKNPPFFSG

SEQ ID NO: 25248 - DNA, 657 bp, Zea mays
  misc_feature: Ceres CLONE 1396765-F
  misc_feature: Translation starting site: 288
  misc_feature (526)..(526): n is a, c, t, g, unknown, or other
aaagctggagctccccgcggtggcggccgctctagaactagtggatcccccgggctgcaggaattcgcacgagaccattacctagaacatcctaatcaaaagtttatacgttcagggctactattgaagcagactccacccggcgcgtcctcgtctcgtctcgtctcgcacgcacccctcactttccttgtcaatcgactcgcgatcgaatccgccccgagtcgattccgccgcggaccgcccggttcacttcccttttctcccgagatctcgactctcgagcaagtatgggtgaggcgaaggacaacgaggtgtacgaggaggacctagtcgactatgaggaggaggtggagaatgtcattgatggcgcccccaccaacggctcctcagatgtcgtcaagaaagggtacgtaaggatccacagcttcgggggtcagagacttcctgctcaagccagagcttcttcgcgccattcaggattgcgggtttgagcatcctttctgagtgcaacatgagtgcatccctncagctattcttggaatggatgtcatctgtcaagcaaatctggaatgggtaagactgcagtttttgtcctgtcaactcttcagcagattgatccctgtgctgggcagtagctgcacttgtgttgtgccacac

SEQ ID NO: 25249 - DNA, 788 bp, Zea mays
  misc_feature: Ceres CLONE 1396770-F
  misc_feature: Encodes the peptide sequence at SEQ ID NO. 25250
  misc_feature (17)..(17): n is a, c, t, g, unknown, or other
  misc_feature (18)..(18): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
ttcctcacctccccctnntgtgcccccgcgcgcgcgggggggnnnatccaactggaactccccgcggaggaggccgctcattaacagaggatcccccgggctgcaggttttcccacgagaccattacctagaacatcctaaaaaaaaatcactacctctccctctccgtcgcgacacaggccacggcgggcggcggcggaggcttccgtgcggctcttggcggattgaacgcccactcgagctgcgccgggggatgattcagccgtccttagatagaccctgctttcctcccgggcgaatcaaagttgcacaaatgccgacaccagtgaagtcggtgctccccgtggagctcctcggctgcggcggtgtcggccggtacctcctccgccacatcgtctcctgtcgtcccctccacgccaaccagggagtggccatccgggtggagggcgccgccgatagctcctccctgctcgtcgccgaagatgtccactacaccggcctacgatgacgggctcctcacccagctctgcgccgtcaagtccgcaggctctcccctctcctccctgctcggccgagggcactgtcagctgttccagaaccctgaggctaggggcaaagccctagagcgccgctaccacactttggaagaacaaccggtcctggtgctcatttgactggtctggcaattcaggaccccgataacccgactcgaagcagccagcggaatcatggaaggctcggtcccaattgaccaagacataataccccttcccggggcctcatggacg

SEQ ID NO: 25250 - protein, 64 aa, Zea mays
  misc_feature: Ceres CLONE 1396770-F
MPTPVKSVLPVELLGCGGVGRYLLRHIVSCRPLHANQGVAIRVEGAADSSSLLVAEDVHYTGLR

SEQ ID NO: 25251 - DNA, 725 bp, Zea mays
  misc_feature: Ceres CLONE 1396775-F
  misc_feature: Encodes the peptide sequence at SEQ ID NO. 25252
aaagctggagctccccgcggtggcggccgctctagaactagtggatcccccgggctgcaggaattcgcacgagaccattacctagaacatcctaatcaaaaggtggttgacggccgcttacccgcaccggcgccatgcgcgcgcgcggctaggtggtcgaggtcaagccaaacgctgcccaccgcctctgcctctgcctcgcatatatcctcgcgcacgttctttgctcgtctcgcactcgcttccttcgacgactcatcgccgatcacaccaggctagctagcccacccacagtcgtagggccaggaccgatcggaggagctcggtttttcgaccaggaccgccgccgccacacccgaagaagccgacgatgcagacgacgacgtcctcggcggcggcgtcgccgcgcccgcgcgcgcgggcgccgcagtccgtggtggccgagctggagggcgcgctgctccggagcgcggacacgttcccgtacttcatgctcgtggcgttcgaggcgtccgggctgccgcgcttcacgctgctgctggagctgtggccgctgctgcggttgctggaggtggcgggccggcgcggtctgccgctgcgcgccgccgcgttcgtggccaccgcgggcgtgccgcccgccgaggtgtaggcagtgtcgcgccgcgtgctgcccaagtcatcgccgacgacgtcgtccccgccgcgtgggccgccttcaggagctg

SEQ ID NO: 25252 - protein, 92 aa, Zea mays
  misc_feature: Ceres CLONE 1396775-F
  misc_feature: SWISSPROT Homolog: EC 2.3.1.15 Glycerol-3-phosphate O-acyltransferase
MQTTTSSAAASPRPRARAPQSVVAELEGALLRSADTFPYFMLVAFEASGLPRFTLLLELWPLLRLLEVAGRRGLPLRAAAFVATAGVPPAEV

SEQ ID NO: 25253 - DNA, 746 bp, Zea mays
  misc_feature: Ceres CLONE 1396778-F
  misc_feature: Encodes the peptide sequence at SEQ ID NO. 25254
aaagctggagctccccgcggtggcggccgctctagaactagtggatcccccgggctgcaggaattcgcacgagaccattacctagaacatcctaatcgaaaaaagggctctacacgaagttaggcggccaagtgttcgcaaccaacccctcttcctcgcccactgaaaggttcagaggctcccgttttagcatagcgaccgagacgaaggagtgggggggcggagagctttgggccctggccaggatgaagtttatgagactcggcacccggccggacaccttcttcaccgccgccgactccgtgaggtctgtctgcacggaggtggccacggacctgcagatcctcgtggataactgcctctaccatctccacaaggtaattagctcaaggatcgtcagagatcgtgcccaccctttggcctttattcaggaatttgaatctttagttaggatcgttccatacagtgggatcccgtctaggctttgttcggttttcacggattggagacccagaataattcctagccggattacttctctaatttatataaattttgatgagttggaacgaaaccgggttattccaatagaaacgaacggccccctaaggaatggagaagcccccccccggcgatcttgagaataaagactctttctgtttcttgccattgcccggcctgtgcatgccttgcctggacgccgaagttccccctgctctccaaatggatgcctctgcgagggctgg

SEQ ID NO: 25254 - protein, 131 aa, Zea mays
  misc_feature: Ceres CLONE 1396778-F
MKFMRLGTRPDTFFTAADSVRSVCTEVATDLQILVDNCLYHLHKVISSRIVRDRAHPLAFIQEFESLVRIVPYSGIPSRLCSVFTDWRPRIIPSRITSLIYINFDELERNRVIPIETNGPLRNGEAPPRRS

SEQ ID NO: 25255 - DNA, 551 bp, Zea mays
  misc_feature: Ceres CLONE 1396780-F
caaaagctggagctccccgcggtggcggccgctctagaactagtggatcccccgggctgcaggaattcgcacgagaccattacctagaacatcctaatcgaaaacacagcactaaagtctattcatctctggctccccaaatcagctggagagcacttttttccatcatggataggactacggtgaactctacacatcctccggatgggtgagagtacttcccggtgaaaccggagggggaacttaggggggagcctttcggcgctgaacgaacccccggaaggaaaaccaaaggaccccggaatcgggggaatttttgggcccccacccccggaagggcccccgaaaaatttttttccccccaaaaaatttttcttttcccccccggggtgttaaaaaaaccgtttttaaagagcccccctataaaaaattttaaaaaaccccccgggggtgggtcccccccgggggaacacccccctggaaaaaaaaggggggggtcccccccccccggggggggggaaaaaaaaaaaaaaaggaaggggggggggggg

SEQ ID NO: 25256 - DNA, 687 bp, Zea mays
  misc_feature: Ceres CLONE 1396784-F
  misc_feature: Encodes the peptide sequence at SEQ ID NO. 25257
  misc_feature (334)..(334): n is a, c, t, g, unknown, or other
  misc_feature (460)..(460): n is a, c, t, g, unknown, or other
gggggttttcatgggcgctgggggggcaggaattttccaagtccagtggggagaacagcctaagcgaaaaagagaagtgacaacagttttaccccgcaagcccgctgctgggcctggccgccgcgtttctggccgtagccgtgctcgtctccgcgacagaggcgtggcgcgcgactccaccgccgctgccggtgctgccgatcccgtcagcgccccacctgatatgccagcgccgcgaggagatcatgtacttccacgtcggtatgaacaccatcacggactccaaggggggtacggtgtcagaggacccggccctagaccgaccctttggtgntttcccccccccccgggggagggggttgtggttgtaggtggactcgctcggcatcctaaaaaacaaacaccacgatgtgatgtgactctggacgcacaatgacacggtccaatgcctgcgcgccancccctggcaaatgggcctcgccaacatgcttaggaagatcgggggccctcttccgctttactggattatacaccctcttggaccgtctcgtcaacggggccggcacaaccaaagaaagcagcaagacggcgcggaccaacggagactaaaaggtgccccttgccccaagagcctccccaggggactacaaggcgggccgctgaactccctttcaagatgcacagggg

SEQ ID NO: 25257 - protein, 41 aa, Zea mays
  misc_feature: Ceres CLONE 1396784-F
  misc_feature (30)..(30): Xaa is any aa, unknown, or other
MYFHVGMNTITDSKGGTVSEDPALDRPFGXFPPPRGRGLWL

SEQ ID NO: 25258 - DNA, 721 bp, Zea mays
  misc_feature: Ceres CLONE 1396785-F
  misc_feature: Encodes the peptide sequence at SEQ ID NO. 25259
  misc_feature (44)..(44): n is a, c, t, g, unknown, or other
aagctggagcgccccgttggaggcggggggggccccttagcggngttctggggggggggaatcacacacacccattaggtagaacatcctaatcgaaaaattcctttcttccccactacaacatctggcaccgtgaaatctcagctacctccttcttacttctgggagcgcgggggcggggacccaactccgatccccaccccaccataccaaagccaccgcggctgcggctgcggcttccgcatcatcaatggtgctgatcactctcgtcccctactacatcgaccgcatgctccacgacatccctgccatgaaggtcctcgtcctcgacccccaaaccgttgacatgctgagctttttgtacacccaatcggagcggggggggggggaggccttcctcgtctagaccatggacaacgcctccagctccacggagtccatggcgcacctcaaggacatctacttcctccgaccctccgctaacaacgaccagaagctccacaagcacctcgacatgccgcgcttcgcctagtaccacctattcttctccagtatattgaaggtcccgcagattcaaatacttgctgactcggatgaacaggaccttgtgcaccaagttcacgacctctatgctgatttttgtgccattgacacataccatttcactctcaacatacaaaataaccacatgtatatgcatccaacaggggggcgacccctc

SEQ ID NO: 25259 - protein, 51 aa, Zea mays
  misc_feature: Ceres CLONE 1396785-F
MVLITLVPYYIDRMLHDIPAMKVLVLDPQTVDMLSFLYTQSERGGGEAFLV

SEQ ID NO: 25260 - DNA, 688 bp, Zea mays
  misc_feature: Ceres CLONE 1396786-F
  misc_feature: Encodes the peptide sequence at SEQ ID NO. 25261
  misc_feature (688)..(688): n is a, c, t, g, unknown, or other
agagctggagctccccgcggtggcggccgctctataactagtggatcccccgggctgcaggaattcgcacgagaccattacctagaacatcctaatcaaaaacttcccgttccccaattcgaaatcgagtcgggtactcgggtcggtcttgccgtgcgtgcgtggctgcgcgaaccagcccacgctcccactccccgcccgccaccgccgggtccctctagggttttgccgcgatgtcgctccggccgagcgagcgggagcagatgcggaagggcaactacaagcagacggtggacgccgaggagagccgccgccgccgcgagggccagatggtcgacatccgcaaggccaagcgagagggaaaggctccagaagaagcgcggggatgggtccccccccccggggccctgccgccgagggccccctccacccgactccaaaaaaaattcaatggctttgccggcaatgtaacgggccgttccttccaacgaccccctgggggggtttggggcgcccccccccgtttccgggaagtggtttcccacaaagggggggcccccccctttgaaaaggggggccccccccggggggggggcgccccccttctttttggggtcctttccgcggggggggggccccccccccaacccccctttttgggggtgggtgggggggggcctcccacaan

SEQ ID NO: 25261 - protein, 151 aa, Zea mays
  misc_feature: Ceres CLONE 1396786-F
  misc_feature (4)..(104): Pfam Name: IBB Pfam Description: Importin beta binding domain
MSLRPSEREQMRKGNYKQTVDAEESRRRREGQMVDIRKAKREGKAPEEARGWVPPPGALPPRAPSTRLQKKFNGFAGNVTGRSFQRPPGGVWGAPPRFREVVSHKGGAPPFEKGGPPRGGGAPLLFGVLSAGGGPPPQPPFLGVGGGGPPT

SEQ ID NO: 25262 - DNA, 632 bp, Zea mays
  misc_feature: Ceres CLONE 1396789-F
  misc_feature (357)..(357): n is a, c, t, g, unknown, or other
  misc_feature (425)..(425): n is a, c, t, g, unknown, or other
  misc_feature (426)..(426): n is a, c, t, g, unknown, or other
agagctggagctccccgcggtggcggccgctctagaactagtggatcccccgggctgcaggaattcgcacgagaccattacctagaacatcctaatcgaaaaaaaaccaaaaccctccatccattctacacgcgccgccgcactcctgtacacgccccgccgccaccgcctccaccaccacagcgcgcaggaatccctcgttctctgagggtttcaggcgtcgtatgtaagagaagatggcgctctcagtatccatggagggcatcgaggcgcgggcgcgggatctcggggtggacctctccgctgtcgatctggactccatcaccttcccgggcgggggagggacttccggatccncccgggatgaaccaggcagcgaacttcgggggggggggatttttcccaaaaattttaaaaaagggggnntttgccccaaatattttggcgggaaaaaaccccccggttttcccccccaaaaaaattttaaaaaattttggaaaagggtttcccccaaaagtctccccccccctattgggggggggaaaaaaaaaaaaaaaaggggttttatgggggggcgcctttccccccccccagaaaaaaaaaaaaaaaaaaacccgggggtggggttgttt

SEQ ID NO: 25263 - DNA, 729 bp, Zea mays
  misc_feature: Ceres CLONE 1396790-F
  misc_feature: Encodes the peptide sequence at SEQ ID NO. 25264
aagctggagctccccgcggtggcggccgctctgtactagtggatcccccgggctgcaggaattcgcacgagaccattacctagaacatcctaatcgaaaaaacccaacccaaccgcgctttttgtcacctctcacctggaaagggaagacaagtcgagattcgagaaggcaaatcgaattcgccatgggcatggctgctccgcgcgcgccgctgcctctcccccaactgctgctcctcctcgttgctgcgctcctcgccgccgctcccctccctagggcggccggggcggacgagttcgacgtccgccgccacctctccaccgtcaccaggtatgatgtggccagggagtccagtagtgtcatctccatgccgtcaatcccagacgggtgccgtgtcattcacctcaatctagtggcaagacatgggactcgtgctcctaccaagaagcgcatcaaggagctggatagattggcagttcgactggaagcccttctgaaagaggcaaatcaggtccttgatagtgattctctgaagaaaattccatccctggattaaaggctgggaatcacgctggaagggcaggactaaaggtggtgagctgattagtgaaggggaagaggagctgaaccatttacctaccagaatgaaggagagggttcaagatctatttgatgacccatatccccctgaagaatattcaataagagcaacccaagttcctcgaacat

SEQ ID NO: 25264 - protein, 123 aa, Zea mays
  misc_feature: Ceres CLONE 1396790-F
  misc_feature: SWISSPROT Homolog: EC 3.1.3.8 3-phytase
MGMAAPRAPLPLPQLLLLLVAALLAAAPLPRAAGADEFDVRRHLSTVTRYDVARESSSVISMPSIPDGCRVIHLNLVARHGTRAPTKKRIKELDRLAVRLEALLKEANQVLDSDSLKKIPSLD

SEQ ID NO: 25265 - DNA, 692 bp, Zea mays
  misc_feature: Ceres CLONE 1396792-F
  misc_feature (21)..(21): n is a, c, t, g, unknown, or other
aaagctggagctcacctcggnggcgggggcgtcctttatcgtggcttgggggggtgcaggattccccacacaccattacctagaacatcctaatcgaaaaaaaaataaaatccaattttctcagtctcgagcgcccgcgtccctcgccccgtcgcgactcgcgacttcgcgagtcgccccgtcccagcctcccagccgtcccggctccccgcgaccccgccctccggcagtccggcgcgggggctcctctccgatccggtgagccgaacgaggatcccaactccccgaagaaagcggccacagccagagccagggtggctcggctctcctctcacagactgcgccgcagcgcctattgctcggctggcagccggtgggggcgggcggccccgcgcccccgcccctgctgcctacatccgcctgcagccagaagatctgcctccagcgaccgccctgcctgccccttgtggcttctgtggttctgcacaccagcacacgcacttgtccccaaacaacggcggcgggcgatgagtatctcagaagagcctccccggcgaaggatctgacggtgaggaggaggtctttctcaacgaggaggccatcatccccgggatacccctcgacgaaggagaattcccccgaccggggacgaccaaaaatgccgaccgtcccccaaacgggatgggttggtc

SEQ ID NO: 25266 - DNA, 791 bp, Zea mays
  misc_feature: Ceres CLONE 1396793-F
  misc_feature (13)..(13): n is a, c, t, g, unknown, or other
  misc_feature (14)..(14): n is a, c, t, g, unknown, or other
  misc_feature (19)..(19): n is a, c, t, g, unknown, or other
  misc_feature (22)..(22): n is a, c, t, g, unknown, or other
  misc_feature (23)..(23): n is a, c, t, g, unknown, or other
  misc_feature (28)..(28): n is a, c, t, g, unknown, or other
gttgccccccccnnaaccnacnnaagancaaaccgggggcgggcggccccgcgcaaagctggagctccccgcggaggcggccgctctagaactagtggatcccccgggctgcaggaattcgcacgagaccattacctagaacatcctaatcgaaaatcacaccaccaaacggaccaggcgaggcgtcctccaggccctagctctgtggtgtgcgcctcgatactgcgactgcggggcgccggtgcccgtcccatcggccgccgaactgtgcgccccggttgcccactaggccactactgcagtctgcactctgcagataacacagaggaaggcggaagccgatggccgccgtgacaagcccctgcctccggctccgcccgagagccgcctctacgtcggagatctcctcctccgcccctcctcggttggggcttggggcttccttctctcactcctggtttaaagtttgggagggtcctttcccgtcccaaagagtcaatgggaagccacgatggccgcactttccgggaccttctaaaaggctccaggttttttaccaaccaactgggggcacccatggaagggaaccaattttcctttattaaggagggcaccatatttggcctcttgggctgggcccccggcaacaacgcgggggggcccgggttcgcttttctagcggtttcaccctcacgaactttggtccggggttttttttcgcttgagggcggacaaaataactggggcgcccccaatataatgtttccccaccccgtgtgtaaataatataa

SEQ ID NO: 25267 - DNA, 680 bp, Zea mays
  misc_feature: Ceres CLONE 1396794-F
  misc_feature: Encodes the peptide sequence at SEQ ID NO. 25268
  misc_feature (411)..(411): n is a, c, t, g, unknown, or other
  misc_feature (635)..(635): n is a, c, t, g, unknown, or other
  misc_feature (656)..(656): n is a, c, t, g, unknown, or other
  misc_feature (657)..(657): n is a, c, t, g, unknown, or other
aaagctggagctccccgcggtggcggccgctctagaactagtggatcccccgggctgcaggaattcgcacgagaccattacctagaacatcctaatcgaaaaattggcacattgtttcctccgttctggaactggaagctggaaggtgaagttatcttggacaacagcagcacgagcgagctgtggaggaggtggaggtgcagccatggcgcacctgctgatgcacggcactctggatgcgaccatcctggaggccgaccacctcaccaaccccacccgggccaccggcggcgcccccgggatcttccgcaagttcgtggaggggttcgaggactcactcggcctcggccagggctccacgcggctatacgcgacggtggacctcggccgggcgcgcgtgggccggacgcnggtcatcaccggcgaccccgtgaacccgcgctggtacgagggtgtccacatctactgcgcccacttcgcctccgacgtcgtggtctccgtcagggccgcgcagcccatcggggccacgctcatcggcgcgcctacctcccccgtcggacctcatcgctggccagaagatcgagcgggcgctcgacatcctcgacgccagcaagaagcggctcccgcacgggccnaagatacgcgtgcggctgggnntccaggacgtgtcgcgacccccg

SEQ ID NO: 25268 - protein, 158 aa, Zea mays
  misc_feature: Ceres CLONE 1396794-F
  misc_feature: SWISSPROT Homolog: EC 3.1.4.4 Phospholipase D
  misc_feature (69)..(69): Xaa is any aa, unknown, or other
  misc_feature (144)..(144): Xaa is any aa, unknown, or other
  misc_feature (151)..(151): Xaa is any aa, unknown, or other
MAHLLMHGTLDATILEADHLTNPTRATGGAPGIFRKFVEGFEDSLGLGQGSTRLYATVDLGRARVGRTXVITGDPVNPRWYEGVHIYCAHFASDVVVSVRAAQPIGATLIGAPTSPVGPHRWPEDRAGARHPRRQQEAAPARAXDTRAAGXPGRVATP

SEQ ID NO: 25269 - DNA, 687 bp, Zea mays
  misc_feature: Ceres CLONE 1396796-F
aagctggagctccccgcggtggcggccgctctagaactagtggatcccccgggctgcaggaattcgcacgagaccattacctagaacatcctaacgaaaaattccaccgccgcacacctcctgtcttccttcaccttcgcgctccgccgccgccgtcgattcgtgctgctctcacccctaacctgtccaacatcgccgggggaggggagcagcagaagaaactccccttacctcgggctatcgcctgaagataaagtggggtcttgtaggggagccttaagggggagcaaaagggatagtataggggagagatggaggaattcattttcttctgtccggcttcgccccctggttaagtccccgcctaataaacctaaggaaaattccgggggttttccggttcctatacccaatctttcttcggtttatggccaatacgggaatgagggggaaacccctttacaaaagttttccaaaaaaaataaggggaaaaagaagaaatttgcccaaagttaaactttgggttggaaaaatataactccctgggccccggggtataatcctgccaaaacaaaaataggccgcgagaaaacgaagaaggaattttttggaattgggggaaaaaagaaaaataaatttcctcataaaagaaagggggaaaaaccccctcctttattatttgtttgg

SEQ ID NO: 25270 - DNA, 684 bp, Zea mays
  misc_feature: Ceres CLONE 1396800-F
  misc_feature: Translation starting site: 246
  misc_feature (466)..(466): n is a, c, t, g, unknown, or other
  misc_feature (482)..(482): n is a, c, t, g, unknown, or other
  misc_feature (484)..(484): n is a, c, t, g, unknown, or other
  misc_feature (605)..(605): n is a, c, t, g, unknown, or other
  misc_feature (606)..(606): n is a, c, t, g, unknown, or other
  misc_feature (648)..(648): n is a, c, t, g, unknown, or other
  misc_feature (659)..(659): n is a, c, t, g, unknown, or other
  misc_feature (684)..(684): n is a, c, t, g, unknown, or other
agagctggagctccccgcggtggcggccgctctagaactagtggatcccccgggctgcaggaattcgcacgagaccattacctagaacatcctaatcgaaaaatcgttcccgccgtcttccccaattcgccgccaggccagggtaaaaaaaaagagaggaagaaaacctcctgcaattcccattccatcgatccagctccggtccaagccaaagctttcttcgccccaaaccttgttcaactccaatgtcggacttcttcttcgggagcccgttccgccgccgcttccacgcgcgccccttccacgccgtcgactggtcctccgccgcggcggcggccatggactgggtggagaccccgtcctcccacgtgctccgcgtcaacgtgccgggactcggcaaggacgacgtcaaggtccaggtcgacgagggcaaagtgctcaccatcaggggcgccccgcccgcggncaaggagaagggaaangnaggacgaggaggaggggacggtgtggcacgtggcggagcgcggcaagccggagttcgcgcgggccgtggcgctgccggagaacgtgcgcgtggacgggatcagggccggcttggagaacgnngttctcacccgtcgtgtgcccaagaagtcgcaccggcccggncccagcccagntcaatcgccgtctccagcaagctcn

SEQ ID NO: 25271 - DNA, 647 bp, Zea mays
  misc_feature: Ceres CLONE 1396806-F
  misc_feature: Encodes the peptide sequence at SEQ ID NO. 25272
agagctggagctccccgcggtggcggccgctctagaactagtggatcccccgggctgcaggaattcgcacgagaccattacctagaacatcctaatcgaaaaaactcccaccccaatacatcctgccgacgccatcagccggcgggacgcacacacgaggtcgaccttcgaaccctagtccttggccgagccgccttgcgggatcgtccccgccgcgcggcagctctgcctcgacccttttagtctccgtccgacaccgcttggatcagagatggaatcaccacccctcacagctgaagcaattgcttttaccgagaaaaagatggacatgactttggaggatataatcaagatgtcaaagaaaaagaatcctggaggcaagagcccccctaggcagccgatcaaaaagcgtccattccagaatgccaacactaataaagggaatgggaaggtttcaccggttttatggaatcttagatcaacccttagaacaggggggcccttgcacaagaaaaagggcaaaactctggggggaaaacaccttttggtttctaaaaaaaagaggtttgaaaaaaaaagggttgtttttttccaagggggcagggggtttttttttgtgaaaaaacccccttgaaaaagggggtttt

SEQ ID NO: 25272 - protein, 120 aa, Zea mays
  misc_feature: Ceres CLONE 1396806-F
MESPPLTAEAIAFTEKKMDMTLEDIIKMSKKKNPGGKSPPRQPIKKRPFQNANTNKGNGKVSPVLWNLRSTLRTGGPLHKKKGKTLGGKHLLVSKKKRFEKKRVVFFQGGRGFFFVKKPP

SEQ ID NO: 25273 - DNA, 659 bp, Zea mays
  misc_feature: Ceres CLONE 1396810-F
  misc_feature: Translation starting site: 251
  misc_feature (511)..(511): n is a, c, t, g, unknown, or other
aaagctggagctccccgcggtggcggccgctctagaactagtggatcccccgggctgcaggaattcgcacgagaccattacctgaacatcctaatcgaaaaacgaaatggttttgccttcgcttttgcttatgcgtacgcgcggcgaatcacggcgcccaccttccaaccggacttgagtcacttgactccgccgcgggattccccgccagatctcattctcgccccaaccctaaccgccgacggtggccatgatggccaccgagcccttgtccccggggaatctcgtcgaggacgtcgaaacactacccctggactcctcctccactctcgcggctacgacggacccgctgctccgcccacctcccccctcgtccaccttctctcccaccgccggtgagaaccatggcgcttttctggacgaggaggatgaggacgtggtggatgacttcacgcctccgctggctccccatgccgctacggccgcgacgaagtcccgcgaggggtcaccngtggttcgctgagatcactgtctccgaacctaggaagcacgcggagcccgcgaccgggagccgggggcgttcattcccggctcgggccagctaagtcctctacctcatcgccactcgggggcccgaagggagggaagtttccccgggg

SEQ ID NO: 25274 - DNA, 677 bp, Zea mays
  misc_feature: Ceres CLONE 1396820-F
  misc_feature: Encodes the peptide sequence at SEQ ID NO. 25275
  misc_feature (513)..(513): n is a, c, t, g, unknown, or other
aaagctggagctccccgcggtggcggccgctctagaactagtggatcccccgggctgcaggaattcgcacgagaccattacctagaacatcctaatcgaaaactctctctctctctctcgtcctgcgccacacgccgcggccgtctccgggcaggaaggaagggggcggtaagatgatgatgacgcggccaccgatggggccgatggagggcgcggcggtggacgagatggtgcgccgcctcgtggagggcggccgaggcgggcgccaggtgcagctgtccgaggcggagatccggcagctctgcgtagagggcaagtgggtgctcctctcccagcccaatctcctccgaatccacgccccagtcaagatctgcggtgatatccatggccagtttgtccaccttctgagattattcgatttgggtggctatcctccagcttcaacttacgtattcctcggagactatgtcgatagaggcaaacggagcctgcagactatatgcttgctgctgncgtacaaaatccggtaccccgaaaatattttcctgttgaggagtaaccacgaggatgcagagactcacagagtctatggtttttatgacgaatgtaagatgaggctcaatgttcggctgtggaagatattctctgattgcttcaactgcctgaccatcgcagcg

SEQ ID NO: 25275 - protein, 161 aa, Zea mays
  misc_feature: Ceres CLONE 1396820-F
  misc_feature (55)..(161): Pfam Name: Metallophos Pfam Description: Calcineurin-like phosphoesterase
  misc_feature: SWISSPROT Homolog: EC 3.1.3.16 Phosphoprotein phosphatase
  misc_feature (107)..(107): Xaa is any aa, unknown, or other
MGPMEGAAVDEMVRRLVEGGRGGRQVQLSEAEIRQLCVEGKWVLLSQPNLLRIHAPVKICGDIHGQFVHLLRLFDLGGYPPASTYVFLGDYVDRGKRSLQTICLLLXYKIRYPENIFLLRSNHEDAETHRVYGFYDECKMRLNVRLWKIFSDCFNCLTIAA

SEQ ID NO: 25276 - DNA, 679 bp, Zea mays
  misc_feature: Ceres CLONE 1396822-F
  misc_feature: Encodes the peptide sequence at SEQ ID NO. 25277
aaagctggagctccccgcggtggcggccgctctagaactagtggatcccccgggctgcaggaattcgcacgagaccattacctagaacatcctaatcgaaaaattacggctgaagggagtcgctcgccgccgcgttcgaggcgttccctcgtcgcgctcgcgccgtcgaccttcaccgctcgctgtcaggtctgcccgccacgacctcgccggccacactcgcagctcgccctcgctcctacgcctcgccggcgaggccttctgccttttcgcgccctctatctgctgcgatctttggagcatcgttctcttctctcacttgagatccagacccctaaaccctagagctcgccgcttccgctcgctcgctccgcgctggcggcgacaatggaggacgaggagatggagaagaaggtgcagcagtacttgcagcgcaagggtttccgcctcactgagcttgcgctccaggaggagtgcaaccgcctctccacctccgccatctccgacgttgcgcttgcacggtctgacaatgatccagcgagatactacgatggatatagcagattaagaacatgggcatacagttctcttgatcaatataagcacgaattacttcgcgtcctttatccagttttcatccatagcttcatggatctagtggcagaaggacatatgcagg

SEQ ID NO: 25277 - protein, 97 aa, Zea mays
  misc_feature: Ceres CLONE 1396822-F
MEDEEMEKKVQQYLQRKGFRLTELALQEECNRLSTSAISDVALARSDNDPARYYDGYSRLRTWAYSSLDQYKHELLRVLYPVFIHSFMDLVAEGHMQ

SEQ ID NO: 25278 - DNA, 617 bp, Zea mays
  misc_feature: Ceres CLONE 1396828-F
  misc_feature (305)..(305): n is a, c, t, g, unknown, or other
  misc_feature (311)..(311): n is a, c, t, g, unknown, or other
  misc_feature (312)..(312): n is a, c, t, g, unknown, or other
  misc_feature (321)..(321): n is a, c, t, g, unknown, or other
  misc_feature (331)..(331): n is a, c, t, g, unknown, or other
aaagctggagctccccgcggtggcggccgctctagaactagtggatcccccgggctgcaggaattcgcacgagaccattacctagaacatcctaatcgaaaaagaaaatacgcacctgctcctcactcttctttatatttttttctccatttggcaacttttgcttgtcgttcatgtatatgcatgaccctttcacacatatgatcagaagataagcacatgcaagacgatctcgcgtggatatgatgcatggatcagaactaacctctatatcatcacccaacgctcgtagatgatgctatacnattccnntgataaatnatatataggnaaaaaaaaaggacccgtaccggcctacttaaaatttaaaattaatgggtggcaatggacaacttatccatgaacgggaaacttggggatcccattgaacccgggaggggcccaatttccgggccctgaacgggaatgatccacgggaggaacggaacttaaaccccttgccaaccaaggggggccccaaaaaaaccggggttgcagggggggggggttttcccccccgccggaaccgggggggattaaaacaaaatttggactggaaaaccgccacccccgggtgc

SEQ ID NO: 25279 - DNA, 652 bp, Zea mays
  misc_feature: Ceres CLONE 1396833-F
  misc_feature (318)..(318): n is a, c, t, g, unknown, or other
  misc_feature (393)..(393): n is a, c, t, g, unknown, or other
  misc_feature (398)..(398): n is a, c, t, g, unknown, or other
  misc_feature (414)..(414): n is a, c, t, g, unknown, or other
  misc_feature (415)..(415): n is a, c, t, g, unknown, or other
aaagctggagctccccgcggtggcggccgctctagaactagtggatcccccgggctgcaggaattcgcacgagaccattacctagaacatcctaatcgaaaaaacacccggaccccggtctgcgtttgtccctgcgggctgcggccctgcctcttctcgtctcccgttcccctcgccgcgtgagctctctctctctctctctctcctctgtggtgacgactgggcgcccgcacccctgggagccgccgccgcccagtccccgtcgggcccttcggcaggtcttctttcgcctctttcgcggcgacgagccgcaccagncgtacatgtgtacacccagccccaggccttaactgcgcccgcccctgcgactggttttcctggctggttctgtgnatttngctgcccggaggattnngtgcacctttaggatcacggtagattcgctgtgaaatcggaagggtgctcaggtcatgtttggggaacagcgcatgatactgggctagactcgggaactcataagcactgcccctgaattgacccgggctgagaagatcctctgggagcaggacttcctgatcaaccccctgcaggggggtggcccaaaaggagacaagggaaggcctgttattttttttccaaaaaaaaccagccg

SEQ ID NO: 25280 - DNA, 765 bp, Zea mays
  misc_feature: Ceres CLONE 1396834-F
  misc_feature: Encodes the peptide sequence at SEQ ID NO. 25281
  misc_feature (30)..(30): n is a, c, t, g, unknown, or other
  misc_feature (32)..(32): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (46)..(46): n is a, c, t, g, unknown, or other
ggggccccccccccccccccccgccccccnanannnnntggggggnggggcacactgggactcctcgcggtggcggccgctctagaactagtggatcccccgggctgcaggaattcgcacgagaccattacctagaacatcctaatcgaaaagttgggtgccgtgcgagctccaagtacccctgtctccctcccgtcttgcgggcttgcctttgcctgttccatttccggctcctccagttggtagtgtcgtttcaatgcgagacgccgtccttcacgagcttgattgcccttgaaagcgaagttggtgttggtgtccttgccggtgaggaggaagaggggatatatggctcccacggaagaggcagcaggggaggacgagcggctgctgaaggatcttctcgcttcttcgtcagataaggaaggagaggatgaagagagtacaaagacacagtccgatgaatctactagggggggattgtgataacggggggtccgtacccgccttatcgagtgaagatgtcaatgataggcatggtagtgacagcaacagcccatgcgctgaatctgatggtgcttgcagtcaaggggcctggaaacaggctccaaagagccagcaacgatgagtgcgggggcctgaaacgcctccaaaccgggatcccaagaagcagcaaatggatcgaaaaatgaccgcggtggttgcttgatgaaaattgccaaggcaaccccttcctttccaggagcgcagtaacccaattgaccaggc

SEQ ID NO: 25281 - protein, 45 aa, Zea mays
  misc_feature: Ceres CLONE 1396834-F
MAPTEEAAGEDERLLKDLLASSSDKEGEDEESTKTQSDESTRGGL

SEQ ID NO: 25282 - DNA, 608 bp, Zea mays
  misc_feature: Ceres CLONE 1396835-F
  misc_feature (228)..(228): n is a, c, t, g, unknown, or other
  misc_feature (251)..(251): n is a, c, t, g, unknown, or other
  misc_feature (252)..(252): n is a, c, t, g, unknown, or other
aaagctggagctccccgcggtggcggccgctctagaactagtggatcccccgggctgcaggaattcgcacgagaccattacctagaacatcctaatcgaaaaaaaaaataaaaaaattgggtgtttacaacgaattttaggtcttggccccttgggctcttggtcccagcgattttttttctgtgggccgttgggtccgtggaacatatccgttgcagaagactacangatgcaaaagcgctcgctcgctnngtgtgctgctgcaacctgaagggatgcgaagccacgccaccgaaggagggcggtgcggggtttcaccttccaaaacctctgcccggggccggcatgggaaagttttcccctggtggcaacaaagaaacttccccggtccgggccacgaagggaaaccaacccggttggccccccaaaggtttttttacacctttttaaacccgggagtttcggggggtccttttggtgggcgcgggccttagcaaaaaggaaaatatttttttggagggcacactcacgggggagccaaaaaaataaccccgggggaaaaaaaaaaagaaaaaaaaaaagggggggggtttaaaaaaaaaaacaag

SEQ ID NO: 25283 - DNA, 780 bp, Zea mays
  misc_feature: Ceres CLONE 1396837-F
  misc_feature: Encodes the peptide sequence at SEQ ID NO. 25284
  misc_feature (5)..(5): n is a, c, t, g, unknown, or other
  misc_feature (6)..(6): n is a, c, t, g, unknown, or other
  misc_feature (16)..(16): n is a, c, t, g, unknown, or other
  misc_feature (44)..(44): n is a, c, t, g, unknown, or other
  misc_feature (46)..(46): n is a, c, t, g, unknown, or other
  misc_feature (47)..(47): n is a, c, t, g, unknown, or other
  misc_feature (52)..(52): n is a, c, t, g, unknown, or other
  misc_feature (319)..(319): n is a, c, t, g, unknown, or other
atttnnaacccccccnccccccccgccccgccgcggggggactntnngactntggacaagactggggctccaccgcggtggcggccgctctagaactagtggatcccccgggctgcaggaattcgcacgagaccattacctagaacatcctaaaaaaaatcttatttcactgccagccctctgaaaaaaaaattaaaaaatgaggtcccagttccacccacctagagagccaaaagagccggcggtggccggcagccaaaacccacgttggattttgccgccgccgcctggagctaggggacaaggcaacgccggccgntgcaacatttatgcgtgtaccaggcagaccagcccggcagccacgcgtacacttctgccgcaaagctaaacgcgccactccgcgggaagctgctctgctgctcccaccagccaccgggagcggagtgccaatggcgactgcagcgagttccacgccgggggcgcgggagcctactctggtctgggcgtcactgaccgcgcgggtgcccccgggagatggcagcgggaggttggcccgccggctggcggggctcgggggccgaccggggggggaggctccagggggcggtggcctccgacgggtttcgaagccattgcagggaacccggccccgtggttttcttcggcccaagccccgggttccgttcccccggggcattcggcaccctaacggaggggccgaaattggggggaaggcgagggcccaggtgaacccagagggcgaaagaaactgagcgcccc

SEQ ID NO: 25284 - protein, 71 aa, Zea mays
  misc_feature: Ceres CLONE 1396837-F
MAAGGWPAGWRGSGADRGGRLQGAVASDGFRSHCREPGPVVFFGPSPGFRSPGAFGTLTEGPKLGGRRGPR

SEQ ID NO: 25285 - DNA, 687 bp, Zea mays
  misc_feature: Ceres CLONE 1396878-F
  misc_feature (217)..(217): n is a, c, t, g, unknown, or other
  misc_feature (222)..(222): n is a, c, t, g, unknown, or other
  misc_feature (224)..(224): n is a, c, t, g, unknown, or other
  misc_feature (288)..(288): n is a, c, t, g, unknown, or other
  misc_feature (289)..(289): n is a, c, t, g, unknown, or other
  misc_feature (306)..(306): n is a, c, t, g, unknown, or other
  misc_feature (311)..(311): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (356)..(356): n is a, c, t, g, unknown, or other
  misc_feature (357)..(357): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (380)..(380): n is a, c, t, g, unknown, or other
  misc_feature (391)..(391): n is a, c, t, g, unknown, or other
  misc_feature (392)..(392): n is a, c, t, g, unknown, or other
  misc_feature (396)..(396): n is a, c, t, g, unknown, or other
  misc_feature (401)..(401): n is a, c, t, g, unknown, or other
  misc_feature (402)..(402): n is a, c, t, g, unknown, or other
  misc_feature (408)..(408): n is a, c, t, g, unknown, or other
  misc_feature (454)..(454): n is a, c, t, g, unknown, or other
  misc_feature (493)..(493): n is a, c, t, g, unknown, or other
  misc_feature (497)..(497): n is a, c, t, g, unknown, or other
  misc_feature (498)..(498): n is a, c, t, g, unknown, or other
  misc_feature (505)..(505): n is a, c, t, g, unknown, or other
  misc_feature (508)..(508): n is a, c, t, g, unknown, or other
  misc_feature (521)..(521): n is a, c, t, g, unknown, or other
  misc_feature (528)..(528): n is a, c, t, g, unknown, or other
  misc_feature (557)..(557): n is a, c, t, g, unknown, or other
  misc_feature (569)..(569): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (578)..(578): n is a, c, t, g, unknown, or other
  misc_feature (583)..(583): n is a, c, t, g, unknown, or other
  misc_feature (597)..(597): n is a, c, t, g, unknown, or other
  misc_feature (598)..(598): n is a, c, t, g, unknown, or other
  misc_feature (604)..(604): n is a, c, t, g, unknown, or other
  misc_feature (607)..(607): n is a, c, t, g, unknown, or other
  misc_feature (609)..(609): n is a, c, t, g, unknown, or other
  misc_feature (610)..(610): n is a, c, t, g, unknown, or other
  misc_feature (615)..(615): n is a, c, t, g, unknown, or other
  misc_feature (625)..(625): n is a, c, t, g, unknown, or other
  misc_feature (632)..(632): n is a, c, t, g, unknown, or other
  misc_feature (635)..(635): n is a, c, t, g, unknown, or other
  misc_feature (652)..(652): n is a, c, t, g, unknown, or other
  misc_feature (655)..(655): n is a, c, t, g, unknown, or other
  misc_feature (656)..(656): n is a, c, t, g, unknown, or other
  misc_feature (659)..(659): n is a, c, t, g, unknown, or other
  misc_feature (660)..(660): n is a, c, t, g, unknown, or other
  misc_feature (664)..(664): n is a, c, t, g, unknown, or other
aagctggagctccccgcggtggcggccgctctagaactagtggatcccccgggctgcaggaattcgcacgagaccattacctagaacatcctaatcgaaaacgaggtatcgagtctcgaccaacccatacgcacctaccctccgccaccgttcccccctccccatctcgcccgccgttctcgtccttgatagatactcctcgcacctcgacgcattncgtgntntccatctctagagggagagttgagtacacggacgggctgaatttggccggaagcgaaaaaaaanngcccccccccggggggnggggngggggcgggccccgcccccccccnnnnnnnncnnnnncccccgcnncgccgnnnncccgccgnnncagncgcccccgccnnccgncgcgnncgcgcncccgcccgcagcagcgcccccagcccgccgcgccggggccgccccncgagcggcgtgggtgcgcggcgccgcccggccgcgccgnccgnncccgcgncgnacccccgcgccgnccccgcnccgccgcgcgcagcgcccggcgcgtcccncgcgccgcgcgnccgnnnncncgcgncgacgcctgccgcnncggcgncgncnncgcgncgcggcgcgnctcgcgncgncgcgcgcggcggcgcgnagnncgnncgcncgcgcgcgcgcgctcgcgcggca

SEQ ID NO: 25286 - DNA, 644 bp, Zea mays
  misc_feature: Ceres CLONE 1396887-R
ccgggccccccctcgaggtcgacggtatcgataagcttttttttttttttttttaattgcagattagctgaacaccgattccagaaggcagcagtgtactgacagcgaaggcaactacactttgtatatacactggtagtaatgatcgaacgaacgagaaccatgtacagcagcacgccacgcttacagattgcagtattaatagttgcaccaggtttggtttatatccacaagaagaatgatgcaaattcatgaaagaaaatggtacgatcaatattgcttaacgaagctgttccgttgacgacgccggcagcagcgagcgaaggagatcgcagatcggcatccaccacatcttggacgcctacatcaccagctccgacacccatcccaagtccggcccgtcgtcctccgtgaccgcagccgcaggcaggaccggcgccgacgacgacgccttggccttccggaatccgagctcccgcatcgcgagcaacagctcctccacctcggcgtccgccggctcgtcgacccacctccggccctccaccggcgacaccggcggcgactcccagggcggcgccagcgtcgacttgggccagagcgacagcccgagcggtgagcaaacgtccttggcggcgcccgcgcca

SEQ ID NO: 25287 - DNA, 627 bp, Zea mays
  misc_feature: Ceres CLONE 1396887-F
  misc_feature: Encodes the peptide sequence at SEQ ID NO. 25288
tggagctcaccgcggtggcggccgctctagaactagtggatcccccgggctgcaggaattcgcacgagaccattacctagaacatcctaatcgaaaagttatatctcctcaagggacgttctccacagacctctctttccccggcaccaccaccacccaggctaaccgaactggaccgagtgtggaacaagactgatggggaggcagatatagcgacggcaggtatgctgaggcgcgaaaatttgcacctggttgctggtacctcggtgtctctggtcgcgccgggggccgacccgaccgccgaagagatcccgtcgcagctcctcgacgcgctgggagagtacctctcctccacccgcgccaagggcgttgacgtcccgacgaacgtggacgacaagatcatgatgaactatgtcaaggtgagggggagcgcgcgcgcgcggagacacaactggacggcgtgcccctacgcgcacccgtgggaagtcgcgcggagatgagacccgtgccgtgtggcctatacgtgggaggcgcgctcgtacttacgtggccgaacggcaacgaccattcagtgacctatctggtgcctacgccgtaattcttcattcacaactgaagcatgcatcc

SEQ ID NO: 25288 - protein, 91 aa, Zea mays
  misc_feature: Ceres CLONE 1396887-F
MLRRENLHLVAGTSVSLVAPGADPTAEEIPSQLLDALGEYLSSTRAKGVDVPTNVDDKIMMNYVKVRGSARARRHNWTACPYAHPWEVARR

SEQ ID NO: 25289 - DNA, 611 bp, Zea mays
  misc_feature: Ceres CLONE 1396890-F
  misc_feature: Encodes the peptide sequence at SEQ ID NO. 25290
  misc_feature (455)..(455): n is a, c, t, g, unknown, or other
  misc_feature (457)..(457): n is a, c, t, g, unknown, or other
  misc_feature (458)..(458): n is a, c, t, g, unknown, or other
caattctggagctccccgcggtggcggccgctctagtactagtggatcccccgggctgcaggaattcgcacgagaccattacctagaacatcctaatcgaaaaatcgtatcgggcaggggctgcaacccaggctgtgcggggcggcagggcagcggcggcgacatctgcatctgcatctcccacctcgtctccctcccgcatctgccctgcctcgatcccgccgccagccatctaagggagccgggagccatgtctccctccggcgagctgctggcgtccatctcctccgctctcgccgtggccttcgtcttcctcgcctgcgtcgagctcggcgacgccgccgccgccgtcagcgtctaccgcctcatccagtacgacctcgccggcgccccgctcggctcccgcgccgcggtcctcaaccaccacgccgcggtgctcccgctccctgccgggngnnagactctcccggtccggcctcgtggtggcggtcctcgaccttccggtctccttcctcagagaggaccctggtggagaaaaaacagctggggggattgctcattttgctccccaacaaccgcggggataaggatagtgcggatgacaaggttca

SEQ ID NO: 25290 - protein, 120 aa, Zea mays
  misc_feature: Ceres CLONE 1396890-F
  misc_feature (69)..(69): Xaa is any aa, unknown, or other
  misc_feature (70)..(70): Xaa is any aa, unknown, or other
MSPSGELLASISSALAVAFVFLACVELGDAAAAVSVYRLIQYDLAGAPLGSRAAVLNHHAAVLPLPAGXXTLPVRPRGGGPRPSGLLPQRGPWWRKNSWGDCSFCSPTTAGIRIVRMTRF

SEQ ID NO: 25291 - DNA, 716 bp, Zea mays
  misc_feature: Ceres CLONE 1396894-F
  misc_feature (11)..(11): n is a, c, t, g, unknown, or other
  misc_feature (12)..(12): n is a, c, t, g, unknown, or other
  misc_feature (15)..(15): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (48)..(48): n is a, c, t, g, unknown, or other
gtattgtgggnnttncccnnngaatcgcgcgggggggggccnnncccncgaggaagtccccccccccggcggcccccccccccaaagatggggctccccgcggtgggcggccgctctagaactagtggatcccccgggctgcaggaattcgcacgagaccattacctagaacatcctaatcgaaaaacgttgttcctcccgaccctcgccgtccctcccgccgcgacccgccctcctcctcccgaccacgccgcccagcccgtgtaccactccctcccagcctcgccctcccacgccgtccctcccgccgtgacccttcctcctcctcccgacctcgccgcctagcccgtgtcgccggccgtcgcccccgtgccactcctgctggctgggaacccaccgaccatggggggatggtgcaattttgggggtggcggtcaccgaacggatcaaggggaacatcgccggtcctggaatcggtcggggcttcctcccttgaaacggggggataacccccggcccgccccccccgggggggggaaaaacagggccttttgggaaaatgggaaaagaccccccccctcgggttggttgtattttcccggaaaccttcccctttttatcggcgagaaaaaccaaggggggatttttaccccgggatttttggtaaaaaggaaaaagcgcaatcttggcgggataatgggcggaaagcgcctatt

SEQ ID NO: 25292 - DNA, 644 bp, Zea mays
  misc_feature: Ceres CLONE 1396905-F
  misc_feature: Encodes the peptide sequence at SEQ ID NO. 25293
  misc_feature (444)..(444): n is a, c, t, g, unknown, or other
  misc_feature (452)..(452): n is a, c, t, g, unknown, or other
  misc_feature (453)..(453): n is a, c, t, g, unknown, or other
  misc_feature (507)..(507): n is a, c, t, g, unknown, or other
aaagctggagctccccgcggtggcggccgctctagaactagtggatcccccgggctgcaggaattcgcacgagaccattacctagaacatcctaatcgaaaaagcacctccattcccagccacgagacgacgaaaccctagcctccctccccctctctcaccaggccaccacctcgccggaacccggcgcctcgaaggagcacgggatcatcggccgccgtcggccgcggctgcggaggagcggtgtaagatgttgaacggcggcggcggcggccagaagaagcggaacacgaagatcgagccctatcggcaccgcgtagagaccgaccccaagttcttcgacaagtcgtggcggaagctccatgacgccatccgcgagatctacaacccacacgccagcggtctctccttcgaggagctctacaggactgcttataacatgtnatggaacnnagttgctcctcagctctatgagaaactccccgaaacctgaaagagcttcctggnaagaagccccagttattagaggcggcccagggggttttgttcctggaaaatttgccccaaaaagggaaggccttaaaaggggtttgcaaaggttaaaaaatccccggggtgtgggggggggaataattatccccgaa

SEQ ID NO: 25293 - protein, 80 aa, Zea mays
  misc_feature: Ceres CLONE 1396905-F
  misc_feature (65)..(65): Xaa is any aa, unknown, or other
  misc_feature (68)..(68): Xaa is any aa, unknown, or other
MLNGGGGGQKKRNTKIEPYRHRVETDPKFFDKSWRKLHDAIREIYNPHASGLSFEELYRTAYNMXWNXVAPQLYEKLPET

SEQ ID NO: 25294 - DNA, 615 bp, Zea mays
  misc_feature: Ceres CLONE 1396935-F
  misc_feature: Translation starting site: 188
  misc_feature: SWISSPROT Homolog: EC 2.7.2.3 Phosphoglycerate kinase
  misc_feature (312)..(312): n is a, c, t, g, unknown, or other
  misc_feature (361)..(361): n is a, c, t, g, unknown, or other
tggagctccccgcggtggcggccgctctagaactagtggatcccccgggctgcaggaattcgcacgagaccattacctagaacatcctaatcgaaaaacccgaagcacatcccgtcgcatcccatcccactaccacccatctcgtcgtccgccgattcgatccggttcttccaacccaggggctgtgatggcgacgaagaggagcgtgggcaccctcggcgaggcggatctgaagggggaagaggtgttcgtgcgcgccgacccctcacgtcctctcgacgacgcccagaagatcacccgacgacacccggnatcgcggctccgtcccccacatcaagttccctcctcgaggagggcgccnaggtcatcctcgccagcccactgggtcgtccaaaaggtgccaccccaaagaaacagttggaaccccctgggtccacgtttggctgaacccctgggaattgaaacccggatggcccaaggattgctttgggggggaaaattaaaaaattggttgcccctttttccaaaaaggggagattcttgcccccaaaaaaggggtaattttcccccggggggggaaaaaaaaccaccccctggggtttttaaaaaaaaaaa

SEQ ID NO: 25295 - DNA, 657 bp, Zea mays
  misc_feature: Ceres CLONE 1396937-F
  misc_feature: Encodes the peptide sequence at SEQ ID NO. 25296
  misc_feature (657)..(657): n is a, c, t, g, unknown, or other
aagctggagctccccgcggtggcggccgctctacaatagtggatcccccgggctgcaggaattcgcacgagaccattacctagaacatcctaatcgaaaaaccagtctcgtcgtgtccgttcgcgatcgggcaaacctgcaatcctttcctcttcgcccccccgctatctcgttgacccaagacggagtacggagtacggtagtcgcacccccgttgtcccgttccttgctcgccccaacttcggcgccgcatccccctcggatgttcgctcctcctctgcccctagtgatggctggaggtaacgcgtggtcgccgctcccttcgcacggatttgacgacgactcctgcttgctctattttatcttgctcgcgacggcggatcgtggcttgattgagcaccggatcccgcagatccgactcctgcgcgatggttagccgcgcaggcgaacctgtggctaggaccaacagtgatggtggcagcagcagcaaggatatctgcacgcttcacagtgcaacatctgctctggacctggcgcaggatcccgtgtgcaccctctgcggccacctcttctggtggtgatgcctctacgaggtggtacacgtgcacgcgcactcccaggagtgtcccgtatgcgaggccgtcgtcgaggagggcn

SEQ ID NO: 25296 - protein, 50 aa, Zea mays
  misc_feature: Ceres CLONE 1396937-F
MVSRAGEPVARTNSDGGSSSKDICTLHSATSALDLAQDPVCTLCGHLFWW

SEQ ID NO: 25297 - DNA, 658 bp, Zea mays
  misc_feature: Ceres CLONE 1396954-F
  misc_feature: Encodes the peptide sequence at SEQ ID NO. 25298
aaagctggagctccccgcggtggcggccgctctagaactagtggatcccccgggctgcaggaattcgcacgagaccattacctagaacatcctaatcaaaaagtagttgccgatccccattccaaacatgaccgttggggcgctgtgccgctgtcgccttcctgagatccccaaaaccccgacgccgcgctctcccacctggcacccgagaatactcgcgctcgcgcactcgacattcctcgccccccacgccggttcaccctgcgcgcacgcgctcagcatctcgcaatcccccgggcggaggcgtatgtcctgcgccgtggcgatgccgatcgacttgctccacgctccagctccgtgggaggaggaggtgaaggcggttgaggaggacgaggaggaggtggatggagtaggatgcggcggaggggccgtggtggtggtcgcggcggacgcggaggcggagggtcacccctacgacttccacgtgtccgggccgcgcaacctgccgccgcccaactggaaggagataatcagatcgagctggaaggatccaaattacaaaaggatggtaatggcctgcttcattcaagcagtctacctgcttgaactggacagacaggacaagaaaggcgaagaggatggccttgctccaaaatgg

SEQ ID NO: 25298 - protein, 117 aa, Zea mays
  misc_feature: Ceres CLONE 1396954-F
MSCAVAMPIDLLHAPAPWEEEVKAVEEDEEEVDGVGCGGGAVVVVAADAEAEGHPYDFHVSGPRNLPPPNWKEIIRSSWKDPNYKRMVMACFIQAVYLLELDRQDKKGEEDGLAPKW

SEQ ID NO: 25299 - DNA, 594 bp, Zea mays
  misc_feature: Ceres CLONE 1396968-F
  misc_feature: Encodes the peptide sequence at SEQ ID NO. 25300
  misc_feature (285)..(285): n is a, c, t, g, unknown, or other
  misc_feature (486)..(486): n is a, c, t, g, unknown, or other
  misc_feature (562)..(562): n is a, c, t, g, unknown, or other
cgctctagaactagtggatcccccgggctgcaggaattcgcacgagaccattacctagaacatcctaatcgaaaaacattacataacggatcggaaggtgatgatccatcgatggagctgtgagctgagctgagctgagctcaccaccaccacacacgggagatagctatagctagcatagcaagccagccagtcagcgacttagcagcagctagctagccatgctgccgtccttcgtgtcgccgacggcgagcgccgcggcctcggtgacgcctccgccgcggncgataccaggcagctacgggccaccggtgctgggcccgctacgggaccggctcgactacttctggttccagaggcaggacgagttcttccggaagcgcgcggcggcacaccgcagcaccgtggtccgcaccaacatcccggccaccttcccctttctcgtgggcgtggacccgggcgtggcgccatcgtgggacgcgccgncttcacggggctcttcgacccggacctcgtggacaagcgcgacatcctcatcggggcctataacccgggcgccggnctcaccggcgggacgggcggcggcgtgaactt

SEQ ID NO: 25300 - protein, 122 aa, Zea mays
  misc_feature: Ceres CLONE 1396968-F
  misc_feature: SWISSPROT Homolog: EC 4.2.1.92 Hydroperoxide dehydratase
  misc_feature (22)..(22): Xaa is any aa, unknown, or other
  misc_feature (89)..(89): Xaa is any aa, unknown, or other
  misc_feature (114)..(114): Xaa is any aa, unknown, or other
MLPSFVSPTASAAASVTPPPRXIPGSYGPPVLGPLRDRLDYFWFQRQDEFFRKRAAAHRSTVVRTNIPATFPFLVGVDPGVAPSWDAPXSRGSSTRTSWTSATSSSGPITRAPXSPAGRAAA

SEQ ID NO: 25301 - DNA, 593 bp, Zea mays
  misc_feature: Ceres CLONE 1396980-F
  misc_feature: Encodes the peptide sequence at SEQ ID NO. 25302
  misc_feature (518)..(518): n is a, c, t, g, unknown, or other
aaagctggagctccccgcggtggcggccgctctataactagtggatcccccgggctgcaggaattcgcacgagaccattacctagaacatcctaatcgaaaacccccacagaaccgtctccccagcccggcgcctcacggtcgcaatttattgcttgcgcaccgcctcgccgctttggcgtggggcgtttgcctgtgtggcgctggacatgtgccgtgcccgtggcttgcttcgtcgtgctcactagtcacgagagagggaggaggctctgcttctgctgccgcttcttcttctcctgctgctcttccggagataagcagggggccgggacagctgactagctgagaggcatggtgatggacgccggcggcggcaagctgccgtacagctacgccggccagcaggacggcgggaagctggtgaagagcgtcagccgcgtggagccgcgcaggttcggcctgagcctcgtggcgggcttcctcgtcgtcacctgcgcctacttctccaccggcaagttngacgccatccagatcgtcttgaccaggcgacccgtctccagcaatgcggttggcgacgggagccggctcgctggg

SEQ ID NO: 25302 - protein, 81 aa, Zea mays
  misc_feature: Ceres CLONE 1396980-F
  misc_feature (56)..(56): Xaa is any aa, unknown, or other
MVMDAGGGKLPYSYAGQQDGGKLVKSVSRVEPRRFGLSLVAGFLVVTCAYFSTGKXDAIQIVLTRRPVSSNAVGDGSRLAG

SEQ ID NO: 25303 - DNA, 631 bp, Zea mays
  misc_feature: Ceres CLONE 1396995-F
  misc_feature: Encodes the peptide sequence at SEQ ID NO. 25304
  misc_feature (337)..(337): n is a, c, t, g, unknown, or other
  misc_feature (402)..(402): n is a, c, t, g, unknown, or other
aagctggagctccccgcggtggcggccgctctagaactagtggatcccccgggctgcaggaattcgcacgagaccattacctagaacatcctaatcaaaaaatccagctttgctttgtagttgtagcgctagcagcttaattggtctctgagctgaggtgcactactagctagctagtcgtgcaggaagaggaaggaatataatggctgagcgggaggtcgtcgaaggcgggacgacgacgggaggcgggctgtggcggaggtatgcgccgcacgtccagatggtgctggcgcagctgtgctacacgctcatgtacttcatcaccgaggccgccttncaccaggggctcaacccctacgtctacatcacctaccgccatctgctcgtcgccgtcctcatctnggccttcgcatactacctggagaaggggctgaggcctaaaatgacgctcatgctgttcgttgagatattcgtgctctcccttctcggggtgagcttaactctggacatgtacttcgcggagctggagtacacgtcccccacgttcgtcacttcggtgggtgacaccatcgcctcgatggacgtcgtcatcgccatcatcctcaggtgacaaaagggcggaccggacgcg

SEQ ID NO: 25304 - protein, 135 aa, Zea mays
  misc_feature: Ceres CLONE 1396995-F
  misc_feature (45)..(45): Xaa is any aa, unknown, or other
  misc_feature (67)..(67): Xaa is any aa, unknown, or other
MAEREVVEGGTTTGGGLWRRYAPHVQMVLAQLCYTLMYFITEAAXHQGLNPYVYITYRHLLVAVLIXAFAYYLEKGLRPKMTLMLFVEIFVLSLLGVSLTLDMYFAELEYTSPTFVTSVGDTIASMDVVIAIILR

SEQ ID NO: 25305 - DNA, 642 bp, Zea mays
  misc_feature: Ceres CLONE 1396996-F
  misc_feature: Encodes the peptide sequence at SEQ ID NO. 25306
  misc_feature (305)..(305): n is a, c, t, g, unknown, or other
  misc_feature (318)..(318): n is a, c, t, g, unknown, or other
  misc_feature (326)..(326): n is a, c, t, g, unknown, or other
  misc_feature (333)..(333): n is a, c, t, g, unknown, or other
  misc_feature (334)..(334): n is a, c, t, g, unknown, or other
  misc_feature (588)..(588): n is a, c, t, g, unknown, or other
  misc_feature (589)..(589): n is a, c, t, g, unknown, or other
  misc_feature (604)..(604): n is a, c, t, g, unknown, or other
  misc_feature (642)..(642): n is a, c, t, g, unknown, or other
aagctggagctccccgcggtggcggccgctctagaactagtggatcccccgggctgcaggaattcgcacgagaccattacctagaacatcctaatcgaaaaatcgatcactacggttccatctcgcacccaactaggcctccgattattccgatcgccagcggatcagatttatgcagtcttactgccgccagctccagccatgccgcgcggcagcagcttggaccagagcctgagcgacgaggagcggtcggcaggtactggggcggtttggatccggcgtcgccggcaatgtccgggatgccngactcgccggggncgggcggncgcgcgnncgcaaagctgatggtggagcagttccacctcaaggtgctccacgccgtcctcgccgtgcgcacgccgcgcccgctcgccaccgccgccgctgccgcgtcgtcgtcgtcgtcgttcaggcggagggacaggtgattccatctcccgctccacgacccgccgccgcccgaggcggccggtcgcctcgacgagctggcccccggggagccgcgtgtggtggacgtcctcctgtgtcctgccaccgccagtggtgtgnnagcccgaggggagtnggtggagaagtggaccgtggcgtgcgagccctggccan

SEQ ID NO: 25306 - protein, 58 aa, Zea mays
  misc_feature: Ceres CLONE 1396996-F
  misc_feature (10)..(10): Xaa is any aa, unknown, or other
  misc_feature (15)..(15): Xaa is any aa, unknown, or other
MSGMPDSPGXGGRAXAKLMVEQFHLKVLHAVLAVRTPRPLATAAAAASSSSSFRRRDR

SEQ ID NO: 25307 - DNA, 648 bp, Zea mays
  misc_feature: Ceres CLONE 1396999-F
  misc_feature: Translation starting site: 207
  misc_feature: SWISSPROT Homolog: EC 2.3.1.119 Icosanoyl-CoA synthase
  misc_feature (513)..(513): n is a, c, t, g, unknown, or other
  misc_feature (525)..(525): n is a, c, t, g, unknown, or other
  misc_feature (526)..(526): n is a, c, t, g, unknown, or other
aagctggagctccccgcggtggcggccgctctagaactagtggatcccccgggctgcaggaattcgcacgagaccattacctagaacatcctaatcgaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaaggggtgtggggggaggccacctacgacctcgccaccgtggntcgcttcctcgnncgtctcgcctttcacatctccgtctacatcatgtccaggcccaggcccgtgtacctcatcgacttcgcatgctacaagccggccgacgagctcaggtggtccaaggcggagttcatcgactg

SEQ ID NO: 25308 - DNA, 644 bp, Zea mays
  misc_feature: Ceres CLONE 1397001-F
  misc_feature: Pfam Name: PTR2 Pfam Description: POT family
  misc_feature (223)..(223): n is a, c, t, g, unknown, or other
  misc_feature (233)..(233): n is a, c, t, g, unknown, or other
  misc_feature (240)..(240): n is a, c, t, g, unknown, or other
  misc_feature (241)..(241): n is a, c, t, g, unknown, or other
  misc_feature (245)..(245): n is a, c, t, g, unknown, or other
  misc_feature (246)..(246): n is a, c, t, g, unknown, or other
  misc_feature (248)..(248): n is a, c, t, g, unknown, or other
  misc_feature (249)..(249): n is a, c, t, g, unknown, or other
  misc_feature (255)..(255): n is a, c, t, g, unknown, or other
  misc_feature (451)..(451): n is a, c, t, g, unknown, or other
  misc_feature (572)..(572): n is a, c, t, g, unknown, or other
  misc_feature (593)..(593): n is a, c, t, g, unknown, or other
aagctggagctccccgcggtggcggccgctctagaactagtggatcccccgggctgcaggaattcgcacgagaccattacctagaacatcctaatcaaaaaacggtttgcgtataaataagtagtcagtcgctcatcttgttccttgtgaacatcgcagtgctgtagcctccttcgtcttgagcgagcatggagatgtcagccatggaggaagccctcccaanggcggatggnagaggannaagnnanncctcanaaccattccgttcatcatcttaaacgagatattcgagaaggtggccacgttcgggctgtcggccaacatgatcctgtacctcaccgagcggtatctcatgaccaacgcctttgccaccgtcgtcctctagttctggcatgccttctccaacttcctgcccatcttaggcgccgtgctcgccgacgcccgcctcggncggttccgggtcatcaccctcgggtcctgcgttagcctcttcgggatgtgcctgctgtggctgacggcgatccttccggtgtacaagaacaccccggagtgcgcgccggggtggcccgganggagcgcggtgatgccgtggnagatgccgctcttctttacgtcgtgagcgatcatgtcccatcgggtcggcg

SEQ ID NO: 25309 - DNA, 640 bp, Zea mays
  misc_feature: Ceres CLONE 1397018-F
  misc_feature: Encodes the peptide sequence at SEQ ID NO. 25310
  misc_feature (640)..(640): n is a, c, t, g, unknown, or other
aaagctggagctccccgcggtggcggccgctctataactagtggatcccccgggctgcaggaattcgcacgagaccattacctagaacatcctaatcgaaaaatgtaaaccacactccactccagcactgaacacttgattgattcagtgggtagctagctagctgaatcacaatggatcctaccaagttccgtccgtccagtagccacgacacgacggtgacgacgacgaacgctggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggggcctccgccaagggcttcttcgagtgcacccacgacgtgacgtcgctgacgtgcgccgacttcctgcgcgcgcccggcgtgcggacgcccgtgatcgtgcgcttctcgacggtgatccacgagcggggttccccggagacgatccgcgacccgcgcgggttcgccgtagagttctacacccgcgagggcaactgggacctgctgggggaacactttccccgtcttcttcattcgcgacggcatcaaggtcccccgacgtgatn

SEQ ID NO: 25310 - protein, 154 aa, Zea mays
  misc_feature: Ceres CLONE 1397018-F
  misc_feature (18)..(154): Pfam Name: Catalase Pfam Description: Catalase
  misc_feature: SWISSPROT Homolog: EC 1.11.1.6 Catalase
MDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFAVEFYTREGNWDLLGEHFPRLLHSRRHQGPPT

SEQ ID NO: 25311 - DNA, 665 bp, Zea mays
  misc_feature: Ceres CLONE 1397022-F
  misc_feature: Translation starting site: 268
tggagctccccgcggtggcggccgctctagaactagtggatcccccgggctgcaggaattcgcacgagaccattacctagaacatcctaatcgaaaaatcactcctcactcactcactcaaaacgaaagccagctcagctcatctgctcacacctcacaggctcacacccacaggccggccgccacagcaccgcggatagcagagcagagcggtgagctgcagagcagggtagccgaggtcgtcgtcgtcgtcgtcactcgtcagccatgagcaaggacaagcaccacaagcacgagcaccacctgcggcgttgctgcgggtgcatggcgtcgtgcctcctggcgctggtcctcatcgtggccttcgtctcgctggtggtgtacctggcgctgcgcccctcgaagccgtccttctacctgcaggacctgcagctgcgcaggcccatctcgctgggcgacccgtcgctgacggcgtcggcgcaggtgacgctggcctcccgcaacccaacgaccgcgtgggcatcttctacagcgcctggaacgtgttcgtcacctaccgcgacgaagccgtgacggagcccgtgtctctgccagcgatagaccagggcaacgcgacttcaacggctggtccccgggtgtgtcggccgactccgtgcccgttgctt

SEQ ID NO: 25312 - DNA, 632 bp, Zea mays
  misc_feature: Ceres CLONE 1397024-F
  misc_feature: Encodes the peptide sequence at SEQ ID NO. 25313
  misc_feature (476)..(476): n is a, c, t, g, unknown, or other
aaagctggagctccccgcggtggcggccgctctagaactagtggatcccccgggctgcaggaattcgcacgagaccattacctagaacatcctaatcgaaaaagtttggtcaactacatacgcaaatcggaatcgaaaccctatctcggatccgatggctcgttcgccgccgccttcttcgtcggccggcggcgcgcagtacgcgcagcagttcctcaacacggtgctctcccagcgggggccgtccgcgctgccgtacgccgaggacgtcaagtggttcatccgcaaccacctggtggagctggccgaggccttcccctccctccatcccaaggccgccctcttcacgcacaacgacggccgcgccgctcacctcctccaggtcgatggaaccatccccatgcaccgcgccgttgcctcctacaacctccccgccgtcatctgggtgaccgagccctacccgcgctccccgccgntcgtcttcgtctcgccgacccgagacatggtcatcaagccccaccaccgccttgtcgacagctccgggctcgtcgccgaagcgccctacctcggctcgtggggcttcccctgcttcaacctcgacgacctcgtccgaatccgtctggacctattcg

SEQ ID NO: 25313 - protein, 159 aa, Zea mays
  misc_feature: Ceres CLONE 1397024-F
  misc_feature (43)..(158): Pfam Name: UEV Pfam Description: UEV domain
  misc_feature (108)..(108): Xaa is any aa, unknown, or other
MARSPPPSSSAGGAQYAQQFLNTVLSQRGPSALPYAEDVKWFIRNHLVELAEAFPSLHPKAALFTHNDGRAAHLLQVDGTIPMHRAVASYNLPAVIWVTEPYPRSPPXVFVSPTRDMVIKPHHRLVDSSGLVAEAPYLGSWGFPCFNLDDLVRIRLDLF

SEQ ID NO: 25314 - DNA, 670 bp, Zea mays
  misc_feature: Ceres CLONE 1397025-F
  misc_feature: Encodes the peptide sequence at SEQ ID NO. 25315
aaagctggagctccccgcggtggcggccgctctagaactagtggatcccccgggctgcaggaattcgcacgagaccattacctagaacaccctaatcgaaaaaccgcatcccacaacccccgagctcagcttagctccactccagctccaatcgcaatcgagaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggagttggcgcacgcgttcgcgctgttcgtggcggtgtctgtgggcgcgaacatctccggcaggcacgtgaaccctgccgtgaccttcggcgccttcgtgggcggcaacatcaccctgttccggaggctcctgtactgtgtggcgcagctgctggggtccaccgtggcgtgcttcctgctccgcttctctacgggcgggcaggccacgggcaccttcagtctgacagccgtgccggtgtggaaagctctgaagctgtaaatcctgacgaccttacggttgatggagccgtt

SEQ ID NO: 25315 - protein, 146 aa, Zea mays
  misc_feature: Ceres CLONE 1397025-F
  misc_feature (13)..(146): Pfam Name: MIP Pfam Description: Major intrinsic protein
MPINRIALGSHQEVYHPGALKAAFAEFISTLIFVFAGQGSGMAFSKLTGGGPTTPAGLIAAELAHAFALFVAVSVGANISGRHVNPAVTFGAFVGGNITLFRRLLYCVAQLLGSTVACFLLRFSTGGQATGTFSLTAVPVWKALKL

SEQ ID NO: 25316 - DNA, 640 bp, Zea mays
  misc_feature: Ceres CLONE 1397028-F
  misc_feature (203)..(203): n is a, c, t, g, unknown, or other
  misc_feature (253)..(253): n is a, c, t, g, unknown, or other
aagctggagctccccgcggtggcggccgctctagaactagtggatcccccgggctgcaggaattcgcacgagaccattacctagaacatcctaatcgaaaaatcgcttcagctcggcgtcttcacaaacgccggcgcaaactctcgcccgagcccgacagatcttcaattccccattccgcccaccgatcgaccttcacgccnagtctcggggtctcttcccgaaggccgttcgcgccgcggttggtttgagnaaggagaggaggaagaatgaggagtgcatctccgtccaaatcgggaagggccgggatccaagtcgggaaacggggggtggggaattttactggctccaggaacgggatccaagcctggatgcccaaagggcctgagaaaaaaaaccggggggacatcccaagggaagggcttttaaaaaccttttttaaaacaaaatggtgtgggtgggaaaaaaaatttcccccgggagaaaatttttgtgggttataaaacaccccctggggtaaaaaaggggggggcgaatggggggaaaaaaaaccccctttttttttccccccgggggaggggttctttttggggggggggggggaggggcgcccccaaaaaatttttccccccgggggggg

SEQ ID NO: 25317 - DNA, 652 bp, Zea mays
  misc_feature: Ceres CLONE 1397038-F
  misc_feature: Encodes the peptide sequence at SEQ ID NO. 25318
  misc_feature (652)..(652): n is a, c, t, g, unknown, or other
aaagctggagctccccgcggtggcggccgctctagaactagtggatcccccgggctgcaggaattcgcacgagaccattacctagaacatcctaatcaaaaacaccgcggcccacgctgcgtaggactccccgactccgacggcgtccgcccgcgtcgcgtggcacgcccacgccacgccggccgccgcgaggaaagaacaccgggtacttccccttcccttacgctccagtttcacaagtcgcgagccgtgcgtcgcgtcgacgcgagttccgcgtgagggagcaggcagttgcagttggaggcggtgacgaaaccctaggacttgagttccagcgcacggctcgggtcctcctcaccgttcccggcgatggaacggcggcaggagctttgcaggaacttccagcgcggcagctgcaagtacggatcgcactgcaggtttgtgcacgcctcctctcagcagcagcagcaggcgaagcccaaccccgtttggggttcggcttagggagtaggcagcagcaacagcagcagtctttcgtttcgtgcgcagtttccagcagcagcagcagcagaaaccccaaccccggtttgggatttggagtggcaagggcagtgggggctggcaccagtccaagaaaacgcctccctgggcn

SEQ ID NO: 25318 - protein, 44 aa, Zea mays
  misc_feature: Ceres CLONE 1397038-F
  misc_feature (3)..(28): Pfam Name: zf-CCCH Pfam Description: Zinc finger C-x8-C-x5-C-x3-H type (and similar)
MERRQELCRNFQRGSCKYGSHCRFVHASSQQQQQAKPNPVWGSA

SEQ ID NO: 25319 - DNA, 661 bp, Zea mays
  misc_feature: Ceres CLONE 1397041-F
  misc_feature: Encodes the peptide sequence at SEQ ID NO. 25320
aaagctggagctccccgcggtggcggccgctctagaactagtggatcccccgggctgcaggaattcgcacgagaccattacctaggacatcctaatcgaaaaatacgccgccatcttcgcaagccaccgcaaccgaagcccgccttcgccgccgccggctctgcgatccccgcaaggtcgtaaacatgtctaccgtgctccagcgcccgacccccggcacggaccagtgcttcggtcgcaagaagacggctgtggccgtcgcctacaccaaggcggggcgcgggctgatcaaggtgaacggcgtcccgattgagctcatcagggcggagatgctccgcctcaaggccttcgagcccatcctgctggcggggcgctccaggctctaggacatcgacatgaggatccgcgtccgaggcgtcgggaagacgtcgcagatctacgccatccgccaggccgtcaccaaggggctcgtcggctactaccagaagtacgtcgacgaggccgccaagaaggaggtcaaggacatcttcaaccggtacgaccgcacccttctcgtcgccgaccccaggcgctgcgaggcgaacaagttcggtggtcgtggcgccccgcccaggttccagaagtcctaccgtttgagcgctcggctgcccgcgcttgacga

SEQ ID NO: 25320 - protein, 88 aa, Zea mays
  misc_feature: Ceres CLONE 1397041-F
  misc_feature (2)..(79): Pfam Name: Ribosomal_S9 Pfam Description: Ribosomal protein S9/S16
MRIRVRGVGKTSQIYAIRQAVTKGLVGYYQKYVDEAAKKEVKDIFNRYDRTLLVADPRRCEANKFGGRGAPPRFQKSYRLSARLPALD

SEQ ID NO: 25321 - DNA, 636 bp, Zea mays
  misc_feature: Ceres CLONE 1397044-F
  misc_feature: Encodes the peptide sequence at SEQ ID NO. 25322
  misc_feature (448)..(448): n is a, c, t, g, unknown, or other
  misc_feature (545)..(545): n is a, c, t, g, unknown, or other
  misc_feature (550)..(550): n is a, c, t, g, unknown, or other
  misc_feature (554)..(554): n is a, c, t, g, unknown, or other
aaagctggagctccccgcggtggcggccgctctagaactagtggatcccccgggctgcaggaattcgcacgagaccattacctagaacatcctaatcgaaaagatccgatggcccgcgccgccgctcgcctcctccccatcttcctcccatggcggcgtcctcccccgccctgcctcctccgccggggcttcctaaaccctagcagccccagaacctccgcgcgcgtcgacaccctcgttctccctggagacgagcgcttgcccttcccctcgcccccacgcctcccgaaccagctgcgtcctgactacgggagtggcggcggaggcggcgctccctcgaccatcgcggccatcgtcacctcactcggcgcaggccctgcaggggtggggatcgtgcggatctccggccccgatgccgtcgccgtcgccgaccgcgttttccgcccangccggaccaggagggcgtcgacgccgtggcaaccgcgcagccactttgttgagtacggactcgcgctcgacgcggacggcagcgttattgacgaggntttgntggntgcaatgctctccccgagttcctacacgcgagaggatggtgtggagcttcagtgccatggcaacgatctctgcttgcgccgg

SEQ ID NO: 25322 - protein, 176 aa, Zea mays
  misc_feature: Ceres CLONE 1397044-F
  misc_feature (114)..(114): Xaa is any aa, unknown, or other
  misc_feature (146)..(146): Xaa is any aa, unknown, or other
  misc_feature (148)..(148): Xaa is any aa, unknown, or other
  misc_feature (149)..(149): Xaa is any aa, unknown, or other
MARAAARLLPIFLPWRRPPPPCLLRRGFLNPSSPRTSARVDTLVLPGDERLPFPSPPRLPNQLRPDYGSGGGGGAPSTIAAIVTSLGAGPAGVGIVRISGPDAVAVADRVFRPXRTRRASTPWQPRSHFVEYGLALDADGSVIDEXLXXAMLSPSSYTREDGVELQCHGNDLCLRR

SEQ ID NO: 25323 - DNA, 741 bp, Zea mays
  misc_feature: Ceres CLONE 1397046-F
  misc_feature (66)..(66): n is a, c, t, g, unknown, or other
  misc_feature (67)..(67): n is a, c, t, g, unknown, or other
  misc_feature (76)..(76): n is a, c, t, g, unknown, or other
  misc_feature (741)..(741): n is a, c, t, g, unknown, or other
ggtgggttggttggcgccccccccccctccccctccctgacaatttcctcacctctctcccccccnngcggccccntaaagctggagctccccgcggtggcggccgctctatactagtggatcccccgggctgcaggaattcgcacgagaccattacctagaacatcctaatcgaaaaaaaataaaatccaattttctcagtctcgagcgcccgcgtccctcgccccgtcgcgactcgcgacttcgcgagtcgccccgtcccagcctcccagccgtcccggatccccgcgaccccgccctccggcagtccggcgcgggggctcctctccgatccggtgagccgaacgaggatcccaactccccgaagaaagcggccacagccagagccagggtggctcggctctcctctcacagactgcgccgcagcgcctagcgctcgggtggcagccgctccggacgggcggccccgcgcccccgcccctgctgcctacatccgcctgcagccagaagatctgcctccagggaccgccctggctgcccccttggggtttctggggttctggacaccaagcacacgaacttggcccccaaacaaaggggggggggggatggagtatcctcaaaaagagcttcccccgggggaaggatcttgaccggggaaggaaggaagttcttctttttaacgagggtggggcccttcctccccccaagaataaccccttccgacggaagaaaaaatcn

SEQ ID NO: 25324 - DNA, 787 bp, Zea mays
  misc_feature: Ceres CLONE 1397052-R
  misc_feature (36)..(36): n is a, c, t, g, unknown, or other
  misc_feature (52)..(52): n is a, c, t, g, unknown, or other
  misc_feature (53)..(53): n is a, c, t, g, unknown, or other
  misc_feature (56)..(56): n is a, c, t, g, unknown, or other
  misc_feature (752)..(752): n is a, c, t, g, unknown, or other
gtggtggtggccctccccccctccctctcccccccngggaaagtggaagttnnttnacataatgggtaccgggccccccctcgaggtcgacggtatcgataagcttttttttttttttttttgaccaatagcgcacaactcaaatctgcgttcccaaatggcctactctactgaacaaaaaaaaaatgcatcggcatcatcgatcacgatatacgtttacagagaatcgttttatcggctgtaacaggttcctctgtcatcacagttaaacaaggtttaagtagcaacagaaaggatttggactcggtgtaacaaagctctctttcgcaagtggccaagtatgcaaatttggagcgaacttatttacgtccctgaggagcttcgtaactgccagcattggagcctgctcgcccagatccataggctggatgctgcccagcctaccccatagggtgaggacccctgcgcaacgatgaaagggagactgcccctgtgctagactggtatgatgatgggtagctgtggggcgcccataccccaagatagagtctgcgattgtggaataagaacgggtgccccccgaggctgaaaccatatggtactcactgtgcgtctggcccgcgtgcggacgccctatgagaggaggctttgaacctcaacagtccgtaggtaattggttgtgcacccttgttgcgccgactccgattaggggatgaatacgagatagttcgggtcccccccccccatagtgngtctcggcccctcggattctgagaaaccccctcta

SEQ ID NO: 25325 - DNA, 629 bp, Zea mays
  misc_feature: Ceres CLONE 1397053-F
  misc_feature: Translation starting site: 165
  misc_feature: SWISSPROT Homolog: EC 4.2.3.1 Threonine synthase
  misc_feature (361)..(361): n is a, c, t, g, unknown, or other
  misc_feature (428)..(428): n is a, c, t, g, unknown, or other
  misc_feature (429)..(429): n is a, c, t, g, unknown, or other
  misc_feature (435)..(435): n is a, c, t, g, unknown, or other
  misc_feature (438)..(438): n is a, c, t, g, unknown, or other
agagctggagctccccgcggtggcggccgctctagaactagtggatcccccgggctgcaggaattcgcacgagaccattacctagaacatcctaatcgaaaaatcgccccccttcggccttccccactgtactctccaatctcgccgccaagcctcaccgcaccatggcgaccttcaccgcggcctcctccctctccctcctcttctcccacccgcactcccactcccgccaaccatccgcccaggggcccaccgccagctcccacctccacctgcatccgcgcgccagccgcgcgcgctgcgcctcttccgacacgacggccacgaagcaccgccgcccagcggaggagaacatccgcgnaggaggcgcgcggctccgaggcccggcccagggtttctctgcgtggtacgagccctttcccgccggnngccggnggngacccgaacgagcgctactcgctggacgaggtcgtctaccgctccagctcgggggggctcctcgacgtgcggcacgacctggaggcgctgccccgctaaccggggtcctactggggggacctcttcaattcccgggtcgggccgaaccgcgggggcataagggttcggggggttgggccccaaaaaaggag

SEQ ID NO: 25326 - DNA, 648 bp, Zea mays
  misc_feature: Ceres CLONE 1397055-F
  misc_feature (464)..(464): n is a, c, t, g, unknown, or other
  misc_feature (490)..(490): n is a, c, t, g, unknown, or other
aaagtggagctccccgcggtggcggccgctctagaactagtggatcccccgggctgcaggaattcgcacgagaccattacctagaacatcctaatcaaaaagacgtccacagtgcgccgtgttctgccgcgcctgcgctcccaccgcgtgtccgcaactctgccccacctcacatccgcgtccgcaatccgcgcctccgccgccgcagcccttcctccgcgcagcgtccgtccatccatggctctccctacacgcagtgtcgtgccgctttccgcaatccgtgcctcaatccccttccttcgcgcagtgcccttccatccatggctcgcttccagaaatcccctacctacggcgcagcgtcgcagtcaggaatccgcccccaaaatcactacccgctctgcggcgatggaagggaaatcatccgtcaatggaaggaacacgtgcttccccccttccatctcggngctgcgcggattgcggattgcatggncatcgtttcgcgccccaatccgtcgatgcaaggaacgcgtgcttcccccttcccatctcggcgctgcgcgaattgcagattgcatggtcatcgtttcgccccagttcattgcccgcatcagatggaagggtgcccccgatcggctcaccctcatcatg

SEQ ID NO: 25327 - DNA, 679 bp, Zea mays
  misc_feature: Ceres CLONE 1397057-F
  misc_feature: Encodes the peptide sequence at SEQ ID NO. 25328
  misc_feature (248)..(248): n is a, c, t, g, unknown, or other
  misc_feature (249)..(249): n is a, c, t, g, unknown, or other
  misc_feature (270)..(270): n is a, c, t, g, unknown, or other
  misc_feature (271)..(271): n is a, c, t, g, unknown, or other
  misc_feature (280)..(280): n is a, c, t, g, unknown, or other
  misc_feature (316)..(316): n is a, c, t, g, unknown, or other
aaagctggagctccccgcggtggcggccgctctagaactagtggatcccccgggctgcaggaattcgcacgagaccattacctagaacatcctaatcgaaaagcgcattgtggctcctcacttctgcgccgccacccactacaggtaaggaagaggaggagggcaggatgtcgcaccgtaagttcgagcacccgaggcacggctccctcggcttccttcccaggaagcgctcctcccgccaccgcggnnaggtgaagtcatttccccagnngatgacccnagaagccttggcatctcactgccttccttggctacnaggctggcatgactcacattggccgtggagggtgagaagccaggatccaaacttcataagaaggaaacttggggaaggctggtaccatcatttgaacccctccctcttggcattggtggggctcgtggaataatgggaagaattcttcgtggggctccgcaactcaaatttttgttttgggccccacatctttaacggaaaattgggggggaaaaggtcttaaaaaaaaatgggggaagagaccaaaaaaaaagggttttaccaaaagtaaggttcccaaaattgaaaaatggtggttgggaaaaaaggaaattccccttgaagctttggaaaaatggaaaaaaattgggtttttggtaaccc

SEQ ID NO: 25328 - protein, 93 aa, Zea mays
  misc_feature: Ceres CLONE 1397057-F
  misc_feature (28)..(28): Xaa is any aa, unknown, or other
  misc_feature (35)..(35): Xaa is any aa, unknown, or other
  misc_feature (38)..(38): Xaa is any aa, unknown, or other
  misc_feature (50)..(50): Xaa is any aa, unknown, or other
MSHRKFEHPRHGSLGFLPRKRSSRHRGXVKSFPQXMTXEALASHCLPWLXGWHDSHWPWRVRSQDPNFIRRKLGEGWYHHLNPSLLALVGLVE

SEQ ID NO: 25329 - DNA, 690 bp, Zea mays
  misc_feature: Ceres CLONE 1397059-F
  misc_feature: Encodes the peptide sequence at SEQ ID NO. 25330
  misc_feature (360)..(360): n is a, c, t, g, unknown, or other
  misc_feature (372)..(372): n is a, c, t, g, unknown, or other
  misc_feature (416)..(416): n is a, c, t, g, unknown, or other
  misc_feature (513)..(513): n is a, c, t, g, unknown, or other
  misc_feature (623)..(623): n is a, c, t, g, unknown, or other
  misc_feature (641)..(641): n is a, c, t, g, unknown, or other
tggagctccccgcggtggcggccgctctagaactagtggatcccccgggctgcaggaattcgcacgagaccattacctagaacatcctaatcgaaaacgaaaaaaccccaccgcagcacagcgccggcaaccgccgccatcgatcgatcgcccggaaactgacctctaccgatgtctggagccggcgaggaggataagaagcccgcggagggcggcgcccacatcaaccttaaggtcaagggacaggatggcaatgaggtgttctttcgcataaagaggtccacccagctgaagaagctgatgaacgcctattgcgaccgccagtctgtggacatgaatgccattgcattccctgtttgnatggccgcaggncttcgcggcgagcagacccctgatgagctggaggatggaggacnggcgacgagatcgacgccatgcttcaccagaccgggaggcagcgttcctagcaccacctaaaagcagcagctgcggaaggcctcgttttgctctccngccctgcgtagtactaaacaaaaagggaaaaaggtcttttttaaggaaactggtgatgctctgggctccttggtgccattgctgagggacatccttagcctttatttaanggggggttgggttttggnacttttggttcggccatcacctcgtttaatctatccctaatacatgccg

SEQ ID NO: 25330 - protein, 101 aa, Zea mays
  misc_feature: Ceres CLONE 1397059-F
  misc_feature (63)..(63): Xaa is any aa, unknown, or other
  misc_feature (82)..(82): Xaa is any aa, unknown, or other
MSGAGEEDKKPAEGGAHINLKVKGQDGNEVFFRIKRSTQLKKLMNAYCDRQSVDMNAIAFPVXMAAGLRGEQTPDELEDGGXATRSTPCFTRPGGSVPSTT

SEQ ID NO: 25331 - DNA, 821 bp, Zea mays
  misc_feature: Ceres CLONE 1397061-F
  misc_feature: Encodes the peptide sequence at SEQ ID NO. 25332
  misc_feature (20)..(20): n is a, c, t, g, unknown, or other
  misc_feature (48)..(48): n is a, c, t, g, unknown, or other
  misc_feature (49)..(49): n is a, c, t, g, unknown, or other
  misc_feature (51)..(51): n is a, c, t, g, unknown, or other
  misc_feature (779)..(779): n is a, c, t, g, unknown, or other
gggtggcccccccccccccnccaggccagcgctagcggtattaggccnncncccaccgctggggctccaccgcggtggcggccgcttcttcaatagtggatcccccgggctgcaggtatttcgcacgagaccattacctagaacatcctaatcgaaaaaccgcagccgcagcacaatcgcctcgccttcccttccccaccagcccgtctctctcttctctctgtctctcttctcgtagccgcgtccacctcgcagcagcaagcaagcgcgaccaaatggcgcctctaggagacggcggagctgctgccgcggcggcgtccaacaacctggtggtgtcgttcggcgagatgctgatcgacttcgtccccgacgtggccgggctgtcgctggccgagtcgggcggcttcgtcaaggaccccggaggagcgcccgccgagcggcgactgcgaccatcgcacaagctcgtcggctcctccgaccttcggtcggcaagcttccggcacaccacggagcctccacaccccatgtcgcacacgaaaccccgacgcggaccgaccagaggtgtcgagacccccaccccgcgaccgcaaccacacacagctaagtcactccaacacaagtcgcagatacgaacatcataaagcacctcaccaacacacaattccccgccggcaggcgcgccccccacacccataaacacaggaacggaggaggaggcgacgaacagggggttggtgacgataggaatagggagcgcgcgcacggagaacaaccaaaanacaaaagataaccgcatccatctcgttgtgccccccgcgccg

SEQ ID NO: 25332 - protein, 121 aa, Zea mays
  misc_feature: Ceres CLONE 1397061-F
  misc_feature: SWISSPROT Homolog: EC 2.7.1.4 Fructokinase
MAPLGDGGAAAAAASNNLVVSFGEMLIDFVPDVAGLSLAESGGFVKDPGGAPAERRLRPSHKLVGSSDLRSASFRHTTEPPHPMSHTKPRRGPTRGVETPTPRPQPHTAKSLQHKSQIRTS

SEQ ID NO: 25333 - DNA, 766 bp, Zea mays
  misc_feature: Ceres CLONE 1397065-F
  misc_feature (6)..(6): n is a, c, t, g, unknown, or other
  misc_feature (7)..(7): n is a, c, t, g, unknown, or other
  misc_feature (18)..(18): n is a, c, t, g, unknown, or other
  misc_feature (19)..(19): n is a, c, t, g, unknown, or other
  misc_feature (37)..(37): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (46)..(46): n is a, c, t, g, unknown, or other
  misc_feature (51)..(51): n is a, c, t, g, unknown, or other
  misc_feature (287)..(287): n is a, c, t, g, unknown, or other
gggggnnccccccccccnnccaccccactccccgccncccnnnntnaaaancccaaaagctggactccccgcggtggcggccgctctagaactagtggatcccccgggctgcaggaattcgcacgagaccattacctagaacatcctaatcgaaaaacacaattcacagcgctcaagttctcgcgcccagagccaaatttttctccactcaatcactgcagccatggacgccagcggagccggtagcaaggcgaagaagggggcggctgggcgcaaggctggcggcnccaggaagaagccggtgtcgcggtccgtcaaggccgggctgcagttccccgtcggccggatcgggggctacctcacgaagggccggtacgggcagagaggggtctttacgggccccgacttatacccgcgccgcccctcgaagagagccaacgacccactctctgcagagagagcgggcacacccacggcatcaacaccccccccacacccccccccgacccggcgacgacctcccttacagcgctcaccctctaatatgggtaggacgtggcgatgcccccgcccgccgcgagcgccctcatcgccccccaaaatgatcccccgagcacacacatttctgtaataacgtcccacattcgacccaccaacccacacgccccgcccaccccctaacactgcggtcccgcgcccccgcccgccgctcgcctggcctccgaacctatatctaccacacccacctgcctccgacatgcaccac

SEQ ID NO: 25334 - DNA, 661 bp, Zea mays
  misc_feature: Ceres CLONE 1397066-F
  misc_feature: Encodes the peptide sequence at SEQ ID NO. 25335
  misc_feature (661)..(661): n is a, c, t, g, unknown, or other
tggagctcaccgcggtggcggccgctctagaactagtggatcccccgggctgcaggaattcgcacgagaccattacctagaacatcctaatcgaaaatacctagaacatcctaatcgaaaaaatatctcaaaaagcccatcttctcttcctctctcgcagcaccgcctctcaacctccgccgccgctcgcccggggcgtcacccacccgcgcagaaggcccccgccgctcaagctaccggtgccctaaaccccgatatcttcttcgcctccctttcctcctcagcacccaatccccgaccttcagggttccgccgccatgccgcagggagaccacatcgagcttcaccagaagcgccatggcaagcgcctggaccacgatgaacgcaagcgcaagcgcgaggcgcgcgaggtgcacaggcgctcgaaggacgcccgcaatttgattggtgctaagggcaagaggttcgccaagaaacgctatgctgagaaggcacagatgaagaagaccctgaaaatgcacgatgaatcaaataagcgacagaaggttgatgatgatgtccaagagggtgctcttcctccgtatctactcgatcgtgatcagacacagcgtgccaaggtcctcagcaacacaatcaagcaaaagaggaaggaaaaggctgn

SEQ ID NO: 25335 - protein, 114 aa, Zea mays
  misc_feature: Ceres CLONE 1397066-F
  misc_feature (1)..(114): Pfam Name: Ribosomal_S8e Pfam Description: Ribosomal protein S8e
MPQGDHIELHQKRHGKRLDHDERKRKREAREVHRRSKDARNLIGAKGKRFAKKRYAEKAQMKKTLKMHDESNKRQKVDDDVQEGALPPYLLDRDQTQRAKVLSNTIKQKRKEKA

SEQ ID NO: 25336 - DNA, 642 bp, Zea mays
  misc_feature: Ceres CLONE 1397073-F
  misc_feature: Encodes the peptide sequence at SEQ ID NO. 25337
ggagctccccgcggtggcggccgctctagaactagtggatcccccgggctgcaggaattcgcacgagaccattacctagaacatcctaatcgaaaagttatcccccacccggacaatcttccttcaggcttcagctgtccgcccgcggcccacccctccgccgtctccaccattccgccgttcccaccacgccactcgccagttcggcactccctcctgtctcccccccttgccgagacggcgcggacgccccgtcgcccaccccgatggctgccactctcctccacgccgccaccgcctcgctccagagctcctcccagcccgcacgcgcgggcgccgccaccgcctttcaccccctcgcgtccaccccatccatacgcctcgcgcgctcctcgttctcgttcaatcgccgcctcgaggtttcactccgggcggttttcggccgtcactggtttcgcgggaggggaagaacccggggccgccgcgtcgtccccgccctaagagggggagaaaattgagggcccaaaaggggggcgatgacaagggtaaacagccaccggggaaaaaaaggcccaagaaggcccaagaaaacttggaaaaggaaatgttggaaaaaattcaaggggggaaggccccggggaa

SEQ ID NO: 25337 - protein, 83 aa, Zea mays
  misc_feature: Ceres CLONE 1397073-F
MAATLLHAATASLQSSSQPARAGAATAFHPLASTPSIRLARSSFSFNRRLEVSLRAVFGRHWFRGRGRTRGRRVVPALRGGEN

SEQ ID NO: 25338 - DNA, 646 bp, Zea mays
  misc_feature: Ceres CLONE 1397074-F
  misc_feature (474)..(474): n is a, c, t, g, unknown, or other
  misc_feature (564)..(564): n is a, c, t, g, unknown, or other
  misc_feature (566)..(566): n is a, c, t, g, unknown, or other
  misc_feature (588)..(588): n is a, c, t, g, unknown, or other
tggagctccccgcggtggcggccgctctagaactagtggatcccccgggctgcaggaattcgcacgagaccattacctagaacatcctaatcgaaaaagaagcccagaacttaaacctggaagcctggaggatggaacgggtactagcttgctagggttcgtgtccggcggcggcgactgcagctggaacgccggcggcgcagctcagtggatgctcccatcgaccattcccaggtttggttctccctcatccggtcctcctccatgtctccatggctgaatcactatcgttctcttctcacgcacgtcatgttgtcaaatccatcactggctttagctcccgtgatctgatcaacagcaaaacgaactcactacacactatgccactatggcatggagtttaattatgagacaatgtaaagactagagcgagtccactaatcacgggtggccaaagaaatcacccgacccagncttcagagtttagtattttactattattcgtcaccaccctgctacatgattacttgtatataaatagaggcacacgacaccatcctgtangntgtagtcttgtgatcttgtccntggagtacaccaaagactggtagaacagacgacctctgccgatgctggtgcccaaaag

SEQ ID NO: 25339 - DNA, 636 bp, Zea mays
  misc_feature: Ceres CLONE 1397079-F
  misc_feature: Encodes the peptide sequence at SEQ ID NO. 25340
  misc_feature (544)..(544): n is a, c, t, g, unknown, or other
aaagctggagctccccgcggtggcggccgctctagaactagtggatcccccgggctgcaggaattcgcacgagaccattacctagaacatcctaatcgaagagttccatgaagaaaaaagaagaactcggccgccggccgctgcccctctcggatgcacgacgtccgagagggcgtgccccctggccccgtcccttgtcgcctgcccgacggtggccgcacaggctgccagtgacatactgccatccctccgtccgatcgactgcccagtgtgcctgcccggcgccctggactcccgtccgctggatctctgcccaggcgccaggtcggaggtcccaccgccccagaccacccgtgaaccagtccgctgcaggatgcaggccaccgtacctccaggtcgccgatcagattattaatcattcagatacgccagctccgcctagacgcgaatcctccgacactatggtgtcagcgttgtccctgccgagtcaagcacaggccgtgcttcggagtcgcttctgctactccgacatcatacactccgncctcagtaggtcgctggacactaattacaggaaggtgacgtacctcgtcgacagctcgatctccgagtctgacacaattctgtccgtctctg

SEQ ID NO: 25340 - protein, 58 aa, Zea mays
  misc_feature: Ceres CLONE 1397079-F
  misc_feature (28)..(28): Xaa is any aa, unknown, or other
MVSALSLPSQAQAVLRSRFCYSDIIHSXLSRSLDTNYRKVTYLVDSSISESDTILSVS

SEQ ID NO: 25341 - DNA, 677 bp, Zea mays
  misc_feature: Ceres CLONE 1397082-F
  misc_feature: Encodes the peptide sequence at SEQ ID NO. 25342
  misc_feature (233)..(233): n is a, c, t, g, unknown, or other
  misc_feature (298)..(298): n is a, c, t, g, unknown, or other
  misc_feature (304)..(304): n is a, c, t, g, unknown, or other
  misc_feature (312)..(312): n is a, c, t, g, unknown, or other
aaagctggagctccccgcggtggcggccgctctagaactagtggatcccccgggctgcaggaattcgcacgagaccattacctagaacatcctaatcgaaaaacaacaccagaatccgcgaatcacagacgcgtctatctcagcttgctgcactgcactaccctgccctgccatcatatcgtacgtgagcccggccgagcgagagcgagggagaggcatggctgctccgaagntcgcgacgctgggcgctggccgtgctcctggcggcgaccgtggtggctcccccggccgcggtggncgcggncgatgtcntgctccaccgtgtacagcacgctgatgccgtgcctgccgttcgtccagatgggcggggccatgccggcccagccgtgctgcggcggcatccggcagctggctgcagcagggcaacaacacccccgaccgccgcaccatctgcggctgcctccagaacggcggccacggcggccaacgggagcggcacctacatcagccgcggcggccgcggtggccagaaaggggcgggggcgccctggcggaaaaaatcagcacccacggttaactggaacaccgataaattaagtggatgaggcgtcctggtgcgcgtcccggggcgaggaatggctggcatgggccttgggggaaaagaaaaaaaatattgg

SEQ ID NO: 25342 - protein, 96 aa, Zea mays
  misc_feature: Ceres CLONE 1397082-F
MSCSTVYSTLMPCLPFVQMGGAMPAQPCCGGIRQLAAAGQQHPRPPHHLRLPPERRPRRPTGAAPTSAAAAAVARKGRGRPGGKNQHPRLTGTPIN

SEQ ID NO: 25343 - DNA, 649 bp, Zea mays
  misc_feature: Ceres CLONE 1397084-F
  misc_feature: Encodes the peptide sequence at SEQ ID NO. 25344
  misc_feature (160)..(160): n is a, c, t, g, unknown, or other
  misc_feature (369)..(369): n is a, c, t, g, unknown, or other
aagctggagctccccgcggtggcggccgctctagaactagtggatccccccgggctgcaggaattcgcacgagaccattacctagaacatcctaaaaaaaaaaaaaaaaaaaaatccggtcgcttgaatcgtactagtcgtgctctcgacagaaagcccnggccgaaacccagcccggaccaggaccaagccctgttcgccgtgcgcgcggtgccccgggccagatctgcgagatctgcaccgacaccgctacgcctatcacgagcctgtaggtggatgctctcgtgatctctcggaggccgcggggactgagcggcatctcggcggaggcgtagcctgcttagctggtggcctgccgagatgcagcgnaaacggggtggtggaatgcagcgtgtgtcgctccccgggtgggtggtgccgagtccccggagcgtggtccagggcatacgacaagcaccgcagcaagatgtcgtccaagttccgcgcgctcaacgtctttcctcgttggcggcgactgcatcccttggttggtctccagcccatcctaagtgttcatgtcaaagtttggttgggaaggttccgggttcggcccatcaggggttaactttctgaccgggggtatggaaggcatctttggctattgggaggg

SEQ ID NO: 25344 - protein, 45 aa, Zea mays
  misc_feature: Ceres CLONE 1397084-F
MSSKFRALNVFPRWRRLHPLVGLQPILSVHVKVWLGRFRVRPIRG

SEQ ID NO: 25345 - DNA, 641 bp, Zea mays
  misc_feature: Ceres CLONE 1397090-F
  misc_feature: Encodes the peptide sequence at SEQ ID NO. 25346
  misc_feature (393)..(393): n is a, c, t, g, unknown, or other
  misc_feature (473)..(473): n is a, c, t, g, unknown, or other
  misc_feature (589)..(589): n is a, c, t, g, unknown, or other
  misc_feature (623)..(623): n is a, c, t, g, unknown, or other
aagctggagctccccgcggtggcggccgctctagaactagtggatcccccgggctgcaggaattcgcacgagaccattacctagaacatcctaatcgaaaacctcgcgcgcacgttctgccgcgcgcatacgcccgcatcccgcagccgcggcagcgccgcagccgctccttccatcctccgccctccttccatcctccgcggatcccagctctccctcccgcgcccgcccgcagccgcaccgcatcccgcagccggcgtcggcgcaacggctgatgctcaaggggtgtgagtcgctgctacagcggcagtgccggccgcgcacccccgcggggtacatggagcccacgccgctaccggttggcggtgaagagcaaggggacagataagcccnaaggcagcaaggggaacgtcgacaaggacccaaaacagctgactcccacacttttttgttcgctggtgctgcggcgacgntgctggcgagctctcccgtgctgggctctgggatgctcccaggcaccggggtcggcgagacgtggagtcacacacggcggatgcgccgccgctgctgcctttgcagtcctcgatcngatcaagggaatattgtcagtggaagagactggntgatcaaaggcagccacg

SEQ ID NO: 25346 - protein, 37 aa, Zea mays
  misc_feature: Ceres CLONE 1397090-F
MLKGCESLLQRQCRPRTPAGYMEPTPLPVGGEEQGDR

SEQ ID NO: 25347 - DNA, 690 bp, Zea mays
  misc_feature: Ceres CLONE 1397097-F
  misc_feature: Encodes the peptide sequence at SEQ ID NO. 25348
  misc_feature (299)..(299): n is a, c, t, g, unknown, or other
  misc_feature (426)..(426): n is a, c, t, g, unknown, or other
  misc_feature (457)..(457): n is a, c, t, g, unknown, or other
  misc_feature (464)..(464): n is a, c, t, g, unknown, or other
  misc_feature (580)..(580): n is a, c, t, g, unknown, or other
aaagctggagctccccgcggtggcggccgctctagaactagtggatcccccgggctgcaggaattcgcacgagaccattacctagaacatcctaatcgaaaaatcaccaccatctcacttcatataccactccctaggaggacccagcaacacacacagccgagctttgcttaggcaagatgaacaggaagccaggagactgggactgcagggcgtgccagcacctcaacttcagccgccgagacatatgccagcgctgcagcgagccacgtggagttgctgatccctgggcggcggangaaggaggaggcgactacgccagctcggtgggcccgcggtggctcctcctttcggcgggcggctttgggcgctgtggggctcctgacgtcccggctgggggggactggtaactggctccctggcgcngcgcaacaacttccgccagcccgctccagcntggcttncaaggtgctccgccctaccaaggagggaaaggcggctgtggacaagggggcgcttggcgggtttttgacgggcgacatgtcacggctcacgggggctacggtttcccgcagcgggngctggctgggggccttgggccttggccttgccccgtactaccaaccggccccggggtgggaagccccgaaaaaaggggatcgggacccagaaacccgaagggggacgagg

SEQ ID NO: 25348 - protein, 76 aa, Zea mays
  misc_feature: Ceres CLONE 1397097-F
  misc_feature (40)..(40): Xaa is any aa, unknown, or other
MNRKPGDWDCRACQHLNFSRRDICQRCSEPRGVADPWAAXEGGGDYASSVGPRWLLLSAGGFGRCGAPDVPAGGDW

SEQ ID NO: 25349 - DNA, 629 bp, Zea mays
  misc_feature: Ceres CLONE 1397099-F
  misc_feature: Encodes the peptide sequence at SEQ ID NO. 25350
  misc_feature (428)..(428): n is a, c, t, g, unknown, or other
  misc_feature (446)..(446): n is a, c, t, g, unknown, or other
  misc_feature (462)..(462): n is a, c, t, g, unknown, or other
  misc_feature (463)..(463): n is a, c, t, g, unknown, or other
  misc_feature (532)..(532): n is a, c, t, g, unknown, or other
agagctggagctccccgcggtggcggccgctctagaactagtggatcccccgggctgcaggaattcgcacgagaccattacctagaacatcctaatcgaaaagtgcccgcggtgctagtgacggttgctctagatccgttcatcctggtggttttgtgaggtcgaaagcggcgagcgaattaaaagatgctggacaagctgtgggacgacgtggtggccgggcctcgcccggagacgggcctcgagaagctccgcaaggccaccaccgcccgcccgctcgtcatcaacaaagacgcggacggcggcagctacaagcgggcgcagtcgacgccgtcgaccccgacgacgccggtgacgccgtcgtcgtcgacgacgccgcgcggcgccggcaacgtggcgcaacgtcttccacccgggggagcacctgnccaccaggggcatggcgncaacctcttcgaccgnncgcagcccaactcccccaccgtctacgactggctctacagcgacgagaccaggagcaaccaccgctagnatcggcgagatggatggacagtgaagaagccatgtttgctggccctggtggttatctaaacgcacgcatgctctattatagctagccatcactattt

SEQ ID NO: 25350 - protein, 114 aa, Zea mays
  misc_feature: Ceres CLONE 1397099-F
  misc_feature (5)..(114): Pfam Name: Auxin_repressed Pfam Description: Dormancy/auxin associated protein
  misc_feature (81)..(81): Xaa is any aa, unknown, or other
  misc_feature (87)..(87): Xaa is any aa, unknown, or other
  misc_feature (93)..(93): Xaa is any aa, unknown, or other
MLDKLWDDVVAGPRPETGLEKLRKATTARPLVINKDADGGSYKRAQSTPSTPTTPVTPSSSTTPRGAGNVAQRLPPGGAPXHQGHGXNLFDRXQPNSPTVYDWLYSDETRSNHR

SEQ ID NO: 25351 - DNA, 612 bp, Zea mays
  misc_feature: Ceres CLONE 1397100-F
  misc_feature (354)..(354): n is a, c, t, g, unknown, or other
  misc_feature (529)..(529): n is a, c, t, g, unknown, or other
tggagctccccgcggtggcggccgctctagaactagtggatcccccgggctgcaggaattcgcacgagaccattacctagaacatcctaatcgaaaaatgttctgcctccgcaccctccgatcgcccgccgcgtccgattcccctgaccccgcctcgccctcaatctccgccgccgcgcccgcgacatccatcacccccgcccgcgacatcccgcctcgcacgccatcaactcacagcggcccttctccgaacgtggtttgttttttcgtttgctcgagcagccagccgactcgtctccagcaatgcggccggggtcggctcgctggaggtgggcgccgccgccgacacctccnacgcctccaagcagggattaggtgagccgtcggctaatcactcgtcattgggaggatctcctcctcccgttcagatttgggcaagaaaggcccgggcgcgatgtccatggccgaggaggggagtgaggccgaggcgctcgagaaagacggcagcaaggcttcttcaccttcgggncccagttaggcgttcctgccgctcttctttcctcccgtgtcgtcagaggaaagcgcgaaaagacgcagggaatcagggggtct

SEQ ID NO: 25352 - DNA, 635 bp, Zea mays
  misc_feature: Ceres CLONE 1397104-F
  misc_feature: Encodes the peptide sequence at SEQ ID NO. 25353
  misc_feature (438)..(438): n is a, c, t, g, unknown, or other
  misc_feature (546)..(546): n is a, c, t, g, unknown, or other
  misc_feature (635)..(635): n is a, c, t, g, unknown, or other
ggagctcaccgcggtggcggccgctctataactagtggatcccccgggctgcaggaattcgcacgagaccattacctagaacatcctaatcgaaaaacagaaccctgcaactgcaagctaaggagagtgcgatcaccaacagttagtgctagtcccccttccttccatccatccatggcatgcgtcaacaccttccagagctgccccattgccagaagagcaaagatcaacacgaggtccaggcgctgcagcacgagcgtggtgaagggctcatcaccaccagccttccagttccagtgcagggcgtcgactttcgcggcggacaccagcctccgtgtcgagctggacaagaaccccgaggcgatcatctcgggggcgtgacccgggaactgctccctcctcagataaaacgaactccgcgccttaccctcgagtcgnagggaaacggcggtccaggaagaacgcccaccaagcgcgcggtggcggtcctgaaccaaaacaggtcccaaacccgggatggggggcaccagcaaaaacaaaccctgnaaggacgtaggagggccaccttccaaggccttggtagggggcttcacggatcgtgcgaaagcgggccctaaaaaagagccccgccctan

SEQ ID NO: 25353 - protein, 68 aa, Zea mays
  misc_feature: Ceres CLONE 1397104-F
MACVNTFQSCPIARRAKINTRSRRCSTSVVKGSSPPAFQFQCRASTFAADTSLRVELDKNPEAIISGA

SEQ ID NO: 25354 - DNA, 694 bp, Zea mays
  misc_feature: Ceres CLONE 1397106-F
  misc_feature: Encodes the peptide sequence at SEQ ID NO. 25355
aaagctggagctccccgcggtggcggccgctctagaactagtggatcccccgggctgcaggaattcgcacgagaccattacctagaacatcctaatcgaaaactccccaactcgccgtctgccttctgcgcctccatttcggcctctgtcccttgcaagttcaatctcacctccaaccatgggtaaagagaagtcccacatcaacattgtggttattggccatgtcgactctggcaagtcgaccaccacaggacaccttatctacaagcttggaggcattgacaagcgtgtgatcgagaggtttgagaaggaggctgctgaaatgaataagcggtccttcaagtacgcgtgggtgctcgacaagctcaaggctgagcgtgagagaggtatcaccattgatattgctcctgtggaagtttgagaccaccaagtactactgcacggtcattgatgcccctggacaccgtgacttcatcaagaacatgatcactggtacctcccaggcttgactgtgctgtccttatcattgatcacccactgggggggtttttgaggctggtatctcccagggatgagccagacccgtgaacatgcttctccttggttaaaccccctggaagggaaacacaaatgatttgcttgctggaaccaagatgggatggcaaccccctcccaaatactcccagggagcgtt

SEQ ID NO: 25355 - protein, 80 aa, Zea mays
  misc_feature: Ceres CLONE 1397106-F
  misc_feature (5)..(81): Pfam Name: GTP_EFTU Pfam Description: Elongation factor Tu GTP binding domain
  misc_feature: SWISSPROT Homolog: EC 2.7.7.4 Sulfate adenylyltransferase
MGKEKSHINIVVIGHVDSGKSTTTGHLIYKLGGIDKRVIERFEKEAAEMNKRSFKYAWVLDKLKAERERGITIDIAPVEV

SEQ ID NO: 25356 - DNA, 712 bp, Zea mays
  misc_feature: Ceres CLONE 1397119-F
  misc_feature (275)..(275): n is a, c, t, g, unknown, or other
  misc_feature (712)..(712): n is a, c, t, g, unknown, or other
aagctggagctccccgcggtggcggccgctctagaactagtggatcccccgggctgcaggaattcgcacgagaccattacctagaacatcctaatcgaaaaaaatcacagcacaaacgttcctctcctcttccatcgtcgtcctcgctcccggccccgcctgtctagtctagtccccctcttctcgcgtgcaacccctgtactgtacgtgctaggcacacagctagctgcagctacagaagggcagcaaatggtttctgggtggggtcatggtgnttaaccgcgttgtggacgacgggaaaggccgtccgactaccagggcaaaacccggcggaacaaggcaaggaacggaaggctggatagggcccccgggattgatcctgggcaacagaaattgggggaaccccccgcgccataattggaaattttctatggaaccttggggaacgaaccttcggggggggggatttgaaattttccaaaatccaaagggccggccaccgtgggtggccaaaatatctgggggggaggggattaaacttggttccgcccgtgtgtgaggtggttttcctccaaccaagacacaaaggtcgggcgaaataaattaaccaattgctcgatttccgccaaaaattgtccgcccaaagggttgttaaatattgtttgaaggggggcaaaccccaagggggcccgttggaggggcctcggcgagn

SEQ ID NO: 25357 - DNA, 600 bp, Zea mays
  misc_feature: Ceres CLONE 1397122-F
  misc_feature: Encodes the peptide sequence at SEQ ID NO. 25358
  misc_feature (303)..(303): n is a, c, t, g, unknown, or other
  misc_feature (374)..(374): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (390)..(390): n is a, c, t, g, unknown, or other
  misc_feature (391)..(391): n is a, c, t, g, unknown, or other
aagctggagctccccgcggtggcggccgctctagaactagtggatcccccgggctgcaggaattcgcacgagaccattacctagaacatcctaatcgaaaaacctataatattttgagcattcagaaacacaccaagcgaagcgcactagcaacaacctaacaacaatggctaccaagatattatccctccttgcgcttcttgcgctttttgcgagcgcaacaaatgcgtccattattccacaatgctcacttgctcctagttccattattccacagttcctcccaccagttacttcaatggncttcgaacacccagctgtgcaagcctataggctacaacaagcgatttgcgcgagcgtcttacaacaccaanttgcccannntgcacnnacatcctttggcacatctaacaataacaaccatcgcaacgcaacagcaacaacagttccctaccagcactgagccaccctagccatgggggaaccctggtcgccctattggaaaaaggaagtggtttggaatccaaccccctttgttctaagaaaacggagtttggaaaacccggaaaaaaaaacaattggaaaaagttttcccccccc

SEQ ID NO: 25358 - protein, 98 aa, Zea mays
  misc_feature: Ceres CLONE 1397122-F
  misc_feature (46)..(46): Xaa is any aa, unknown, or other
  misc_feature (70)..(70): Xaa is any aa, unknown, or other
  misc_feature (72)..(72): Xaa is any aa, unknown, or other
  misc_feature (73)..(73): Xaa is any aa, unknown, or other
  misc_feature (75)..(75): Xaa is any aa, unknown, or other
MATKILSLLALLALFASATNASIIPQCSLAPSSIIPQFLPPVTSMXFEHPAVQAYRLQQAICASVLQHQXAXXAXTSFGTSNNNNHRNATATTVPYQH

SEQ ID NO: 25359 - DNA, 656 bp, Zea mays
  misc_feature: Ceres CLONE 1397130-F
  misc_feature: Encodes the peptide sequence at SEQ ID NO. 25360
  misc_feature (524)..(524): n is a, c, t, g, unknown, or other
  misc_feature (625)..(625): n is a, c, t, g, unknown, or other
  misc_feature (632)..(632): n is a, c, t, g, unknown, or other
gctctagaactagtggatcccccgggctgcaggaattcgcacgagaccattacctagaacatcctaatcgaaaaaattagccagcccacctctgctctgcgggcgcttcagatggaagcactagccattggatccgcgcctcgccgtccgggcgcaaggtactcccaactccgccgccccggaaccctcgccgtcaccaccacagccacagttgcatgccgccccctcacggcgccctccatggacgccgccgttggacgcccgagccgcgcgactatccgctgcaccagcgcgtagacggactcgttggatgaggtcgagacgagctcatacttcgcgcatgccaacggggggggggggacgcaacaagagggcaacgggagccccgtggacgccgctgacgcgaaatcccccgggtacgcggggccagaccgaaaaaagatccggcggtggtccgtgaagtggcacgcggtgcactaagcgggccccttacggctccctacccgaaaatcacgggaaccatncctgggaacgtcgcccgacgacatgccattggtaatatggacgcccccctcctactcataaaaacgtcgagtcgggtccttggttcttgttgtaagggagnagatcgnagtttttctcccccccgcaatatg

SEQ ID NO: 25360 - protein, 61 aa, Zea mays
  misc_feature: Ceres CLONE 1397130-F
MEALAIGSAPRRPGARYSQLRRPGTLAVTTTATVACRPLTAPSMDAAVGRPSRATIRCTSA

SEQ ID NO: 25361 - DNA, 720 bp, Zea mays
  misc_feature: Ceres CLONE 1397133-F
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (24)..(24): n is a, c, t, g, unknown, or other
  misc_feature (25)..(25): n is a, c, t, g, unknown, or other
  misc_feature (36)..(36): n is a, c, t, g, unknown, or other
  misc_feature (47)..(47): n is a, c, t, g, unknown, or other
  misc_feature (48)..(48): n is a, c, t, g, unknown, or other
  misc_feature (50)..(50): n is a, c, t, g, unknown, or other
  misc_feature (51)..(51): n is a, c, t, g, unknown, or other
  misc_feature (54)..(54): n is a, c, t, g, unknown, or other
ggggggggcccnnnnnnnnnnncnnacctattacgnaataataagannannaanaaaaaaaggagaatcccaccgggggggggcgggttataactattggatcccccggggtggaggaattcgcacgagaccattacctagaacatcctaatcgaaaaatcaaccatattattgagaccaacaagcaacatagaaagtggaatccagtagcaacaatagagcaacaatggcgaccaagatattttccctccttatgctccttgctctttctgcatgtgttgctaacgcgacaattttccctcaatgctcacaagctcctataggttcccttcttcccccataccttccatcaatgatagcttcagtatgtgaaaacccagctcttcaaccctataggctccaacaagcaatcgcagcaagcaaacatacctttatcacccttgtttcaacaatcgccagccctatctttggtgcagtcattggtacaaaccatcagggcacagcagctgcagcaactcgtgctacctgtgatcaaccaagtagctctgggaaaactttctccctactctcagcaacaacaatttcttccattcaaccaactgtctacattgaaccgcgctgcttatttgcagcaacaactattaccattcagccagctagctactgcctactctcagcaacaaaaacttccttccatttaaccaaatggggcgcactgga

SEQ ID NO: 25362 - DNA, 648 bp, Zea mays
  misc_feature: Ceres CLONE 1397137-F
  misc_feature: Encodes the peptide sequence at SEQ ID NO. 25363
  misc_feature (222)..(222): n is a, c, t, g, unknown, or other
  misc_feature (226)..(226): n is a, c, t, g, unknown, or other
  misc_feature (264)..(264): n is a, c, t, g, unknown, or other
  misc_feature (267)..(267): n is a, c, t, g, unknown, or other
  misc_feature (289)..(289): n is a, c, t, g, unknown, or other
  misc_feature (430)..(430): n is a, c, t, g, unknown, or other
aagctggagctccccgcggtggcggccgctctagaactagtggatcccccgggctgcaggaattcgcacgagaccattacctagaacatcctaatcgaaaaaaccgcatcatcctttccctcgcgccgccgccaacgcaacccttgcagccccaatccctcacagcaaccatggctggcgcgcaggagtccctctctctggtgggcacgatgcgcggccacnacgncgaggttgacgcgatcgcgaccccgatcgaccactcgncgntcatcgtctcctcctccgcgancaagtccctgctggtgtggggactgaccaacccggtccactccaacccggaattcgggccaacggcgaataaaggggtcccccttcgccgggtcacggggcactcccacttcgtcaaggaagtcgtcctcaaatccgaaangcaagttcccctttcggctctggggaagggaaaaatccccctctcgggactccttcaccggggtcaccaaccgccggttcttcggcaaaaaaaaaggaaggcccctcccgctggccccttccccggaaaacaacccgaaaaattttcccgggccccccgaaaaaacaattataatctggaaaccccccgggggggggggagacaccacccgagggggg

SEQ ID NO: 25363 - protein, 159 aa, Zea mays
  misc_feature: Ceres CLONE 1397137-F
  misc_feature (18)..(18): Xaa is any aa, unknown, or other
  misc_feature (19)..(19): Xaa is any aa, unknown, or other
  misc_feature (32)..(32): Xaa is any aa, unknown, or other
  misc_feature (33)..(33): Xaa is any aa, unknown, or other
  misc_feature (40)..(40): Xaa is any aa, unknown, or other
  misc_feature (87)..(87): Xaa is any aa, unknown, or other
MAGAQESLSLVGTMRGHXXEVDAIATPIDHSXXIVSSSAXKSLLVWGLTNPVHSNPEFGPTANKGVPLRRVTGHSHFVKEVVLKSEXQVPLSALGKGKIPLSGLLHRGHQPPVLRQKKRKAPPAGPFPGKQPEKFSRAPRKNNYNLETPRGGGRHHPRG

SEQ ID NO: 25364 - DNA, 602 bp, Zea mays
  misc_feature: Ceres CLONE 1397147-F
  misc_feature: Encodes the peptide sequence at SEQ ID NO. 25365
  misc_feature (298)..(298): n is a, c, t, g, unknown, or other
aaagctggagctccccgcggtggcggccgctctagaactagtggatcccccgggctgcaggaattcgcacgagaccattacctagaacatcctaatcgaaaaactgccgcgccgccaccctctacagataaggaagaggaggagggcaggatgtcgcaccgtaagttcgagcacccgaggcacggctccctcggcttccttcccaggaagcgctcctcccgtcaccgcggcaaggtgaagtcattccctagggatgaccccaagaagccttgccatctcactgccttccttggctacnaggctggcatgactcacattgtccgtgaggttgagaagccaggattccaactccataagaagggaacttggtgagctggtaccatcattgaaacccctcctcttgtcattggtgggctcgtggcatatgtgaagacatcccgtgggcttcgcaactcaactctggttggggccaacatcttaacgaaaaagtgaggagaaaggtctaccaaaacttggtggcagaggcagaagaaagctttcaccagggatgctcctcaatatggaaaatgatgctggcaagaagaaattcagctgcagcttga

SEQ ID NO: 25365 - protein, 73 aa, Zea mays
  misc_feature: Ceres CLONE 1397147-F
  misc_feature (50)..(50): Xaa is any aa, unknown, or other
MSHRKFEHPRHGSLGFLPRKRSSRHRGKVKSFPRDDPKKPCHLTAFLGYXAGMTHIVREVEKPGFQLHKKGTW

SEQ ID NO: 25366 - DNA, 660 bp, Zea mays
  misc_feature: Ceres CLONE 1397148-F
  misc_feature: Encodes the peptide sequence at SEQ ID NO. 25367
  misc_feature (302)..(302): n is a, c, t, g, unknown, or other
  misc_feature (323)..(323): n is a, c, t, g, unknown, or other
  misc_feature (341)..(341): n is a, c, t, g, unknown, or other
  misc_feature (353)..(353): n is a, c, t, g, unknown, or other
  misc_feature (409)..(409): n is a, c, t, g, unknown, or other
  misc_feature (458)..(458): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (497)..(497): n is a, c, t, g, unknown, or other
  misc_feature (511)..(511): n is a, c, t, g, unknown, or other
  misc_feature (579)..(579): n is a, c, t, g, unknown, or other
  misc_feature (590)..(590): n is a, c, t, g, unknown, or other
  misc_feature (605)..(605): n is a, c, t, g, unknown, or other
aaagctggagctccccgcggtggcggccgctctagaactagtggatcccccgggctgcaggaattcgcacgagaccattacctagaacatcctaatcgaaaagaaataaaggactatctcagcgatttccgaaccctccccacccccacacccacccgatccaaccgagtcccggcggcgatggcggcggcggcgacgaacgccgatgtggaggtggtcgacttcgacctcgatgacgacgacctcatggacgaggacgccgggccggatccagcaccgccccccgcctcccgcctccgctncaaccatcgcggggcgacgancgcgccgcgtaggaccanagggccgcggcnttccgcgaggaccctaactcctccgcgacccgcgactcgcggtttttgggcgcggnggggacgcgccgaacctcgactcgcttgggcggccctggacccatccgntcaattggaagggatggaaattgtgttgnnntcacaggnagttcacgaagaangctcaagaagatgaccttcaaaatgctttccaagaaatttgggcaggtcaaaaacctggcatttgaanttggccgccgntaccggatttggtcnaggggtaccgctttgatgaataacgagaagtttgaagaagctcggctgaataaaa

SEQ ID NO: 25367 - protein, 114 aa, Zea mays
  misc_feature: Ceres CLONE 1397148-F
  misc_feature (41)..(41): Xaa is any aa, unknown, or other
  misc_feature (48)..(48): Xaa is any aa, unknown, or other
  misc_feature (54)..(54): Xaa is any aa, unknown, or other
  misc_feature (58)..(58): Xaa is any aa, unknown, or other
  misc_feature (77)..(77): Xaa is any aa, unknown, or other
  misc_feature (93)..(93): Xaa is any aa, unknown, or other
  misc_feature (103)..(103): Xaa is any aa, unknown, or other
  misc_feature (106)..(106): Xaa is any aa, unknown, or other
  misc_feature (111)..(111): Xaa is any aa, unknown, or other
MAAAATNADVEVVDFDLDDDDLMDEDAGPDPAPPPASRLRXNHRGATXAPRRTXGPRXSARTLTPPRPATRGFWARXGRAEPRLAWAALDPSXQLEGMEIVLXSQXVHEEXSRR

SEQ ID NO: 25368 - DNA, 628 bp, Zea mays
  misc_feature: Ceres CLONE 1397152-F
  misc_feature: Encodes the peptide sequence at SEQ ID NO. 25369
  misc_feature (390)..(390): n is a, c, t, g, unknown, or other
  misc_feature (505)..(505): n is a, c, t, g, unknown, or other
  misc_feature (531)..(531): n is a, c, t, g, unknown, or other
aaactggagctccccgcggtggcggccgctctagaactagtggatcccccgggctgcaggaattcgcacgagaccattacctagaacatcctaatcgaaaatgcggtctgcctctgcccttaccgctacgctttcctcccggattccagcagcgaaacacgcgcggggcaaggacggagctggtaagccgatcgagccggcgagggtggacaagatgatgatggccgaggtggccgccaaccacagcaaaaggagccacaacgacggctacttcagtgccaaagccgccgccgccgccgccgcgagcccagagggagtgggaagcatgtccatgtcctcgaagaagccgaggaaatagcacagcccgagaaccgcgcccgtatcgcccanggagaagaaggacagggatcgcgagagagtcgcggcgctccagcagctagtgtccgcgttcgggaaaacagacacgggtttccgtctggaggaggggtcggggtacatcaggttnctgcaccagaaagtccaggcctccantcccccttaatggggggtcctccgggtgccggcccccccctgaggataccaagattaaaacctccgaacccgggtttggcctggggcccgggaacca

SEQ ID NO: 25369 - protein, 47 aa, Zea mays
  misc_feature: Ceres CLONE 1397152-F
MMMAEVAANHSKRSHNDGYFSAKAAAAAAASPEGVGSMSMSSKKPRK

SEQ ID NO: 25370 - DNA, 661 bp, Zea mays
  misc_feature: Ceres CLONE 1397154-F
  misc_feature: Encodes the peptide sequence at SEQ ID NO. 25371
aagctggagctccccgcggtggcggccgctctagaactagtggatcccccgggctgcaggaattcgcacgagaccattacctagaacatcctaatcgaaaaacaaacacctccgatccgtccccgatcatcgcaccacctgtagcccacctcgctctcgagtctcgacccagcgacgagatggccgcggtggatctgaccccaaggacgcccaagaaggcctacggcggcgacggcggcgcctactacgagtggagccccgccgacctgcctatgctcgccgtcgcctccatcggcgccgccaagctctcgctcgccgccggcggcctctccctccccagctactccgactccgccaaggtcgcctacgtcctacaaggcgtcggtacctgcggcctcgtcctccccgaggcgacgaaggagaaggtggtggcggtgaaggagggcgacgcgctggcgctgcccttcggcgcggtgacgtggtggcacaacggacccgccgcgcaggccgacctcacggaggtcttcctcggcgacacctccaagggccacaagcggggggatttcacaaccttccagctcacggggtccgggggcatcttcacggggctgtccaccgagttcgtgtcgcgcgcgtgggatctggcggaaccccaccccgc

SEQ ID NO: 25371 - protein, 160 aa, Zea mays
  misc_feature: Ceres CLONE 1397154-F
  misc_feature (6)..(159): Pfam Name: Cupin_1 Pfam Description: Cupin
MAAVDLTPRTPKKAYGGDGGAYYEWSPADLPMLAVASIGAAKLSLAAGGLSLPSYSDSAKVAYVLQGVGTCGLVLPEATKEKVVAVKEGDALALPFGAVTWWHNGPAAQADLTEVFLGDTSKGHKRGDFTTFQLTGSGGIFTGLSTEFVSRAWDLAEPHP

SEQ ID NO: 25372 - DNA, 641 bp, Zea mays
  misc_feature: Ceres CLONE 1397156-F
  misc_feature: Encodes the peptide sequence at SEQ ID NO. 25373
  misc_feature (544)..(544): n is a, c, t, g, unknown, or other
  misc_feature (550)..(550): n is a, c, t, g, unknown, or other
  misc_feature (551)..(551): n is a, c, t, g, unknown, or other
aagctggagctccccgcggtggcggccgctctagaactagtggatcccccgggctgcaggaattcgcacgagaccattacctagaacatcctaatcgaaaaaaaaagcagcagcagcagaccttcttgacctagcaagcaatggggccgccgttcctcgccgtcgccgtcatcgtcgccttcctggccgccgccgcgcaggccgccgaccccttcgccttcttcgactgggacgtctcctacatcaccgcctcccctctcggcgtcccgcagcaggtcatcgcagtcaacaagcagttcccaggccctatcatgaacgtcactaccaactacgatgtggtcgtcaatgtgctcaacagcttagacgagcccctgctcatcacttgggatgggatccagcagcgcaagaattgctggcaggatggggttctcagcaccacctgccccataccgccaggttggaactggacctacaacttccaggtcaaggaccagattggcagcttcttctacttcccaccccttggtatgagcgtgccccccgncggggnnttcgtaggtatcactgtcaacactcgcgcgggttcattctcggtcccattctacacgccccggatgtggacatcacgctccttcatcggg

SEQ ID NO: 25373 - protein, 167 aa, Zea mays
  misc_feature: Ceres CLONE 1397156-F
  misc_feature (31)..(148): Pfam Name: Cu-oxidase_3 Pfam Description: Multicopper oxidase
  misc_feature: SWISSPROT Homolog: EC 1.10.3.3 L-ascorbate oxidase
  misc_feature (135)..(135): Xaa is any aa, unknown, or other
  misc_feature (137)..(137): Xaa is any aa, unknown, or other
MGPPFLAVAVIVAFLAAAAQAADPFAFFDWDVSYITASPLGVPQQVIAVNKQFPGPIMNVTTNYDVVVNVLNSLDEPLLITWDGIQQRKNCWQDGVLSTTCPIPPGWNWTYNFQVKDQIGSFFYFPPLGMSVPPXGXFVGITVNTRAGSFSVPFYTPRMWTSRSFIG

SEQ ID NO: 25374 - DNA, 735 bp, Zea mays
  misc_feature: Ceres CLONE 1397160-F
  misc_feature: Translation starting site: 303
  misc_feature (635)..(635): n is a, c, t, g, unknown, or other
  misc_feature (638)..(638): n is a, c, t, g, unknown, or other
  misc_feature (651)..(651): n is a, c, t, g, unknown, or other
  misc_feature (654)..(654): n is a, c, t, g, unknown, or other
  misc_feature (655)..(655): n is a, c, t, g, unknown, or other
  misc_feature (659)..(659): n is a, c, t, g, unknown, or other
  misc_feature (660)..(660): n is a, c, t, g, unknown, or other
  misc_feature (667)..(667): n is a, c, t, g, unknown, or other
  misc_feature (710)..(710): n is a, c, t, g, unknown, or other
aagctggagctccccgcggtggcggccgctctagaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgcctgccgccagcatctccaccgcttgccgaggcgtcaggatctccgtcgccagcgcccgcgccgtcgccatcctcagctcgtcggcctccaccagcagccgcgacagcgcgggcttgtagctgtccagcgccgcgtccacctcggcgtcccgcggtcctagccgggncgncctgaggccgcgncgnngcgnnacgtcgnagtttccgctggcagcagctgcagctcccaaccgtgccgcggnagcgagctcgcgctgccgcacgatg

SEQ ID NO: 25375 - DNA, 793 bp, Zea mays
  misc_feature: Ceres CLONE 1397164-F
  misc_feature: Translation starting site: 226
  misc_feature: SWISSPROT Homolog: EC 2.3.1.88 Peptide alpha-N-acetyltransferase
  misc_feature (27)..(27): n is a, c, t, g, unknown, or other
cctcccaccactctttgctggcccctnccccccccaccccacactgggactccccgcggtggcggccgctctatcctagtggatcccccgggctgcaggaattcgcacgagaccattacctagaacatcctaatcgaaaaatccccatcggcacttatcgtcggagaaccacacactcccccgcatcgcagagacccgtcgaggtcagatttaggttgaggtaacatggggtgcctccggcaggcgaccatcgaagacctgctggcgatgcaggggtgcaacctgatgtgcctgccgcagaactacccgatgaattactacttctaccacgtgctctcgtggccgcagctcctcttcgtccccgaggactacggaggcaatagcgctcggctacgtgctcgccgagagggaggaggacccctccgagccctgccacggtgacgtcacctccctcgcgggactccgctcccaccgcaagttggatttcgccactaagctcatgtccgcagctcagtgcgccatggaccaggtcctccaaactgagtacgtgtttttccaggtcccgcgatccaacccgggctgccttcaacctctacaccttcgaccctcgggtcccagatccgagcacattcagctcaacccgtatgcccgaagggcgagaagcgattcctactgaccgaagttggtccgggcgggcccagcccaagaaggggccactagcgaggggaatcaagggcccccggtgggtggcctggctcccacccaagcccaccatggggaatcgaacgggttc

SEQ ID NO: 25376 - DNA, 737 bp, Zea mays
  misc_feature: Ceres CLONE 1397166-F
  misc_feature: Encodes the peptide sequence at SEQ ID NO. 25377
  misc_feature (331)..(331): n is a, c, t, g, unknown, or other
  misc_feature (451)..(451): n is a, c, t, g, unknown, or other
aagctggagctccccgcggtggcggccgctctagaactagtggatcccccgggctgcaggaattcgcacgagaccattacctagaacatcctaatcgaaaaaaacacacacgggcaatcaattagcagaacccgcgccaccccccttcctcggagtcggagcgagtcgaggaacggctcgtctgcctctcccgttctccttcctctcctccccagaagatccgatccatcatcgaggactcgccgggaagaatcaaggatatatagataatatacaaacaaaggttcctccagagcccagagcaggagggaagtcaccggccgtcggcggngaggagatgtcggacggcgcgggctcccggacgggcgtcgctggcgcgctgggcctctcggtcacctcgtcggtgggcatcgtcatctgcaacaagtacctcatcagcactctaggcttncttcttcgcgacgacgctgacgagctggcacctcatggtgacctttcttcacgctgtacgttgcgcagcggttgggtttcttcgagcaaaagccgatcgaaggggcgaaccgttattctccttcgggctggtcaaagggatctcccttgggcccctcaacctctggcctcggggtaaattgggtgggttcaaaccaaagaccaggggggccatttaacccttcccaaaagctggggaaccccttttctgggagaaaaaattaaaaaaataagggccccccctgggg

SEQ ID NO: 25377 - protein, 96 aa, Zea mays
  misc_feature: Ceres CLONE 1397166-F
  misc_feature (38)..(38): Xaa is any aa, unknown, or other
MSDGAGSRTGVAGALGLSVTSSVGIVICNKYLISTLGXLLRDDADELAPHGDLSSRCTLRSGWVSSSKSRSKGRTVILLRAGQRDLPWAPQPLASG

SEQ ID NO: 25378 - DNA, 660 bp, Zea mays
  misc_feature: Ceres CLONE 1397173-F
  misc_feature: Encodes the peptide sequence at SEQ ID NO. 25379
aaactggagctcaccgcggtggcggccgctctagaactagtggatcccccgggctgcaggaattcgcacgagaccattacctagaacatcctaatcgaaaaacctcccaaactaccattcccagttcccacggcacgatggcctccgccgaaatccccaactccagccccgacgccaccaaccccgcccccgccgccgccgccgccaccggccccgacctctcctcttcgccgccgccgctcccgccgcgcaagcgccgcctttcgccttccccaccaccaacgcggtccgcgtcacgctctcggtccccccgctcccgctccccgcacggccgacgctcgcgcagccggagccgcagcccgcagcagtacccgaccgatggcaagcggcaacggcacaatggccttaccgtggatgcgtgccgcgatttcctgcgcgacaggtgcacccgctccgacctcgagtgcagatacgcgcaccctcacaactccgtttccatcgacctggacaataaggtgactgcgtgtgcggattctctgaggaacaattgcttccgggggatgacttgccgttactaccatccgcctccacatatccaggagcaattactgagatcaagtggcggggaaaaacccaagggggaggacgcagatctgcaga

SEQ ID NO: 25379 - protein, 174 aa, Zea mays
  misc_feature: Ceres CLONE 1397173-F
MASAEIPNSSPDATNPAPAAAAATGPDLSSSPPPLPPRKRRLSPSPPPTRSASRSRSPRSRSPHGRRSRSRSRSPQQYPTDGKRQRHNGLTVDACRDFLRDRCTRSDLECRYAHPHNSVSIDLDNKVTACADSLRNNCFRGMTCRYYHPPPHIQEQLLRSSGGEKPKGEDADLQ

SEQ ID NO: 25380 - DNA, 769 bp, Zea mays
  misc_feature: Ceres CLONE 1397178-F
  misc_feature: Encodes the peptide sequence at SEQ ID NO. 25381
  misc_feature (533)..(533): n is a, c, t, g, unknown, or other
aagctggagctccccgcggtggcggccgctctataactagtggatcccccgggctgcaggaattcgcacgagaccattacctagaacatcctaatcgaaaaaacagcagcagaagcaaaagccgcaggccgcaactactccgatctgagtatcacagtcacagctaatagctagccagcagcccagcacccagcaactacccgtacgtacgaacgtgcgcttccgatggcgaccacggtgatggcctccgcgaccgcgagctcccccgccttctccgcccccggcgcgcgcgccaggcgcgccgcccggcttccggcggggttccgcggccgtgtcgccgcgccgccgcgccgcctcgcgctgctcgccagggcctcccagcaggccgatgacgctgccgccgacacgagcgcgagcgcggcgccggatgctcggaagctggggctctgggacgccgctggcggtccagcggggcccgcgccggagcggaatcaaaaccccgggctggccgaaggggggggcaccccatatcntggggttttgcccgccagaggccaccccggggggaaagggaatcttctttcgaggatcggaaaaaaggagccccccctcttctgggggtttagtggggaacccgccgggtttttcccctagcccccccggttctcctgtgtggcccccccttcctctcagaggaagataccccccaggggagaaagaagtggtgcatttttatatcagagcgcccaggaggacacattattttgaa

SEQ ID NO: 25381 - protein, 142 aa, Zea mays
  misc_feature: Ceres CLONE 1397178-F
  misc_feature (103)..(103): Xaa is any aa, unknown, or other
MATTVMASATASSPAFSAPGARARRAARLPAGFRGRVAAPPRRLALLARASQQADDAAADTSASAAPDARKLGLWDAAGGPAGPAPERNQNPGLAEGGGTPYXGVLPARGHPGGKGNLLSRIGKKEPPLFWGFSGEPAGFFP

SEQ ID NO: 25382 - DNA, 653 bp, Zea mays
  misc_feature: Ceres CLONE 1397179-F
  misc_feature: Encodes the peptide sequence at SEQ ID NO. 25383
  misc_feature (371)..(371): n is a, c, t, g, unknown, or other
  misc_feature (382)..(382): n is a, c, t, g, unknown, or other
tggagctccccgcggtggcggccgctctagaactagtggatcccccgggctgcaggaattcgcacgagaccattacctagaacatcctaatcgaaaaaatgcggcgcctccactttgcgatgcccgcgtcctcgctcccctccccatcctcctcatctaccgtgctctccattccccacccgctcccaccgccgctcgcagatgccgcccaaggtggtcgccgtcgccgcgggcgaggcccacacactcgccctcacgggtgacgggcaggtgtactcctggggcagggggccgttcggtcgcctcgggaacggccgcgaggacgacaagctggtccccaccgcgggggcgcccgcggtctctgccagcgngacaccgcggnccaggtttcgtcgcccgtcgcggttggtgcctaccacagccttgcgctgggacggatgaaggttcactctgggtcatgggggttacaaatctctatggtcaacttgggctatgggggaccagaatccctttttttccatgttttcggtgagcaatttcaggggatttaaggcttctccctggaacactggaagggatgaagacaagaacacacgggggccggcacttgggttggaaggtgtctttctgggcacagctggggggcatggatg

SEQ ID NO: 25383 - protein, 79 aa, Zea mays
  misc_feature: Ceres CLONE 1397179-F
  misc_feature: SWISSPROT Homolog: EC 2.7.11.1 Non-specific serine/threonine protein kinase
  misc_feature (57)..(57): Xaa is any aa, unknown, or other
  misc_feature (61)..(61): Xaa is any aa, unknown, or other
MPPKVVAVAAGEAHTLALTGDGQVYSWGRGPFGRLGNGREDDKLVPTAGAPAVSASXTPRXRFRRPSRLVPTTALRWDG

SEQ ID NO: 25384 - DNA, 659 bp, Zea mays
  misc_feature: Ceres CLONE 1397181-F
  misc_feature (202)..(202): n is a, c, t, g, unknown, or other
  misc_feature (205)..(205): n is a, c, t, g, unknown, or other
  misc_feature (222)..(222): n is a, c, t, g, unknown, or other
  misc_feature (230)..(230): n is a, c, t, g, unknown, or other
  misc_feature (233)..(233): n is a, c, t, g, unknown, or other
  misc_feature (357)..(357): n is a, c, t, g, unknown, or other
aaagctggagctccccgcggtggcggccgctctagaactagtggatcccccgggctgcaggaattcgcacgagaccattacctagaacatcctaatcgaaaattccgatccgatccccggccggccacctaccaccggtcagccccatcaatctctgaggcagcgtcagccatcacgcctccctcatcgatctccccgccgncgncgctgctaatacagatnatggaggncgncgccgccgctgctgccactgccatctaccctctggcacgatgcaaaaccatacacctggtgaggcatggccaagtggtcaccacggggaaagggaaccgggatccaggggcccacattgaaaancgaattttttgaaaggaggattacttcccttgggcttggaccccggtttacctccccggaaaaaattggaaaggaaattcggcctttcaaaaaaaatggaacggggatttgggcccccttttgcagggaccctgggaacgggggggggggttttttgggggaaaaaggccgaaaaggggggggggggggccccccccggggtggggaaaagttgggcaccccccccatttttaaagttggaaaggccccccctttttttttttttaaagccccctcaggaagcctttttgggggcccctttt

SEQ ID NO: 25385 - DNA, 693 bp, Zea mays
  misc_feature: Ceres CLONE 1397182-F
  misc_feature: Encodes the peptide sequence at SEQ ID NO. 25386
gctctagatctagtggatcccccgggctgcaggaattcgcacgagaccattacctagaacatcctaatcgaaaaatttcgagtggtcgagtccgtccgtgtctgtcctccgctgtccgctggctgctgctctaacccaatccaaggaggatgccgaggagcccgcagctgagcctgagcggctgcagctctctcttctccctgtccagcaccagtacgagccgcgacagcgccgccctgaaggcgccggtgccagcgccaccggcaggcgcggtgcccccacggcgcacccctctcctgtcgctcagcgtcggcgaggaggaagaggacgagggtgaggacgaggaggagtacctgctgggggccggcgccctggatctgcagctgacggggcccggtggcggcagcaacagcagcggcggctacgacgacgagcggaagaacatccggatgatgaggaacagggagtctgcgctgcgctccagggcaaggaagagggcctatgtgcaggagctggagaaggaggttcgtcgcctggtgaatgagaacctcaagctcaagaggcagtgcaaacaactgaaactagatatggctgcactggtccagcaaagcagcagcaagagcagctcccacatcagaagaacctcctcatccactcagctctaggctgctaccaataggaatatgtatgtga

SEQ ID NO: 25386 - protein, 171 aa, Zea mays
  misc_feature: Ceres CLONE 1397182-F
  misc_feature (92)..(155): Pfam Name: bZIP_1 Pfam Description: bZIP transcription factor
MPRSPQLSLSGCSSLFSLSSTSTSRDSAALKAPVPAPPAGAVPPRRTPLLSLSVGEEEEDEGEDEEEYLLGAGALDLQLTGPGGGSNSSGGYDDERKNIRMMRNRESALRSRARKRAYVQELEKEVRRLVNENLKLKRQCKQLKLDMAALVQQSSSKSSSHIRRTSSSTQL

SEQ ID NO: 25387 - DNA, 2007 bp, Zea mays
  misc_feature: Ceres CLONE 1397184
  misc_feature: Encodes the peptide sequence at SEQ ID NO. 25388
gtgacctgggagtgggagggttggtgcctataggatcgtcatggacaccatcgaggagtgcggcgacggaggccgccacctgctgctgggcctcggcaccaggatactcgtcggcgtgccggacaactcccgcggctgctccgagctgctgtcgtgggcgatcggcgccgtcgccaagcccagcgactccgtcgtcgccgtgcacgtcctcggagggagggggaggaagcggaggctgcagaaggccaacgccttcgtcatctacatgctcggcgaattcgtcgaagcttgtgaggccaagcagattaatttggaggccaaggtgatatgcagctcaaacattgggagagccctgacccaagaagctgcactgactgatgggaacatcctcattgttgggagatcaagaaatgcgtaccataggagccattttgagattgcaaactactgcttcatgcatgctccaaaaaactgctcggtgatcgctgttggaaggcaaggcgtagcacagagtagtactcggttgagacctcggtcatttgatgatagcaccatctcctcaagctcaacatggagcaggagattcccgccgcttcagaagctgctcagaacaaactcgacacggaagctggctcagtccgacgacaagagctcgccgagagcagttctggacggcccagagggagagggaggggagaaccaagagtgctacagcacgtctagccatgatgtgagccggcgcggccacaacggcctgtggagacggctgtcagacatgaagctctggctcccgttcctgaggaacatcggcgatgacagcaccaggggcagcgacgtcggttcggccttcgctgaagatcacaagcctgcctggaggtgcttcagcttccaggagatttcagtggccactaatgacttccacccagacaacatggctggaagaggaggctatgcagaagtatacaagggcaccctagctgacggctatcttgtagccgtgaagaggctagcaaaaggcacccccagcgagcagaaggaaaaggagttcctggcagagctagggatccaggggcatgtatgccatccaaacacatcctaccttcttggatgctgcgtggagaatgggctgtacttgatattcgagttctgcacgaatggcaccctagcatcggcactgcatgggaagggtgggagaacccttgaatggcctctgaggtacaagatcgcggtgggcgttgcgaggggcctgcagtacctgcacatgttctgcaggcaccggatcatccaccgcgacatcaaggcgtccaatgtgcttctcggccatgacttcgaacctcagatttcggacttcggattggccaagtggctcccaaagcagtggactcaccattctgtcgtacccatagaaggcacgttcgggtacttagcaccagaatacttcatgcacggcattgtcgacgaaaagacggacatctttgcctttggcgtgctgctgctggagatcgtcaccggaaggagacccattgactgctccaagcaaagccttctacaatgggcaaagccgctgctggaagctgggcaggtgactgagcttgcagatccaagcctcggggacgactacgacaaagatcagctgaacaggatggtcgcggtcgcatcccgctgcatcatgcgaccggcgatgtggcggccttcgatggccgaggttctgcatttcctgtctactactgatgagtgtctgaacgagcccgagaaatggaacattcccgacgacgaggtggacgacatggatgattgtacactgttctctgaatccttttccatgtgattgtagcctcatttttttcccatttccttttagtgtgtgctatgttggcatgccgttcttggcatgggatggaggcattgagctatgttttttttttgtagtcttagatgactggtatttaatcatgcgatatatatatgacggggattttgggatgtaataaaaaaaaaaaaaaaaaa

SEQ ID NO: 25388 - protein, 595 aa, Zea mays
  misc_feature: Ceres CLONE 1397184
  misc_feature (293)..(560): Pfam Name: Pkinase Pfam Description: Protein kinase domain
  misc_feature (19)..(151): Pfam Name: Usp Pfam Description: Universal stress protein family
  misc_feature: SWISSPROT Homolog: EC 2.7.11.1 Non-specific serine/threonine protein kinase
MDTIEECGDGGRHLLLGLGTRILVGVPDNSRGCSELLSWAIGAVAKPSDSVVAVHVLGGRGRKRRLQKANAFVIYMLGEFVEACEAKQINLEAKVICSSNIGRALTQEAALTDGNILIVGRSRNAYHRSHFEIANYCFMHAPKNCSVIAVGRQGVAQSSTRLRPRSFDDSTISSSSTWSRRFPPLQKLLRTNSTRKLAQSDDKSSPRAVLDGPEGEGGENQECYSTSSHDVSRRGHNGLWRRLSDMKLWLPFLRNIGDDSTRGSDVGSAFAEDHKPAWRCFSFQEISVATNDFHPDNMAGRGGYAEVYKGTLADGYLVAVKRLAKGTPSEQKEKEFLAELGIQGHVCHPNTSYLLGCCVENGLYLIFEFCTNGTLASALHGKGGRTLEWPLRYKIAVGVARGLQYLHMFCRHRIIHRDIKASNVLLGHDFEPQISDFGLAKWLPKQWTHHSVVPIEGTFGYLAPEYFMHGIVDEKTDIFAFGVLLLEIVTGRRPIDCSKQSLLQWAKPLLEAGQVTELADPSLGDDYDKDQLNRMVAVASRCIMRPAMWRPSMAEVLHFLSTTDECLNEPEKWNIPDDEVDDMDDCTLFSESFSM

SEQ ID NO: 25389 - DNA, 634 bp, Zea mays
  misc_feature: Ceres CLONE 1397189-F
  misc_feature: Encodes the peptide sequence at SEQ ID NO. 25390
aagctggagctccccgcggtggcggccgctctatatcagtggatcccccgggctgcaggaattcgcacgagaccattacctagaacatcctaatcaaaaaccgaaccaaacaacacacgtcaaagcggaaaacctcagaaaaccacaataaatcatcctcgtccaccactgcccccgctctgctgcaactccactcgggccggccgccctttccacccaccttgatcctctgatccgttggtgcttgaccgatccatggacacccatatcggatccgtgaacggggcggcgtctaaccagacggttggctgcccggcgtcggcgccggggtgcccgatggcgtccacgccggcgcagcccgcggcgaccctgtcggcgggggaggcgtcgctggggagccacctcgcgcgtcgcctcgtgcaggtcggcgacgacgatgtattcgcggatccgggggactatcacctcacgctgctcgaccacctgatcgccgagccccgcctgcgcctcctcggatgctggaacgagctcaacgccgggtacgccgccgacgggtacgcgcgcgcgcgaggggccagggtctgcgccgccagggtcacagtcgggggaatcagcgggctcacgccaatcgtgc

SEQ ID NO: 25390 - protein, 126 aa, Zea mays
  misc_feature: Ceres CLONE 1397189-F
  misc_feature (44)..(126): Pfam Name: TPP_enzyme_N Pfam Description: Thiamine pyrophosphate enzyme, N-terminal TPP binding domain
  misc_feature: SWISSPROT Homolog: EC 4.1.1.1 Pyruvate decarboxylase
MDTHIGSVNGAASNQTVGCPASAPGCPMASTPAQPAATLSAGEASLGSHLARRLVQVGDDDVFADPGDYHLTLLDHLIAEPRLRLLGCWNELNAGYAADGYARARGARVCAARVTVGGISGLTPIV

SEQ ID NO: 25391 - DNA, 649 bp, Zea mays
  misc_feature: Ceres CLONE 1397191-F
tggagctccccgcggtggcggccgctctagaactagtggatcccccgggctgcaggaattcgcacgagaccattacctagaacatcctaatcgaaaaagacaaatcgacgatcgccgcttctcttggccattgtagagggagagagagagcgcgagcgacctaggtcagtcggtttcggttttgggcgcagcttcagtatccgcgaccgcgagatggttctgcgcgtgccgccaccgcgcagctccgccggcgggggcgtgttcgaaagggcgccccggggagtgacccggcaccgggggtggttgtccgggggaagaacacctttcccgggggggggtcggcggggccccggaggccccccccctttggcgggggggccccgggggcaaggggctggggcttagaaactccaaagaggggggggggttttcctcgggggggggccgggaaaatttttttttcctttaaccaaaaaggggccccccccccgggccattttgggggggggtagggcttcccccccgggcgctggggccccggtaaaaaacggggcggaaaaaagggggtacccccccccccggggttatgctgccgaccccttaacgaccccccttccagaggaatccagtttttagaaggggggggggg

SEQ ID NO: 25392 - DNA, 826 bp, Zea mays
  misc_feature: Ceres CLONE 1397196-F
  misc_feature: Encodes the peptide sequence at SEQ ID NO. 25393
  misc_feature (672)..(672): n is a, c, t, g, unknown, or other
  misc_feature (763)..(763): n is a, c, t, g, unknown, or other
acgccccccccccccccccacccccacctacgattgccccccccccaaactggtgctccccgcgggggcgggcgctctataactagtggatcccccgggctgcaggaattcgcacgagaccattacctagaacatcctaatcgaaaaactgccgcgccgccaccctctacagataaggaagaggaggagggcaggatgtcgcaccgtaagttcgagcacccgaggcacggctccctcggtttccttcccaggaagcgctcctcccgtgcaccgcggcaaggagaagtcattccctagggatgaccccaagaagccttgccatctcactgacttccttgtctacaagggtggcatgactcacattgtccgcgaggttgagaagccaggatccacactccataagaaggatacttgtgaggctgttaccatcattggaaacccctcctcttggccatgttggggccccgggatatgggaaaaactccccggggcactcccccacatccactcgggtttgggccccaatttccttatcccagaaaggggggagaagggtctaaaaagaactgggtgcccagaggcagaagaaagggtttacaaaaggaagcccccccaatatggaaaaaggaagcccggaaaagaagcaaaattcacctcgccacttggagaaanagaaagaaaaaaaggggttggggtattcgggggtttttggcattacccccaattacgaaaaacagaaggcttttggaaaaaaaaaaaaagnctcacccgggagggacacttcgcgtccaaaggcgggtccacattgtggaaacgcgggagatta

SEQ ID NO: 25393 - protein, 158 aa, Zea mays
  misc_feature: Ceres CLONE 1397196-F
  misc_feature (107)..(107): Xaa is any aa, unknown, or other
  misc_feature (137)..(137): Xaa is any aa, unknown, or other
MTHIVREVEKPGSTLHKKDTCEAVTIIGNPSSWPCWGPGIWEKLPGALPHIHSGLGPNFLIPERGEKGLKRTGCPEAEERVYKRKPPQYGKRKPGKEAKFTSPLGEXERKKGVGVFGGFWHYPQLRKTEGFWKKKKXLTREGHFASKGGSTLWKRGRL

SEQ ID NO: 25394 - DNA, 633 bp, Zea mays
  misc_feature: Ceres CLONE 1397197-F
  misc_feature: Encodes the peptide sequence at SEQ ID NO. 25395
  misc_feature (236)..(236): n is a, c, t, g, unknown, or other
ggagctccccgcggtggcggccgctctagaactagtggatcccccgggctgcaggaattcgcacgagaccattacctagaacatcctaatcgaaaaatcacactcgcgaaccccgtcatcgatctcgtttcaaatccatccatcctcgtttcctccgtcccgcagcatctcaaccccatggccaagatcaagatcgggatcaatgggttcggcaggatcggaaggctggtggccanggtggccctgcagagtgacgatgtcgagctcgtcgccgtgaacgaccccttcatcagcaccgactacatgacctacatgttcaagtacgacactgtgcacggacagtgaaagcaccatgaagtcaaggtgaaggactccaaaacccttctctttggtgagaaggaggttgctgtgtttggctgcaggacccctgaggagatcccgtgggggttcggttggtgctgaatatgttgttgagtctactggtgttttcactggacagggagaagctgcagctcacttgaagggtggtgcccaagagggttgtcatctcctgctctagcaaggatgcccccatggttgtcgttggtgtcaccgagaaggagtaccagtctgacataacattgtctccaatgt

SEQ ID NO: 25395 - protein, 55 aa, Zea mays
  misc_feature: Ceres CLONE 1397197-F
  misc_feature (4)..(56): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
  misc_feature (20)..(20): Xaa is any aa, unknown, or other
MAKIKIGINGFGRIGRLVAXVALQSDDVELVAVNDPFISTDYMTYMFKYDTVHGQ

SEQ ID NO: 25396 - DNA, 649 bp, Zea mays
  misc_feature: Ceres CLONE 1397205-F
  misc_feature: Encodes the peptide sequence at SEQ ID NO. 25397
  misc_feature (213)..(213): n is a, c, t, g, unknown, or other
  misc_feature (222)..(222): n is a, c, t, g, unknown, or other
  misc_feature (223)..(223): n is a, c, t, g, unknown, or other
  misc_feature (295)..(295): n is a, c, t, g, unknown, or other
  misc_feature (327)..(327): n is a, c, t, g, unknown, or other
  misc_feature (328)..(328): n is a, c, t, g, unknown, or other
  misc_feature (449)..(449): n is a, c, t, g, unknown, or other
  misc_feature (450)..(450): n is a, c, t, g, unknown, or other
  misc_feature (485)..(485): n is a, c, t, g, unknown, or other
aaagctggagctccccgcggtggcggccgctctagaactagtggatcccccgggctgcaggaattcgcacgagaccattacctagaacatcctaatcgaaaagaggactcagcgggctccaaagccgacgaggataaagaggagcccggctccgcacgcgggagcgagaggatcgccggcgcaggatgtggtgcgcatcgtgcttggcgtccngctgcgcgnnctgcacctgcaacctctgcacgtcggcggcatcgggcgtgtcccggcgctccgcgcgcctcggttactgcgncctcttcgccgcctcccttatcctctccttcnntgctcgcagttcggcgcgccgctcctcaagcatatcccatggataaatggcgtgtggatcaacaccaccagaaagatggtttcaaatgaatgctgttcttcgtgtaagcctggggaacttnnctggtcttgcaaaattttctctcgggatgattgtngggaagaccagaatgaccgggggatgcctggcaccatggtggctggattgcaagattgctggatgggctgtccccatgggcctaaagggcggggggcgaacattgcattactattaagagggactttcccaaaggtgggactgggttctttcttaaggaagggg

SEQ ID NO: 25397 - protein, 62 aa, Zea mays
  misc_feature: Ceres CLONE 1397205-F
  misc_feature (10)..(10): Xaa is any aa, unknown, or other
  misc_feature (13)..(13): Xaa is any aa, unknown, or other
  misc_feature (37)..(37): Xaa is any aa, unknown, or other
  misc_feature (48)..(48): Xaa is any aa, unknown, or other
MWCASCLASXCAXCTCNLCTSAASGVSRRSARLGYCXLFAASLILSFXARSSARRSSSISHG

SEQ ID NO: 25398 - DNA, 627 bp, Zea mays
  misc_feature: Ceres CLONE 1397206-F
  misc_feature: Translation starting site: 516
tggagctccccgcggtggcggccgctctagaactagtggatcccccgggctgcaggaattcgcacgagaccattacctagaacatcctaatcgaaaaattaattaacaaagagaagacttcttccttcctcgtcgtctccagcccattccaattcttgattccatcgccccaccatccacaactcccctaatccttccaacctcctcgtcgtccagtccaccacctccacgcgcaatggccagcggctaggcggcaccaaccagatcacaaggattcgtttcatccggcagcgcagctctagagcctccatgggcagctacgcgtacaagtactgtatgtgcttcacgcgcaagttccgatccccggacgcccagccggcggccggaggtccgcgccgcccacctctccttcggctctgacgcccatgccctcccgcgcttcgtcgccggggtccagggcgagtcccccggcgacgtcgaccgcatcctcgccatgctctccgggggccacagccatgggatcgcccgcctcgtcacagggtcggcgggggaatccacgcccacggtcgaaagacttcttcgccttcctcttctcccccgacctcacccaacccatcggggaccagg

SEQ ID NO: 25399 - DNA, 627 bp, Zea mays
  misc_feature: Ceres CLONE 1397207-F
  misc_feature: Translation starting site: 176
  misc_feature: SWISSPROT Homolog: EC 1.2.1.3 Aldehyde dehydrogenase (NAD(+))
  misc_feature: SWISSPROT Homolog: EC 1.2.1.36 Retinal dehydrogenase
agagctggagctccccgcggtggcggccgctctagaactagtggatcccccgggctgcaggaattcgcacgagaccattacctagaacatcctaatcgaaaaactgcgcctgcggaggatcggaggaaccagtagcggaggcttcgattttcggctggcgcaataaatttcccgcatggctcggagggccgcgtcctcgctcgtctcccgctgcctcctggcgagggcccctgccggcgcgccgcccgctgccccctctgcgctgcgcaggacagtgcctgcagatgtgatgcacaggctgttgccaggtgtccttcagaggttcagcactgcagcagcagtagaggagcccatcacgccgtcagtccatgtgaactacggggggctcctcattaatggcaactttgttgattccgcatccggcaagaccttcccaactctggaccctcgtacagggaggtgattgctcatgtggctgagggtgacgcagaggacattaaccgtgcagtagctgcggctcgcaaggcttttgatgagggccatggccgaagatgactgcctatgagaggtcccgtatcctactgcggtttggtgatttgaaaaagaacacaatgacgagcttgctgt

SEQ ID NO: 25400 - DNA, 661 bp, Zea mays
  misc_feature: Ceres CLONE 1397210-F
  misc_feature: Encodes the peptide sequence at SEQ ID NO. 25401
  misc_feature (563)..(563): n is a, c, t, g, unknown, or other
aaagctggagctccccgcggtggcggccgctctagaactagtggatcccccgggctgcaggaattcgcacgagaccattacctagaacatcctaatcgaaaaatttatacccctccgtttcccacccttacctccccactccggcagtccccgtcccaccactacagccactgctgcccggccggccgcgtccctcttcctccgccaggcgccagccgcccgctctccagcaatggcgtctgcctcgcacgccccgacgccgctgctcaaggacgagctggacatcgtcatcccgacgatccgcaacctcgacttcctggagatgtggaggcccttcttccagccctaccacctcatcatcgtgcaggacggcgaccccagcaagaccatccgcgtccccgagggcttcgactacgagctctacaaccgcaacgacatcaaccgcatgctggggcccaaggcatcctgcatctccttcaaggactccgcctgccgctgcttcggctacatggtctccaagaaagagtacatctacaccatcgacgatgactgcttcgttgccnaggatccatcaaggaaggacaatcatgcacttgagcagcacatcaagaacctcctgagccctttcactccattttttcttcatactctgtatgaccct

SEQ ID NO: 25401 - protein, 143 aa, Zea mays
  misc_feature: Ceres CLONE 1397210-F
  misc_feature (7)..(143): Pfam Name: RGP Pfam Description: Reversibly glycosylated polypeptide
  misc_feature (111)..(111): Xaa is any aa, unknown, or other
MASASHAPTPLLKDELDIVIPTIRNLDFLEMWRPFFQPYHLIIVQDGDPSKTIRVPEGFDYELYNRNDINRMLGPKASCISFKDSACRCFGYMVSKKEYIYTIDDDCFVAXDPSRKDNHALEQHIKNLLSPFTPFFLHTLYDP

SEQ ID NO: 25402 - DNA, 617 bp, Zea mays
  misc_feature: Ceres CLONE 1397211-F
  misc_feature: Encodes the peptide sequence at SEQ ID NO. 25403
  misc_feature (358)..(358): n is a, c, t, g, unknown, or other
  misc_feature (359)..(359): n is a, c, t, g, unknown, or other
  misc_feature (368)..(368): n is a, c, t, g, unknown, or other
cgctcttcactagtggatcccccgggctgcaggaattcgcacgagaccattacctagaacatcctaatcgaaaaatctcccataatattttcagcattcaaaaacacaccaagcgaagcgcactagcaacgacctaacaccaatggctaccaagatattagccctccttgcgcttcttgcccttttagtgagcgcaacaaatgcgttcattattccacagtgctcacttgctcctagtgccagtattccacagttcctcccaccagttacttcaatgggcttcgaacatccagccgtgcaagcctacaggctacaactagcgcttgcggcgagcgccttacaacaaccaattgcccannatgcacacnatcccttgcacatctaccctacaaacattgcacgcacaacaacacacagttctgcatcactgagccactagcgtggtgaccctgcactacttgaaaagagttgctgcatcaacccactgctctggggaactattttgatacaagaaaaaaacagttggaaaagttatgcccggggtcaacaaataacctgggggaaacctggcgttaaccaaaaaaatttttttttaaacccccttccgggggggaaag

SEQ ID NO: 25403 - protein, 98 aa, Zea mays
  misc_feature: Ceres CLONE 1397211-F
  misc_feature (72)..(72): Xaa is any aa, unknown, or other
  misc_feature (73)..(73): Xaa is any aa, unknown, or other
  misc_feature (76)..(76): Xaa is any aa, unknown, or other
MATKILALLALLALLVSATNAFIIPQCSLAPSASIPQFLPPVTSMGFEHPAVQAYRLQLALAASALQQPIAXXAHXPLHIYPTNIARTTTHSSASLSH

SEQ ID NO: 25404 - DNA, 808 bp, Zea mays
  misc_feature: Ceres CLONE 1397212-F
  misc_feature: Encodes the peptide sequence at SEQ ID NO. 25405
  misc_feature (808)..(808): n is a, c, t, g, unknown, or other
ttgttgctccccccccctcttcctcctatctcccccctttctttaaaaaatatagcactcaccgcggaggcggacgatcttccatagtggatcccccgggctgcagtttttcgcacgagaccattacctagaacatcctaatcgaaaaatctgaactcttgattgatcgtgtctgtctgtgcaggctcaccaatatgggggccctggtgtgagagaaggtggtgcaccgccaccagggctggcgcctcctctccagcatgtggctccacgccggggtcatccacctggacggcaacatgctctgcctcctcttcatcggcatgcgcctcgaacagcagttcggatacgtgaggatcggcgcgatctacgtggtctccggagtgagcggcgccgtgctgtcgtctctgttcgtccggaaccgcgtcaccgtgggggcctccgatacggtcttgggcctgttgggcgccatgctctcggagctgctcaccaactgtaccatctacaccaaaaaggcggcggccgtgggcccacccttcctgtccgttggccgccgccaaacctggttggttggttccctggccccccgttcaaaaatttgggctccaaccccccggctttcctcccgggccttccttaactcgagtttcgtcttggctcaatgggccccccccctttggcccggaattggagcggcttaacgggaatttccctcaccgggggctgcccccagggaaccgaccggaagaaaaaaccctcccgcgtgaacgagtggggaaaccatctctctcagtctctagacgcatatccn

SEQ ID NO: 25405 - protein, 146 aa, Zea mays
  misc_feature: Ceres CLONE 1397212-F
  misc_feature (1)..(125): Pfam Name: Rhomboid Pfam Description: Rhomboid family
  misc_feature: SWISSPROT Homolog: EC 3.4.21.105 Rhomboid protease
MWLHAGVIHLDGNMLCLLFIGMRLEQQFGYVRIGAIYVVSGVSGAVLSSLFVRNRVTVGASDTVLGLLGAMLSELLTNCTIYTKKAAAVGPPFLSVGRRQTWLVGSLAPRSKIWAPTPRLSSRAFLNSSFVLAQWAPPLWPGIGAA

SEQ ID NO: 25406 - DNA, 698 bp, Zea mays
  misc_feature: Ceres CLONE 1397221-F
  misc_feature: Encodes the peptide sequence at SEQ ID NO. 25407
  misc_feature (411)..(411): n is a, c, t, g, unknown, or other
  misc_feature (457)..(457): n is a, c, t, g, unknown, or other
  misc_feature (472)..(472): n is a, c, t, g, unknown, or other
  misc_feature (491)..(491): n is a, c, t, g, unknown, or other
  misc_feature (519)..(519): n is a, c, t, g, unknown, or other
cgctctgaactagtggatcccccgggctgcaggaattccacgagaccattacctagaacatcctaatcgaaaaatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcnggcgaagacggcgacagcggcgtgaacgctacgtctccccctccgnaagggccaagtgccngccccattgccttgccccnccacgaggccagccgggggaaaaccaangattggatgagggggtgccccccccccgggactgggccttcaaaatggaacaaaaaataacggcccggaaaacaaaaacccgcccaaatgccccaaaaaaggggcaaaccccccccccccgcggaaacgggggggaaaaacaacccctttccttgtatgacttgaaaacccccggggag

SEQ ID NO: 25407 - protein, 131 aa, Zea mays
  misc_feature: Ceres CLONE 1397221-F
  misc_feature (92)..(92): Xaa is any aa, unknown, or other
  misc_feature (97)..(97): Xaa is any aa, unknown, or other
  misc_feature (103)..(103): Xaa is any aa, unknown, or other
  misc_feature (112)..(112): Xaa is any aa, unknown, or other
MGKGSVGASWWAFLLLAGVLLVVAATAGAEDGVVERDRKEDLRWCKQACEWQYGKDTPRKRECESECRERHQQADAGEDGDSGVNATSPPPXGPSAXPIALPXHEASRGKTXDWMRGCPPPGTGPSKWNKK

SEQ ID NO: 25408 - DNA, 753 bp, Zea mays
  misc_feature: Ceres CLONE 1397222-F
  misc_feature: Encodes the peptide sequence at SEQ ID NO. 25409
  misc_feature (529)..(529): n is a, c, t, g, unknown, or other
  misc_feature (732)..(732): n is a, c, t, g, unknown, or other
aagctggagctccccgcggtggcggccgctctagaactagtggatcccccgggctgcaggaattcgcacgagaccattacctagaacatcctaatcgaaaaacaaacaacaaatcactccgttgagccttcaccatcacctccctctctggctctctctctctctcacgcatacgaacacactctctactagtactaacctctcactaatctatatctagcagcaagcacacaccgtaacatcaaagccaacgacgacgcggggccggccgcccatggccttcacgtccttattgggcagcgacgcggagcggaaggtggcggtggcggaggtggcgctgcgggcggtgctgtgcgggctaggcgcgctggcggcggcgctggtggcgacggacacgcagacgcgcaccttcttctccctgcagaagaaggcgacctacacggacatgaaggccatggtgctcctggtggccgccgcggccacggccgccggctacagcctgctgcaggcggcgcgctgctgctgctgngtaggcctgctgcgcacgtccatccgcccccgcgcccgcctgctgctggccaggtgagacttcccgtgggaccacggcgctggcgtaggcgctgctgggcgaccgttaccgcccaagctgcaggtccccggtggtgccatagcaaggactgccccagataggagggaagggccatccggggcctcctacagaagccttatganagggagataagattccacgtt

SEQ ID NO: 25409 - protein, 103 aa, Zea mays
  misc_feature: Ceres CLONE 1397222-F
  misc_feature (85)..(85): Xaa is any aa, unknown, or other
MAFTSLLGSDAERKVAVAEVALRAVLCGLGALAAALVATDTQTRTFFSLQKKATYTDMKAMVLLVAAAATAAGYSLLQAARCCCXVGLLRTSIRPRARLLLAR

SEQ ID NO: 25410 - DNA, 622 bp, Zea mays
  misc_feature: Ceres CLONE 1397226-F
  misc_feature (427)..(427): n is a, c, t, g, unknown, or other
aaagctggagctccccgcggtggcggccgctctagaactagtggatcccccgggctgcaggaattcgcacgagaccattacctagaacatcctaatcgaaaactaggctttcagccgctctcctagtctcctactctcctctcagccgtcgccgtcgctctccacaccgctctcctctctcctccgagccgcagctcttctctctccctctcccctgcgtgccgccactgcgggcaccctgcacgccgccgctgcgtggccctacacgccaccgctacgggtgccctacgcgccgccgtcactgctccggctctcctctgtttcccaggcaatgccgccgctctaactccccaaggcatcgcccccgacgacggctcagcgaagccccgtcgaacgcctcgcggacgccctggggcgggaggagggncgctttacgctccatgggcagggcgcggtaggatgcctcaggtttcacagggcgccttagcgcctaggcgagcgctaaggcggcgctacggataagcatgctttttgagtaggatgtggaagagattaagctcatggggaaagattctaagactacaattgggaatcagggggtttgctttttctattttcccaa

SEQ ID NO: 25411 - DNA, 675 bp, Zea mays
  misc_feature: Ceres CLONE 1397232-F
  misc_feature: Encodes the peptide sequence at SEQ ID NO. 25412
gctctagtttccaagaatgccccgggctgcaggaatttccacgagaccattacctagaacatcctaatcgaaaattttctcgcgctcctaccttcgccgcttcgttctctaaccttggctcccgctccctccgcaggagcatctcaacaccgccttgagaaccccccaactcgccggctgcagccatggtaagatctccctcccccttactctctcgcctgttgcatcttcgctgccctgcagccatggatttggcgtcgcccttgcgaactcctgacgtgcaacgggccttgtttctggttccaggtgaaatattcgacggagccaaccaaccccaccaagtcaaccaaggccatgggccgtgacctacgtgttcacttcaagaacacccgtgagacagcttttgcccttaggaagttgtcactcaccaaggccaaaaggtaccttgaggatgtgattgcccacaagcaggccatcccgttccgcagctattgtggcggtgttggacgtaccgctcaggctaagtctcgtcactcaaatgggcagggacgctggcctgtcaaatctgctagattcattctagaccttctcaagaatgctgagagcaatgctgaggtaaaaggtcttgatgtcgataccctctatgtgtcacacattcaagtgaaccaggctcaa

SEQ ID NO: 25412 - protein, 107 aa, Zea mays
  misc_feature: Ceres CLONE 1397232-F
  misc_feature (1)..(107): Pfam Name: Ribosomal_L22 Pfam Description: Ribosomal protein L22p/L17e
MGRDLRVHFKNTRETAFALRKLSLTKAKRYLEDVIAHKQAIPFRSYCGGVGRTAQAKSRHSNGQGRWPVKSARFILDLLKNAESNAEVKGLDVDTLYVSHIQVNQAQ

SEQ ID NO: 25413 - DNA, 664 bp, Zea mays
  misc_feature: Ceres CLONE 1397233-F
  misc_feature: Encodes the peptide sequence at SEQ ID NO. 25414
  misc_feature (347)..(347): n is a, c, t, g, unknown, or other
  misc_feature (348)..(348): n is a, c, t, g, unknown, or other
  misc_feature (422)..(422): n is a, c, t, g, unknown, or other
  misc_feature (431)..(431): n is a, c, t, g, unknown, or other
  misc_feature (451)..(451): n is a, c, t, g, unknown, or other
  misc_feature (604)..(604): n is a, c, t, g, unknown, or other
aaagctggagctccccgcggtggcggccgctctagaactagtggatcccccgggctgcaggaattcgcacgagaccattacctagaacatcctaatcgaaaactccctctcgcattcatctccaccagcaggtcggacttcttgcgctccaagaactcggcgaggatggaaatgttttttggcagctttctcagtgaatcagtatcaccgcagaaccttttcggacacccagatgttgagagatgcccattcctgaggaatatcaatggagctacaaccttttccctcgcttctgctttgccagtagctgctcaagggaggcaagggtccaattttttgagggaagnnggtcaggctttgagtcagcattcaagcttttccatggccgagggatggaatagttccccttttcagaaagatcnatatgtatnctgatgaaaaccacaatggnaagcatttgatggtcaggactgaccctggctctggcgtttaattcccatgggctgctagagcagccacaataagtctatcagattggggaccccatttgggtttttgccttctttcacggcaagggcaaaaggcagaacaagaaaccaacaantctagatcagtcccaccagaagcccagacaacagatcagtcttcatgaaacaaaaagagt

SEQ ID NO: 25414 - protein, 88 aa, Zea mays
  misc_feature: Ceres CLONE 1397233-F
  misc_feature (61)..(61): Xaa is any aa, unknown, or other
  misc_feature (86)..(86): Xaa is any aa, unknown, or other
MEMFFGSFLSESVSPQNLFGHPDVERCPFLRNINGATTFSLASALPVAAQGRQGSNFLREXGQALSQHSSFSMAEGWNSSPFQKDXYV

SEQ ID NO: 25415 - DNA, 741 bp, Zea mays
  misc_feature: Ceres CLONE 1397239-F
  misc_feature: Encodes the peptide sequence at SEQ ID NO. 25416
  misc_feature (26)..(26): n is a, c, t, g, unknown, or other
  misc_feature (616)..(616): n is a, c, t, g, unknown, or other
  misc_feature (719)..(719): n is a, c, t, g, unknown, or other
  misc_feature (741)..(741): n is a, c, t, g, unknown, or other
aagctggagctccccgcggtggcggncgctctttcctagtggatcccccgggctgcaggtattcgcacgagaccattacctagaacatcctaatcgaaaaattcatgatctaggatccgtcgccgtcgagagctgaggcgaagcaacatagaagacgaggggggagtgcgactcctcgtgacttgtgagggagagaagccatggcggagatggagccgagcatcgggaaccatatggcggaagaccaaccgactccggccgcctccactgccgaggaggccgctatggatgcagataccagcggcgagcggcgtagcgctgccgcgttggtgggcctgctccgcgggttcctcgccgtgcaacagcgccgggccgaggcctactccacgctacgaagggggttttctgagtatatggcttatggaggtgaattggcctatcaacaactgtgtggcaatattacagcggagttcaatgattgctcaaaacaaaatttagtcgcagcgatcttgccgatttactgaagggtgttcaagcacatgagaaagagaagttgcatttgacagcgaagattcaggtgctgaagaaagccggcaggccttcagagcgcctggtngaccacgcggactgcaggtcgcgcagcatggcccagcacgtgtgcgtgcacgtcaaggagatcacggaggccgccggcaccgaggacgccgaggtggatgcgnagtatgacgcggccctcaggan

SEQ ID NO: 25416 - protein, 107 aa, Zea mays
  misc_feature: Ceres CLONE 1397239-F
MAEMEPSIGNHMAEDQPTPAASTAEEAAMDADTSGERRSAAALVGLLRGFLAVQQRRAEAYSTLRRGFSEYMAYGGELAYQQLCGNITAEFNDCSKQNLVAAILPIY

SEQ ID NO: 25417 - DNA, 677 bp, Zea mays
  misc_feature: Ceres CLONE 1397241-F
  misc_feature (379)..(379): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (457)..(457): n is a, c, t, g, unknown, or other
  misc_feature (513)..(513): n is a, c, t, g, unknown, or other
  misc_feature (542)..(542): n is a, c, t, g, unknown, or other
  misc_feature (543)..(543): n is a, c, t, g, unknown, or other
  misc_feature (575)..(575): n is a, c, t, g, unknown, or other
  misc_feature (576)..(576): n is a, c, t, g, unknown, or other
  misc_feature (629)..(629): n is a, c, t, g, unknown, or other
  misc_feature (657)..(657): n is a, c, t, g, unknown, or other
tcagaactagtggatcccccgggctgcaggaattcgcacgagaccattacctagaacatcctaatcgaaaaatcacacatattattgagaccaactagcaacaaacaaagctcaatatcgtaccatcaatgcaaggcaaaatatttatacttccttatgctctttgggctttctgcaagtgctggtaccgcaaccattttcccacaatgctcacaagctcctatatcttcctttcttcccccatacctctcaccagcggcggcttcagtatgtgaaaacccaattcttcaaccctacaggatccgacaggaaatcgcagcaggcatcttacctttatcacccttgttcctccaacaaccgacagccctattacagcagntacctttggtgcatttgttggaacaaaacatcaagggacaagcactacaacaacttgtgctnnnnaaacttggggccnactctcataaacatgatttattcctttcaacaaataaccccaattaaaaccggggnttattttgagtaaaactacctttcattcnnttaagatgaaaaccaccccccaaaaaaatttnnccattcaacccaatggggaaccaattgaaatctgagaaaataaataaaaaccngtgaataaattcccttcaattaaaacgnagatataaaaaaaagcgaaa

SEQ ID NO: 25418 - DNA, 648 bp, Zea mays
  misc_feature: Ceres CLONE 1397248-F
  misc_feature: Encodes the peptide sequence at SEQ ID NO. 25419
  misc_feature (306)..(306): n is a, c, t, g, unknown, or other
  misc_feature (307)..(307): n is a, c, t, g, unknown, or other
  misc_feature (351)..(351): n is a, c, t, g, unknown, or other
  misc_feature (378)..(378): n is a, c, t, g, unknown, or other
  misc_feature (423)..(423): n is a, c, t, g, unknown, or other
  misc_feature (532)..(532): n is a, c, t, g, unknown, or other
  misc_feature (542)..(542): n is a, c, t, g, unknown, or other
  misc_feature (545)..(545): n is a, c, t, g, unknown, or other
  misc_feature (646)..(646): n is a, c, t, g, unknown, or other
aaagctggagctccccgcggtggcggccgctctagaactagtggatcccccgggctgcaggaattcgcacgagaccattacctagaacatcctaatcgaaaaacataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcnnatcgtgggcggcggcaccggccggggtgcccgctggccgccacngctgtcggaagcgcttccgcgtgctgnctgctggagcgcggcgcctcgcccctacgacgacgacccgcatcnggggacatggcccccgcttcgcggacacgcttgtcggacacctcccccgggctcgcccgcgcagcgctttcgtggtcggaggacggcgtcatcaatcgcgccccgcggntgctggccgncgncagctgcatcaacgccggcttctacacgcgggccagcgacgacacgtgcgggggcgtcgggtggaacctgggcgccgccgggcggcgtaccggtgggtggnag

SEQ ID NO: 25419 - protein, 72 aa, Zea mays
  misc_feature: Ceres CLONE 1397248-F
  misc_feature (35)..(35): Xaa is any aa, unknown, or other
  misc_feature (38)..(38): Xaa is any aa, unknown, or other
  misc_feature (39)..(39): Xaa is any aa, unknown, or other
MAPASRTRLSDTSPGLARAALSWSEDGVINRAPRXLAXXSCINAGFYTRASDDTCGGVGWNLGAAGRRTGGW

SEQ ID NO: 25420 - DNA, 590 bp, Zea mays
  misc_feature: Ceres CLONE 1397254-F
  misc_feature (531)..(531): n is a, c, t, g, unknown, or other
tggagctccccgcggtggcggccgctctagaactagtggatcccccgggctgcaggaattcgcacgagaccattacctagaacatcttaatcgaaaaataaactagacgagaagagagagagagggagagaggggaaagttgattctctctctgacccgcccactccctccttccctgctccggtcgcactccgtcgttcctccgcgcacgtacgtacagcagccagacacgagatcgagtggtacagggcccgccagaaacctcacgagctagctggttcctgatcggcggcctgtgccgcgcgccgatccacgcatggcgccgccgctcctgcccgcgcgcttcgtcgccgcctccgtcgggctgctcgccgtcgccttctcctctctctaacgcgtccgtcaggtgcatacgatccgctcgatccgaacgggaaataacaatcaagtgggacgtgatacagtggactgcggatgggtatgggggccgtcgtttcgctatacaactaccagcagtaccgcacatcaggnggccggggtggaggctaaggttgggtgtggcgaaaaaaaggaggggatctgggccgagg

SEQ ID NO: 25421 - DNA, 653 bp, Zea mays
  misc_feature: Ceres CLONE 1397259-F
  misc_feature: Translation starting site: 194
  misc_feature: SWISSPROT Homolog: EC 2.3.3.1 Citrate (Si)-synthase
  misc_feature (520)..(520): n is a, c, t, g, unknown, or other
  misc_feature (601)..(601): n is a, c, t, g, unknown, or other
  misc_feature (620)..(620): n is a, c, t, g, unknown, or other
aaagctggagctccccgcggtggcggccgctctagaactagtggatcccccgggctgcaggaattcgcacgagaccattacctagaacatccctaatcaaaaaagcaaccacttctgctctgcatcccgtctgggcctctgcatttgcttggctgctgctcccttctcccaccgaccaactcgatcccgcgccatggatcgcgccgaccccgcgcggggccgccttgccgtgctctcctcccacctccgtggtgcaggggccgaggaggcggcggggctggagaggcgccgagtatccgcgccggcgcccgggccccgcgccggcgcgctttgccgtggtggacgggaggaccgggaagcggcacgaggtcaaggtctccgaagacggcaccgtgcgcgccaccgacttcaagaagataccactggaaaggacgacaagggtcttaagatttatgatcctggttaccttaacactgcccctgttcgctcgtcctctgctacatcggatggagatgagggnaatcctcccctataggggttatccaatcgaagaattgctgaaagcagctcggtttggtgaggtgccctaccttttaatgtnagggggactttgcctactncagagtcattggcagggctgggaatttgctatt

SEQ ID NO: 25422 - DNA, 735 bp, Zea mays
  misc_feature: Ceres CLONE 1397263-F
cccgctggagctcaccgcggtggcggccgctctagaactagtggatcccccgggctgcaggaattcgcacgagaccattacctagaacatcctaatcgaaaaattgcaaatgtttctcttcctctctcccacctctcctctcctctccattgcaaaccttcgggatgaaggttgagagcctgctctgaaacgacgtacgtaaagggaacaaggaaccggagagcgcgcgacgtcctccggcatcctagagcatgacctggtcgctcggcagggccacgaggggattcgtggcaccacacccccgcccccccgaacagcctcacccactgaaaaagaccaactctccggaacgccccgcccccgccgccccgggaggacacccgggccccgccccctgcggggcgccgtcaagatcaaagttatccggtgtggggagagaagcagcagcgaatacgacgggggagacacgccgcccggccacgcggaccccgctccagcgacgccgcccccaccgccccggggagaccccgcccgcatgagctgtgctcccccaaccggcctcgctgccacccatcggggcggcgcgcacatggcgcccggggtcgctcggcaccccggcccacggcgtggggcgagaatgggccgacagacgaccgcgcggggggcgtcgcacaacacactcgcaccacccccgaccccgtgggccgcggttgcccgcaccctgcccaatgcgct

SEQ ID NO: 25423 - DNA, 735 bp, Zea mays
  misc_feature: Ceres CLONE 1397264-F
  misc_feature (20)..(20): n is a, c, t, g, unknown, or other
  misc_feature (207)..(207): n is a, c, t, g, unknown, or other
caagctggagctcaccgcgntggcggccgctctagaactagtggatcccgcgggctgcaggaattcgcacgagaccattacctagaacatcctaatcgaaaactcctgtctccgtcttctcaccaccgctgcctccgcggtttcgcttccccccgtcttcccaagcctttgcttcgctcttcgcttcggattccctctgctcatggncggcagagggaaggcaatctaataacccccgcaaaagaaggaatcgtctcgcacccccacggccgccctccatcgcctccgcgcctccacacgcaaagtaatcatgtcttcccatttaccccgccagtccacgccctacacccttccacttctaatttctaagaacactccccccacactcgttgccgggaggcgttatctctcgccttctcttaccctccctccccgagtgggttcctcccccccccccctcatcggcgcgttttgttttttctaatattccccctcttatgattactacacccccccccctccggatctatttttttattccctctcacctccactctctctcacccctttcctcttaccctctttcatatccccttcttcccccctcccataacccacacacaccacccatttgttccgcctttgcacctcccccttttctcctatttcccacccccgccccttcgttatataccccctctctccgtttttattttctcacccccctttcctttg

SEQ ID NO: 25424 - DNA, 648 bp, Zea mays
  misc_feature: Ceres CLONE 1397265-F
  misc_feature: Encodes the peptide sequence at SEQ ID NO. 25425
  misc_feature (378)..(378): n is a, c, t, g, unknown, or other
  misc_feature (485)..(485): n is a, c, t, g, unknown, or other
  misc_feature (536)..(536): n is a, c, t, g, unknown, or other
aaagctggagctccccgcggtggcggccgctctagaactagtggatcccccgggctgcaggaattcgcacgagaccattacctagaacatcctaatcgaaaaatttttctctctcctgcgccgcgacgtccctcgccttcgccgccgaatccgagactccgatctcgggttcaccgcagcgcacagagcagccccgactcccggcccgatccgcgctctcctctccgtcgcttcagtcatggcaggaatggcacctgagggttctcagttcgatgctaagcactatgattctaagatgcaggagctgctgagcaccggtgagactgaggagttcttcacttcatatgatgaagtttttgagagttttgatgatatggncctccaagagaatcttctgagaggcatttatgcttatggttttgagaagccatctgcaattcagcaggagaggaatggttcccttctgcaaggggtcttggatgtcntctcacaagcacaacctgggacaggaaagaaaggaacttttctgttctggnatctttgccccagctggcctatagcctggctgggatggccgggccctggcccttgcctcccccccgggggctctgcgcggttcatcggaggaaggcgtgcgcggcgcccggt

SEQ ID NO: 25425 - protein, 136 aa, Zea mays
  misc_feature: Ceres CLONE 1397265-F
  misc_feature (47)..(47): Xaa is any aa, unknown, or other
  misc_feature (83)..(83): Xaa is any aa, unknown, or other
  misc_feature (100)..(100): Xaa is any aa, unknown, or other
MAGMAPEGSQFDAKHYDSKMQELLSTGETEEFFTSYDEVFESFDDMXLQENLLRGIYAYGFEKPSAIQQERNGSLLQGVLDVXSQAQPGTGKKGTFLFWXLCPSWPIAWLGWPGPGPCLPPGGSARFIGGRRARRP

SEQ ID NO: 25426 - DNA, 600 bp, Zea mays
  misc_feature: Ceres CLONE 1397270-F
  misc_feature (185)..(185): n is a, c, t, g, unknown, or other
  misc_feature (298)..(298): n is a, c, t, g, unknown, or other
  misc_feature (327)..(327): n is a, c, t, g, unknown, or other
  misc_feature (449)..(449): n is a, c, t, g, unknown, or other
  misc_feature (454)..(454): n is a, c, t, g, unknown, or other
  misc_feature (455)..(455): n is a, c, t, g, unknown, or other
  misc_feature (533)..(533): n is a, c, t, g, unknown, or other
  misc_feature (544)..(544): n is a, c, t, g, unknown, or other
  misc_feature (556)..(556): n is a, c, t, g, unknown, or other
  misc_feature (560)..(560): n is a, c, t, g, unknown, or other
aagctggagctccccgcggtggcggccgctctagaatagtggatcccccgggctgcaggaattcgcacgagaccattacctagaacatcctaatcgaaaactgctagtgctcagtcctcgccctctcgctttccgagggagcctttgcctttcccctccgcccgccagccattaatggcggcggnatctccatccactcccccctcgcccccctcccactgctgctacttctagaagcgctggtggcagggcaggcgttatcccggccgctggcgctggcgcgagagttggttggtgntggtgttcaacccccctccctcttcaggnttagggtggagcgatccgtgcaggccaacgcggggtgcgtgacccagaaagggaaacgccgccttttttctctttctgcgccccgtttttcaaatcctcctcatcctcatccgccccgccgnacatnnacaaaaaggtcccgccttctttcttctcttctctctgcccctggttgccgtttgctcgtgctccccacccccttctgnattcagcaggntctttccgcggngcgncgcgtcgcatgggaaactgctggggcgcaagatcagctca

SEQ ID NO: 25427 - DNA, 637 bp, Zea mays
  misc_feature: Ceres CLONE 1397272-F
  misc_feature (387)..(387): n is a, c, t, g, unknown, or other
  misc_feature (417)..(417): n is a, c, t, g, unknown, or other
  misc_feature (424)..(424): n is a, c, t, g, unknown, or other
  misc_feature (425)..(425): n is a, c, t, g, unknown, or other
aagctggagctccccgcggtggcggccgctctagaactagtggatcccccgggctgcaggaattcgcacgagaccattacctagaacatcctaatcgaaaagagcagcagaccacgaccagcacgcccacttgcctgcgattactttgcgccagagggcagaggccttgcccctgccatcgttgttcttatccccccttcctctttctttctcctccctcttgcggcttctctctggactcgcccctccctccgtctcgtctcccaggtcatggcaaagctggaacacccgtgaatatagcaagtgggagataaacaggaagagctagggtgaatactaaataccagtaacagtagaaggaaaagagtcagcccgcccgtgactacnagtgattttgttggggggggggggtttgtngggttcnntttgttggggggggggtttggttgtgttttgtgtggggggggtcccggggcggcccccgctttgcgggtcccctgtggggtggtcgggcctcccctcccggcgctccgcgtttctgcttgccccccctccccttctgcgtcgcccctggggtggtgcgggtccgcgccccccccctccgcccctccctcgccgctggttccctcgcgcccgg

SEQ ID NO: 25428 - DNA, 644 bp, Zea mays
  misc_feature: Ceres CLONE 1397278-F
  misc_feature: SWISSPROT Homolog: EC 1.1.1.1 Alcohol dehydrogenase
aagctggagctccccgcggtggcggccgctctagaactagtggatcccccgggctgcaggaattcgcacgagaccattacctagaacatcctaatcgaaaaacagggtcatctcacattggatcgattgtgttctcaactggggagaaactcaggatctacgccgtggagtgatttgtcattctgcctcgaagatcctggcactcgctgaaaggaccacgtccagaatacgatcaagcgcatagctgtgccggcctgcgacgccggtaagtcaatggccatcgaggagtcggaggtatcgacttcgcatgccatgtaggagggcgttaagatcgtcttcacctctgtctgccacagcgacatctactactggaagtccaagactcccgtgctccctctctagccttcgccacgatgctgcaggtatactagacagcgttggacacagtcttactgacagtacctcccctggacatgtccttcctgtgttcactgccgagtgcaatgagagtgtccactgcaagtcggcagagagccacatgtgtgatctggtcacgatcaacaccgaccgcggtgtgatgattgccgatgtccactctcggtctatccatcgtgggaagtctatctaccactttggtgacactt

SEQ ID NO: 25429 - DNA, 1111 bp, Zea mays
  misc_feature: Ceres CLONE 1397278-R
  misc_feature: SWISSPROT Homolog: EC 1.1.1.1 Alcohol dehydrogenase
  misc_feature (1)..(1): n is a, c, t, g, unknown, or other
  misc_feature (2)..(2): n is a, c, t, g, unknown, or other
  misc_feature (17)..(17): n is a, c, t, g, unknown, or other
  misc_feature (248)..(248): n is a, c, t, g, unknown, or other
  misc_feature (249)..(249): n is a, c, t, g, unknown, or other
  misc_feature (271)..(271): n is a, c, t, g, unknown, or other
nnggggggggggatccnatgcgtggtggcacccacaaaggggttgaaatttttatcggaccttcataccctctatagtgagaaaggggatggttcatacgatataattaccgacacaggaagctaccctactgcttggcaaaagccaaactgaaggcaacacacaaacgctgtccatcgccagcatgtatgtacctcctcatcgaaatggcaggctagcattgcctcttttattaaccccaaacccannccaaatcacaaaataaacaacnaaatcgagttcgcaatggggatgatgcatccagatgccctcccccttgggcatcaggtcgaaagccttgttgatctcggcgaacgggacgctgtgcgtggggaacctctccaccttcagccccaggtgttgagggaaccagtccacctacatttgggcagattagtgggggggcggtaaaattttgcaaaaggaggtcctcctttcagggggcgttatggtttcaggaaaagttcagtgggggatggggtcttttgaactgaaggggtcgcgttttggaggagctcctccaagcctaggcgcaggtaaacccctcttcaggcgaattccattgaaacgaagtttttctcaaaaggcctggggagttccttagtctatttaaattgtattgcgcctcgttgggcacgtttcttaagataactcgccggggtgtgtaaaacctcttctgcgccctcttttggtagtcgcgtcttctgaggtggtggcgaagatctttctcttggggcgctctgagggattttggtttaagagcacgattgtgcagtaccgttcgccgcgaggggtgggaggacgatcgggatggcggagtctttattgcaggaaccttgcgcgtggcaggttctcacgcggcgcaagttatgtcggaggggtcgtatgggaacatcacatgtggagagaatactgaagagcgcaagatcatgtgggtaacgtgggtgtatctgggaggggggtgtgggcgctgcatggccgtatacactcgaaattgtcctatcgcgacgatgcgaggtgggaagattgtgcaagcacttggtgcggaaggggatccgcaccgggcgcctac

SEQ ID NO: 25430 - DNA, 638 bp, Zea mays
  misc_feature: Ceres CLONE 1397283-F
  misc_feature: Encodes the peptide sequence at SEQ ID NO. 25431
  misc_feature (365)..(365): n is a, c, t, g, unknown, or other
gctggagctccccgcggtggcggccgctctataactagtggatcccccgggctgcaggaattcgcacgagaccattacctagaacatcctaatcgaaaaaacaatattatctcaaagctaaccaacaatggacgttcccaaaggtgttcttccacataaacatcaacggccaggcagtggaaaggatcgtgatggagttgtatactgataagacgccgaagacgcctgagaatttcagagctctgtgcactgcacagaagggagtgggtcgtaagggaaagcccctccacttcaagggatcttccttccaccgagtgatccccagtttcatgtgccagggaggtgatttcaccgcgggaaacggnacagcaggtgagtccatctacggtgatacattcgaggacgagaactttgagaggaagcacacggctcctgcgaacctttccatggcgaacgccggagccaacaccaacggatctcagttcttcatctgcaccgtaaaaaccgattgccttgacggtaagcacgtggtgttcggtcaggtggtgtaaggattagacgtggtgaaggcgatcgagaaggtgggatcgtcatctggaaagccgtcgaagccggtggttatcgccgattgtgcacag

SEQ ID NO: 25431 - protein, 119 aa, Zea mays
  misc_feature: Ceres CLONE 1397283-F
  misc_feature (1)..(120): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
MELYTDKTPKTPENFRALCTAQKGVGRKGKPLHFKGSSFHRVIPSFMCQGGDFTAGNGTAGESIYGDTFEDENFERKHTAPANLSMANAGANTNGSQFFICTVKTDCLDGKHVVFGQVV

SEQ ID NO: 25432 - DNA, 641 bp, Zea mays
  misc_feature: Ceres CLONE 1397287-F
  misc_feature: Encodes the peptide sequence at SEQ ID NO. 25433
aagctggagctcaccgcggtggcggccgctctagaactagtggatcccccgggctgcaggaattcgcacgagaccattacctagaacatcctaatcaaaaagatccccctcctcaccgccaccacgttcgtccgcatccgcgcgctctgccaccgcatggcgcccttcctcctcaccctgctcgccgtcctcctccccgcggtgccgcccagcctcggagccggctacgagaaggggagcgcgggaaccatcaacatcaccaagagcctcgccggcttcccggagttcagagccttcagcgccatgctgaacgagaccagcgtcgcgctcgtcatcaacagccgcgacaggaacaccgtgctggggcccaacaacacagccggcggcgcggagttcggcagactgacacacatcccgcgctcgttcctggtggaactgctcgcgctccacgacgtgctcgactacgtcgacgagcccaccctgggcgcactgcaacgcggtcgcacggaccaaggctccgtgggcacacgctgctagaagtgatgcaacccgctccgcggagaacagggtttcatccggactaacccgggggcgaacgaagggtcacgggctacttcggcgcgaccgcggggcttcgaaac

SEQ ID NO: 25433 - protein, 126 aa, Zea mays
  misc_feature: Ceres CLONE 1397287-F
MAPFLLTLLAVLLPAVPPSLGAGYEKGSAGTINITKSLAGFPEFRAFSAMLNETSVALVINSRDRNTVLGPNNTAGGAEFGRLTHIPRSFLVELLALHDVLDYVDEPTLGALQRGRTDQGSVGTRC

SEQ ID NO: 25434 - DNA, 618 bp, Zea mays
  misc_feature: Ceres CLONE 1397291-F
  misc_feature: Encodes the peptide sequence at SEQ ID NO. 25435
  misc_feature (521)..(521): n is a, c, t, g, unknown, or other
tggagctccccgcggtggcggccgctctagaactagtggatcccccgggctgcaggaattcgcacgagaccattacctagaacatcctaatcgaaaaatcagttcgatagccaggaagcccgtgcacgtcgaccgacgtacgccaccatgccggggatcaccatatgcgacaccgtccccaacctggagctggactccacccacggtaagatccgcatccacgactaccttgtcgacggctacgctatcatcttctctcacccagccgacttcacgcccgtgtgcacgacggagatggcggcgatggcggggtacgccaaggagttcgagaagagtggcgagaagctgctgggcatctcgtgcgacgacatggagtcgcacaggcagtgaaccaaggacgtggaggcgtacggcgcgaagcagcagctgcagcagcatacgacgacgaaggtgacgttcccgatcctggcggacccaggcgcgaacgtcatctggcagctgaacatggtgtaccccccacnagaaggacgcggccggggcggagaatgacgtcccgcgcagttcacgtcgtggggcccaaaaaggccggtgaagctgagcttcctgtaaccggccacc

SEQ ID NO: 25435 - protein, 80 aa, Zea mays
  misc_feature: Ceres CLONE 1397291-F
  misc_feature (6)..(79): Pfam Name: AhpC-TSA Pfam Description: AhpC/TSA family
  misc_feature: SWISSPROT Homolog: EC 1.11.1.15 Peroxiredoxin
MPGITICDTVPNLELDSTHGKIRIHDYLVDGYAIIFSHPADFTPVCTTEMAAMAGYAKEFEKSGEKLLGISCDDMESHRQ

SEQ ID NO: 25436 - DNA, 641 bp, Zea mays
  misc_feature: Ceres CLONE 1397298-F
  misc_feature: Encodes the peptide sequence at SEQ ID NO. 25437
aagctggagctccccgcggtggcggccgctctagaactagtggatcccccgggctgcaggaattcgcacgagaccattacctagaacatcctaatcgaaaaatgttttcattgccaccacacctagagcccgatacgcagctgacgctcagagcattacgatgcatcgtctgccaacagcaactagctcatcagaatcactggcgcttctggtccgaaaaccaaacagcgccgcggccagggatccatcatggctccgaacggcatcaccttcccagaggccgacgagtgcgccaccgcgccggacactgaggactacccaggcgaagaccgccccgcccgcgttcatggcaacccgaggcctaatcctacccagctcaggctgaggataacacctgacaggctgctaatcctcctcgaaaggctgttacagcgatctatactgatcgaatctcaagcatctgcggtctcgtctgctccttatcgcaggggcatcctagatctgtgccacacagattcgcccagtgaacatacctatgacattgctacatcaaccaaagtgggcatcactgccgatgatgtgaccacgttctatgagaattactttgccaatgcaaagaatgcaaaactgagaatcacgaa

SEQ ID NO: 25437 - protein, 130 aa, Zea mays
  misc_feature: Ceres CLONE 1397298-F
MAPNGITFPEADECATAPDTEDYPGEDRPARVHGNPRPNPTQLRLRITPDRLLILLERLLQRSILIESQASAVSSAPYRRGILDLCHTDSPSEHTYDIATSTKVGITADDVTTFYENYFANAKNAKLRIT

SEQ ID NO: 25438 - DNA, 964 bp, Zea mays
  misc_feature: Ceres CLONE 1397298-R
ttgagtacctcgagagtctcgtttgtttttttttttttggaaacccttcccgttaaagataagtacacgccattaaatggaccctaattaagttgcactaggtcaaagaatccagcggcacaaagtaccatttgtactcttctcctaaaaaaaactatacagtttcactcaagatagacataattgtggtcacattacatacagaagttttctacaaaattgaaacaaacacaaggttgaaaacatcgagaataatcttgtgatgtgtaaggtagacgcgctgtgaaccgaccttccaccctgcactacctcatcataaaggctatcttgtttgattcacgaagaagttatccaactctactgctctgagttaaatactggattgttcttagatattgggtacagcctgcattatgccttcgccattttggagctcttctacttctcaccttatgggaacgtgggcttgcggggctccctcttctcttccttcactttcttcttggtatactttcgagcaaccctgactttacttagggcccacctttgggatcatcccgagtgtggcggaaatcatctttcataaggaactcccagcaaagattcgcctctgcatctttcttaaaaccctgcaactgttgtttccggggccccggggggggccttaaccacctttttaaaagtgttttggtggtttgtttttgggccgggaccaagccctttaaccattggggctgggtgattaaaaggttaagtctggcgtggttgggctccaaaacccccaaagggaagaacaggtgggccgggatttggaacagggtgggacaaatatgtggggttgagcacctggttttcacgtaaattcccaacgctgcgggaccccagggaaccgatttgggaagaagaaatttcggttgtaaaatttcttggaaaatggggggccacgcggatttggttgagaaaa

SEQ ID NO: 25439 - DNA, 647 bp, Zea mays
  misc_feature: Ceres CLONE 1397299-F
  misc_feature: Encodes the peptide sequence at SEQ ID NO. 25440
aagctggagctccccgcggtggcggccgctctagaactagtggatcccccgggctgcaggaattcgcacgagaccattacctagaacatcctaatcgaaaagcactcgcactcgcactcgcacctgcacctcgcactagctagtcttgccaattaagctaggtatagaccagcatggcttctgctctcaagatgacggccatctgcatgctgatcctgaccacgggccagctgatggcaactgccggtgcaaaggcgccgctggtgcaggcggacgccgcgcctacggctcgccgtctgctctcggcggaccatgagcgctcagcctccgggaggacgagcaactgcccctgcaccgccatgactccgtggtgttgcttcggtttgcagaggacggcgacggagaactgcccctgcaccgccaggactccgtggtgttgctccggtttgcagaagacggcgctagaggactgcccctgcagcccatttacaccatggtgctgctccggtttgcagaagacggcgctggagaactgcccctgcacccccatgactccattctgttgctttggcgccggcagtgctgtcacaaactgaaatcttcatgagaagaacatgcatgcagatggatgtggcctctaaatgtgt

SEQ ID NO: 25440 - protein, 140 aa, Zea mays
  misc_feature: Ceres CLONE 1397299-F
MASALKMTAICMLILTTGQLMATAGAKAPLVQADAAPTARRLLSADHERSASGRTSNCPCTAMTPWCCFGLQRTATENCPCTARTPWCCSGLQKTALEDCPCSPFTPWCCSGLQKTALENCPCTPMTPFCCFGAGSAVTN

SEQ ID NO: 25441 - DNA, 640 bp, Zea mays
  misc_feature: Ceres CLONE 1397305-F
  misc_feature: Encodes the peptide sequence at SEQ ID NO. 25442
  misc_feature (493)..(493): n is a, c, t, g, unknown, or other
tggagctccccgcggtggcggccgctctagaactagtggatcccccgggctgcaggaattcgcacgagaccattacctagaacatcctaatcgaaaaatctcgtcgctcggctcccgaccgcatcgcgatcagtcatctcctgcgtctcgttctcgccggagatcagacgcgccaccgccgggcgatggatgcctcctaccgccgcgccggtgccggaagcggttctgctccccgctccgtcgaggacatctacaaggactaccgcgcccgccgctccgccgtcctccgcgccctcacccacgacgtcgaggagttctacgcgctgtgcgatccagagaaggagaacctgtgcctatacgggtacgcaaacgaagcgtgggaggtggcgctgccggcggaggaggtgcccacggagctgccggagcctgcgctcgggatcaacttcgcgcgcgacgggatgaaccgtcgcgactggctcgcgctcgtcgccgntcactccgactcgtggctcatatccgtcgcattctactacgccgcgcggctcaaccgaagtgatcgtcgtctccggtggtgtgaagcaatctaaggaaagggacagatccggtactgacaacagtggtagaaataaactgtcagcaa

SEQ ID NO: 25442 - protein, 133 aa, Zea mays
  misc_feature: Ceres CLONE 1397305-F
  misc_feature (103)..(103): Xaa is any aa, unknown, or other
MDASYRRAGAGSGSAPRSVEDIYKDYRARRSAVLRALTHDVEEFYALCDPEKENLCLYGYANEAWEVALPAEEVPTELPEPALGINFARDGMNRRDWLALVAXHSDSWLISVAFYYAARLNRSDRRLRWCEAI

SEQ ID NO: 25443 - DNA, 632 bp, Zea mays
  misc_feature: Ceres CLONE 1397306-F
  misc_feature: Encodes the peptide sequence at SEQ ID NO. 25444
agagctggagctccccgcggtggcggccgctctagaactagtggatcccccgggctgcaggaattcgcacgagaccattacctagaacatcctaatcaaaaaatccagctttgctttgtagttgtagcgctagcagcttaattggtctctgagctgaggtgcactactagctagctagtcgtgcaggaagaggaaggaatataatggctgagcgggaggtcgtcgaaggcgggacgacgacgggaggcgggctgtggcggaggtatgcgccgcacgtccagatggtgctggcgcagctgtgctacacgctcatgtacttcatcaccgaggccgccttcaaccaggggctcaacccctacgtctacatcacctaccgccatctgctcgtcgccgtcctcatctggcccttcgcatactacctggagaaggggctgaggcctaaaatgacgctcatgctgttcgttgagatattcgtgctctcccttctcggggtgagcttaactctgaacatgtacttcgcgagcctgaagtacacgtccccaacgttcgtcacttccgtggtgaacaccatcgcctcgatgacgttcgtcatcgccatcatcctcaggtgacaaaaggccggaccggacgcg

SEQ ID NO: 25444 - protein, 135 aa, Zea mays; identical to SEQ ID NO: 22262
  misc_feature: Ceres CLONE 1397306-F

SEQ ID NO: 25445 - DNA, 639 bp, Zea mays
  misc_feature: Ceres CLONE 1397309-F
  misc_feature (47)..(47): n is a, c, t, g, unknown, or other
  misc_feature (48)..(48): n is a, c, t, g, unknown, or other
agctggagtccccgcggtggcggccgctctagaactagtggatcccnnccgggctgggcaggaattcgcacgagaccattacctagaacatcctaatcgaaaaaattccattctcggaagagaccatttccttcctcctgatctctcacggagtttctctccatggggacgccccgctctccgaggccccgcggcgaagggcccctcaattccccgcccgctggtggggcgggggccctcccggcgggggggaaacccctccccccaaggggggaaaggttcccgccaaacctcttctttcccgggggggggggctaaatttttttggggcccccggggggggggggggcaagcccccggggggagccccccccgggggggggcgggggggggagaccaccccaaaaaaccccctcggagaaacaagggggggggggtttttttcccaaacaaccccccccccccccgggcggggtcccccccgcggcgggagagcccctccttttttatccccgcccccttggggtgtgtttttttttttctccccccagaagaagacacccccctcccctcccgagacaagggggggggggggccccccccccgcgggggggggaaaaacaagggggggggggggcg

SEQ ID NO: 25446 - DNA, 649 bp, Zea mays
  misc_feature: Ceres CLONE 1397317-F
  misc_feature: Encodes the peptide sequence at SEQ ID NO. 25447
atagctggagctccccgcggtggcggccgctctagaactagtggatcccccgggctgcaggaattcgcacgagaccattacctagaacatcctaatcgaaaaaactcgccgtctcgccagtcgccaccatctaaagccgcggctccaatcccaccgcaggacaggcaggcagagcgcgccccgcgccatttcagccatgtcgacgacgtcgtcgtcgtcgtcgtcgtcgtcgtcgtcgtcgttccagtggcgcccatgggtggcactctcctccatccccgtcgtcgtcggcgccaacaacgagcgggcacggaggctcgcgcccggtgcctccgacctctttctcgacatccagctcccacagcacggcgcctcctacctgttcctgcccgagcgcatcataccggagcccaggaattcgtattcaggccgccaccccttcaccatcctgtccgcctgctccgaccgcttcctcttcattgcggttgggggtacccgagccgagggcgtctcgaaccccgcctgcttcctcggcaacgcccaggccagcaccgccgtccgcctccccgacgtccccgcccacctcggcgtcaacatcatactgcgaaacagcattggcctcatcgccgacccgcgacacggtggccat

SEQ ID NO: 25447 - protein, 151 aa, Zea mays
  misc_feature: Ceres CLONE 1397317-F
MSTTSSSSSSSSSSSFQWRPWVALSSIPVVVGANNERARRLAPGASDLFLDIQLPQHGASYLFLPERIIPEPRNSYSGRHPFTILSACSDRFLFIAVGGTRAEGVSNPACFLGNAQASTAVRLPDVPAHLGVNIILRNSIGLIADPRHGGH

SEQ ID NO: 25448 - DNA, 581 bp, Zea mays
  misc_feature: Ceres CLONE 1397320-F
  misc_feature: Encodes the peptide sequence at SEQ ID NO. 25449
  misc_feature (120)..(120): n is a, c, t, g, unknown, or other
  misc_feature (121)..(121): n is a, c, t, g, unknown, or other
  misc_feature (147)..(147): n is a, c, t, g, unknown, or other
cacccgcggtggcggccgctctagaactagtggatcccccgggctgcaggaattcgcacgagaccattacctagaacatcctaatcgaaaactttcgaactgaggaaccctaggcccagnncactcggcgacggcggcgcgccaccnggcgacgggatcagcggcatcactcccctccttccccggcgcggcggcgccctgcacctaggccctagcactgcagcactcgacaacaggatcagcggtcgcgcccccctcctccttccccggcgcggcggcgccctgcagatctgccactgtccgcctgccggtcatggagcacctccggtggcgccccacagtgaacgagcgcgacttcattgagtgtgcgctccagtctgacctcccgtgtgacggcccgcactcctttgacttccgcaaagtcaagatcaccttcggcagggaagaaggcttcgtcaaaaggggcaactccggggaaacccacgggaagggcttacctggacccgggaacttgggcgaaccataccccggaaaaggcccaaatagaagggaacccttggccaattttccccccgagtccc

SEQ ID NO: 25449 - protein, 89 aa, Zea mays
  misc_feature: Ceres CLONE 1397320-F
MEHLRWRPTVNERDFIECALQSDLPCDGPHSFDFRKVKITFGREEGFVKRGNSGETHGKGLPGPGNLGEPYPGKGPNRREPLANFPPES

SEQ ID NO: 25450 - DNA, 660 bp, Zea mays
  misc_feature: Ceres CLONE 1397322-F
  misc_feature: Encodes the peptide sequence at SEQ ID NO. 25451
  misc_feature (443)..(443): n is a, c, t, g, unknown, or other
aaagctggagctccccgcggtggcggccgctctagaactagtggatcccccgggctgcaggaattcgcacgagaccattacctagaacatcctaatcgaaaaaaactcacagcacaaacgttcctctcctcttgcatcgtcgtcctcactcccggacccgcctgtctagtctagccccctcttctcgcgtgcaacccctgtactgtacgtggtagggacacagctagctgcatctacagtagggcaacaaatggtttctggtgcggtgacatgttgagcacgccggcgtcgaccacggtcacgccgtcgacttccctggcaatccggcagacaaatctaggaccggacgctgcctggacgccgggctgatcctgagcacgcagctgacggagcacctgtgcgtgatgggcatctccatgaacctggtgactcacctcctaggngagttgcatcgatccgactcccagtacgccactgtggtagacaacttcgtgggcccgcttaacctgcacgacctagatcgtggattcctcgcagaccacaagctcgaactctacctcggcatcgccatctccagcagaatcagactgcaatgtcgtgagccagctgactgcgattgccatagagtacaggatgcgctcagccagtacgagctcaccc

SEQ ID NO: 25451 - protein, 85 aa, Zea mays
  misc_feature: Ceres CLONE 1397322-F
MGISMNLVTHLLGELHRSDSQYATVVDNFVGPLNLHDLDRGFLADHKLELYLGIAISSRIRLQCREPADCDCHRVQDALSQYELT

SEQ ID NO: 25452 - DNA, 636 bp, Zea mays
  misc_feature: Ceres CLONE 1397328-F
  misc_feature: Encodes the peptide sequence at SEQ ID NO. 25453
cgctcaagaactagtggatcccccgggctgcaggaattcgcacgagaccattacctagaacatcctaatcgaaaagtccttcttccttctctcacacactccactccacgtccccctccttcaaatcctttcaacacccaagcacaaggagagagaagccgccgccgccgccatggacaatattgaggtgaggaggaggaataacaaagggagaatcagccggacgccgccaggggggacgggtacaggcggtcctgcgcgccggcctcgtcgccatggccttcgtcctcctctgcctctgctcctccacgccgtccgccattgacctcaccccaaacggcgaggacgttgctgggagctcaagctgggctttcacgccaccgtgcagcgggtcaccagttggggtcccagtgaccccacccctgcggttgggaggcaatcttcctgctccggccctgacctcaggggcccattccataaacctcccaatcatggaggtcggggggatccttttcccccaaaatcggaagggtccaaaaaattggaaaaactaacttctttaaccaaaaaagttgggggggcccaatcccttgcaaaaaaaaaaaaatggccccaattttggggattttttcctga

SEQ ID NO: 25453 - protein, 92 aa, Zea mays
  misc_feature: Ceres CLONE 1397328-F
MAFVLLCLCSSTPSAIDLTPNGEDVAGSSSWAFTPPCSGSPVGVPVTPPLRLGGNLPAPALTSGAHSINLPIMEVGGILFPQNRKGPKNWKN

SEQ ID NO: 25454 - DNA, 674 bp, Zea mays
  misc_feature: Ceres CLONE 1397335-F
  misc_feature: Encodes the peptide sequence at SEQ ID NO. 25455
  misc_feature (385)..(385): n is a, c, t, g, unknown, or other
tccccgcggtggcggccgctctagaactagtggatcccccgggctgcaggaattcgcacgagaccattacctagaacatcctaatcgaaaagacccccgaactccggacgagccttccgcgcgacggtgcacggctccgccagccacccgtaaaaccctagacggctagccggcgcacggaagcgggcagcggagcggaggtgagcctctcctgcgtcggattgtccccgcccccgctaggcgccatgaagctgacggtgaagaccctcaagggaacgcacttcgagatccgggtgcagcccaacgacacgattatggctgtgaagaagaatattgaagagatacaagggaaagacagctatccgtggggccaacaactgctganttttcatggagaggtcttgaaagatgaaagtacattggaagagaataaagtcaatggagatgggtttctaggtgtcatgcttagtaagggtaaaacatctggttcaactggaactttcatcttccccgggattcaaaacctcctggaaacaaggcagggaccttccccttaagggcccccaaaaggggttcccctaacccccgggggggccaattaccacttcccccccgaaagaggtcccgggaaggggcccaaaaacgggggaggggggggtaaaattttttggggg

SEQ ID NO: 25455 - protein, 103 aa, Zea mays
  misc_feature: Ceres CLONE 1397335-F
  misc_feature (6)..(79): Pfam Name: ubiquitin Pfam Description: Ubiquitin family
  misc_feature (47)..(47): Xaa is any aa, unknown, or other
MKLTVKTLKGTHFEIRVQPNDTIMAVKKNIEEIQGKDSYPWGQQLLXFHGEVLKDESTLEENKVNGDGFLGVMLSKGKTSGSTGTFIFPGIQNLLETRQGPSP

SEQ ID NO: 25456 - DNA, 659 bp, Zea mays
  misc_feature: Ceres CLONE 1397336-F
  misc_feature: Encodes the peptide sequence at SEQ ID NO. 25457
  misc_feature (659)..(659): n is a, c, t, g, unknown, or other
aaagctggagctccccgcggtggcggccgctctagaactagtggatcccccgggctgcaggaattcgcacgagaccattacctagaacatcctaatcgaaaaacttggcgctagggtttcccccctctcatttcccctcctcctcccgctccccctggctccccaagcctcgacgcccggctagggttttgcctccttcccgccgccgctgtttcagcgagcgagaccgaggggtagagaaagagcggtgcttagccacccatgtcctgcgtccgagcgagcgggtcgaggtacggcggaaccgctacaaggtggcggttcacgcgtaggaggggcggcggcggcgcgaggacaatatggtggagatccgcaagagccgccgtgaggagagcctcctcaagaggcgccgtgaggggctccaagcccaggtccctgcccctccctccggggtcgagaagaagcttgaaagcctcccagctatggttagtggggtttattcggatgataataaccttcagcttgaggccaccacacagttccgcaaattgctctctatagagaggagtccccccatcgaagaagttatcaaaacaggtgtagttccaagatttgtgcagtctctcaccagagaggatttcccccagctgcagtttgaagcn

SEQ ID NO: 25457 - protein, 101 aa, Zea mays
  misc_feature: Ceres CLONE 1397336-F
  misc_feature (1)..(60): Pfam Name: IBB Pfam Description: Importin beta binding domain
MVEIRKSRREESLLKRRREGLQAQVPAPPSGVEKKLESLPAMVSGVYSDDNNLQLEATTQFRKLLSIERSPPIEEVIKTGVVPRFVQSLTREDFPQLQFEA

SEQ ID NO: 25458 - DNA, 638 bp, Zea mays
  misc_feature: Ceres CLONE 1397338-F
cgctctagaactagtggatcccccgggctgcaggaattcgcacgagaccattacctagaacatcctaaaaaaaatcttatttcactgccagccctctgaaaaaaaaattaaaaaatgaggtcccagttccacccacctagagagccaaaagagccggcggtggccggcagccaaaacccacgttggattttgccgccgccgcctggagctaggggacaaggcaacgccggtcggtgcaacatttatgcgtgtaccaggcagaccagcccggcagccacgcgtacacttctgccgcaaagctaaacgcgccactccgcggcaagctgctctgctgctcccaccagccaccgcaccgagtgccaatggcagactgcagctgagttcgacgcgcggcggcagcggcaagcctactctgggtctgcggcggtcacctgaccccggggggggggcgccccccggaaaatggaaggggaagtttcccccccttgggggtttttggggccccttgggggagattcccggtgggtggcctcaaaaattttaacaagagggggaccttgcccgggttttttcccaaacccccccttttcccccggttttttctttaaggggggtatttgggggggggccccccccca

SEQ ID NO: 25459 - DNA, 612 bp, Zea mays
  misc_feature: Ceres CLONE 1397339-F
  misc_feature: Encodes the peptide sequence at SEQ ID NO. 25460
  misc_feature (436)..(436): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
aagctggagctccccgcggtggcggccgctctagaactagtggatcccccgggctgcaggaattcgcacgagaccattacctagaacatcctaatcgaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaaggctcgaatgcgcaaccctggactttttccatccaccccctgggcccccaaaaaaggggggcccccaaaaaaacccccctctcctcctttttttaanaaagggggggggggggaaaaacccccctttttaacaccctggttatccggggggggggaaaaaaaaatttgggcccccccccccccgcgggggaattattttattaaaaaaaacannnntttcttttttctctcccccccccccccccagggggggggggggcccccccccccccc

SEQ ID NO: 25460 - protein, 147 aa, Zea mays
  misc_feature: Ceres CLONE 1397339-F
  misc_feature (89)..(89): Xaa is any aa, unknown, or other
  misc_feature (128)..(128): Xaa is any aa, unknown, or other
  misc_feature (129)..(129): Xaa is any aa, unknown, or other
MASETETFAFQAEINQLLSLIINTFYSNKEIFLRELISNSSDALDKIRFESLTDKSKARMRNPGLFPSTPWAPKKGGPPKKPPSPPFFXKGGGGEKPPFLTPWLSGGGEKKIWAPPPPRGNYFIKKNXXFFFLSPPPPQGGGGPPPP

SEQ ID NO: 25461 - DNA, 683 bp, Zea mays
  misc_feature: Ceres CLONE 1397341-F
  misc_feature: Encodes the peptide sequence at SEQ ID NO. 25462
  misc_feature (398)..(398): n is a, c, t, g, unknown, or other
  misc_feature (525)..(525): n is a, c, t, g, unknown, or other
  misc_feature (551)..(551): n is a, c, t, g, unknown, or other
aagctggagctccccgcggtggcggccgctctagaactagtggatcccccgggctgcaggaattcgcacgagaccattacctagaacatcctaatcgaaaaaggattggagtgttttcctcgtcttcaagcgagaagggtcttcaggacttgttttttgggcgggcgcagttgcggagatgcagaggctgggggatttcaggctccctcccttcttcaactaccctccttacttcactttgcagcctatgcgtgaaacacgggaaaagcaagtacagttatggaaaaatatgatactcgattactgtagaagtcaaaagatacatacaatatccctggaagaagatttccccatgttctccaatccaaagattgagagatctcttacctatgaagcanaggaagtgttccttgcagctctcgtcagtgaaggtcgtgctgagtggatggacaaaggtcacaagaagtgcctagttctttggctagggatacaggattgggcccatttcatattaaactttgtaanggatatggggttggaagtatgactanttgagaatacgctctggaattgatacacgtgaactgaacttgagggatcgatcgtggtgtctcatgcgggcgctggggactaaagcaaaagggaaagcggtattttcaaggccctcgccgatgacaggggga

SEQ ID NO: 25462 - protein, 122 aa, Zea mays
  misc_feature: Ceres CLONE 1397341-F
  misc_feature (7)..(123): Pfam Name: ESCRT-II Pfam Description: ESCRT-II complex subunit
  misc_feature (74)..(74): Xaa is any aa, unknown, or other
  misc_feature (116)..(116): Xaa is any aa, unknown, or other
MQRLGDFRLPPFFNYPPYFTLQPMRETREKQVQLWKNMILDYCRSQKIHTISLEEDFPMFSNPKIERSLTYEAXEVFLAALVSEGRAEWMDKGHKKCLVLWLGIQDWAHFILNFVXDMGLEV

SEQ ID NO: 25463 - DNA, 710 bp, Zea mays
  misc_feature: Ceres CLONE 1397342-F
  misc_feature: Encodes the peptide sequence at SEQ ID NO. 25464
  misc_feature (1)..(1): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (47)..(47): n is a, c, t, g, unknown, or other
  misc_feature (56)..(56): n is a, c, t, g, unknown, or other
  misc_feature (710)..(710): n is a, c, t, g, unknown, or other
nggggnnnnnnnnnnnnccccccttcccctccccccccacccccccnacctaaatntatataataaaaattggagctccccgcggtggcggccgcttcctctcctccgcggccgaggtcgctcccccgcccgccgcctcttgcccgcggccgatctcttccctccgctcgcagcgtcgcagcccgtaacgagaccgcgctcggttgagcaccacctggggcccagcgccccagcgtcctcgtgaccacctcggcgcggcatccgccctctgcagccccggtgtctccgcgaccggctccggtgcgtccggaacgcagctccacaggagcatcattatttatagaatacgatctactttatagctgatgacaatgtctgcttctactgctgcaattcgtactgcgaatacaaatggaaaccatgcaggaagttcggattcacattctagccaagatgctaggcagcgaacagctggtattacaaaaagaaaagcattgccttcgattctttcaaaaattcctagcaatgatctgagtcatactatccgaggagaatcagttcttcaaaagtcaaattattcttctgaaggaagaaaaagaggtggttgctttcagcaactgctgaaagcccaaaaccaaaaacactaccaattgggggtttgcttccagcaagctgctggtacggccaaaaaggaaaaagccccctacctn

SEQ ID NO: 25464 - protein, 113 aa, Zea mays
  misc_feature: Ceres CLONE 1397342-F
MSASTAAIRTANTNGNHAGSSDSHSSQDARQRTAGITKRKALPSILSKIPSNDLSHTIRGESVLQKSNYSSEGRKRGGCFQQLLKAQNQKHYQLGVCFQQAAGTAKKEKAPYL

SEQ ID NO: 25465 - DNA, 642 bp, Zea mays
  misc_feature: Ceres CLONE 1397343-F
  misc_feature: Encodes the peptide sequence at SEQ ID NO. 25466
  misc_feature (392)..(392): n is a, c, t, g, unknown, or other
  misc_feature (430)..(430): n is a, c, t, g, unknown, or other
  misc_feature (466)..(466): n is a, c, t, g, unknown, or other
cgcggtggcggccgctctagaactagtggatcccccgggctgcaggaattcgcacgagaccattacctagaacatcctaatcgaaaacttgctaacgaggtgagagagtgttggggccgccgctcttgagggatagaagaagaggtacagcaagcgggggttgcgaggaggcggcggacgctatgggcaacgccgggagtgcgccggaccagcccaagaactcggcggatggggccggcgctgccgacgcggagtctcgccgcgggccgccgtctacggtgcgtttcttccccgatggggagcgccacaaggcacggcagccgcgccaataaaagctcgaggagagaaaggagggcgtcccgccgccgcccgccaccgagggaggagatggnccccgcgcaacctcctggcaggtgtatgcgccttgggngcgttcattgtgtgtgagatagggccctgggctaangaaggaagggaggaccaaggacagaaaaggactcacctgatgcgtgggggaagggaaatggaccgggacagaatcgacttaatctctcggttggctgggtggcggggactaagctaacccgcgaagaaagaaatggccggtttcccgataagccaaccggtgggttgggatcattt

SEQ ID NO: 25466 - protein, 49 aa, Zea mays
  misc_feature: Ceres CLONE 1397343-F
MGNAGSAPDQPKNSADGAGAADAESRRGPPSTVRFFPDGERHKARQPRQ

SEQ ID NO: 25467 - DNA, 738 bp, Zea mays
  misc_feature: Ceres CLONE 1397345-F
caccgcggtggcggccgctctagaactagtggatcccccgggctgcaggaattcgcacgagaccattacctagaacatcctaatcgaaaaatacaacggtgtcagcggactccctacgccaccgtcctcatccgacgccgtcgtccactacaccgccacggtcgtcctcggtcgcgaccgcgcccttcgttctcatccagcgccacggtctagggtttgaggactcctccatcgtctccttgcctcttctccatcatctccttgcctcttctctcctctgagttctccctctggtcacggtcttggttgctcttttgcttttcattcaaatcgtcgtgcatccagatctggcgtctatttttgggccaaatgcttatttcttgcagaaaccaggcatccagatctagcgtgttctgagcacaaaagttgtacaggtatgacctattgatcaggaaagttgtagcagacacgttcgtcgtcgcgaacatcgtcgagccgtgtggctactgcgctggccggtgagcatcggcaagacgtgtgactgctgcccctgaccagcacgatgcgtctctgggctcacatgatgattagatgggacctgatcaccgcgtctctcgacacctgatcaccgggagctcttcatatgtaagaaggcattggacatcagtgctttgacaaaagtctatggtgtgtacacatgattatggcattgaaacaaaagagcaatccatgcgtttg

SEQ ID NO: 25468 - DNA, 716 bp, Zea mays
  misc_feature: Ceres CLONE 1397348-F
  misc_feature: Encodes the peptide sequence at SEQ ID NO. 25469
  misc_feature (709)..(709): n is a, c, t, g, unknown, or other
gctcttgaactagtggatcccccgggctgcaggaattcgcacgagaccattacctagaacatcctaatcgaaaagctagggtttactgtttgccttcctttctcggcaggcggaaccttcgcggcttcgcctgatcgcctacgccgcttcgccctgattctgattctctggtgctcccaagaagaaagtctgggaatgaaggaccgcctcctctcgctgaaccagacccagcgggtccgcctcgaggccgcgcttcaagagctccagtccgttgcgcccgccgccgtgtccgtcgccgccgtcaccgtcgcggacaccattcccgtctatcaagaggacaacatcctcaaggggcatgggacgtcgtatcaggacggggaggtggttgcgacgctctgcgcggtggtggagcgggtcaacaagctggtctacgtccgcactcttcgcgcgagatacaagccggaggttgctgatatcatagatggccgcgtgattgatattgctcctaagcgatggacgttggagataaattttagccaagatgctgttctgatgctttcatctatgaacttgactgatggtattcacagcatgagaactgctgctgatgaacttaatatgcggagtatctttgaagaacatgatgtcatctgtgctggagttcgaggcttccaacatgatgtatctctgcagctacaggcatgagtgnaaagcat

SEQ ID NO: 25469 - protein, 169 aa, Zea mays
  misc_feature: Ceres CLONE 1397348-F
MKDRLLSLNQTQRVRLEAALQELQSVAPAAVSVAAVTVADTIPVYQEDNILKGHGTSYQDGEVVATLCAVVERVNKLVYVRTLRARYKPEVADIIDGRVIDIAPKRWTLEINFSQDAVLMLSSMNLTDGIHSMRTAADELNMRSIFEEHDVICAGVRGFQHDVSLQLQA

SEQ ID NO: 25470 - DNA, 601 bp, Zea mays
  misc_feature: Ceres CLONE 1397351-F
  misc_feature: Encodes the peptide sequence at SEQ ID NO. 25471
  misc_feature (399)..(399): n is a, c, t, g, unknown, or other
  misc_feature (402)..(402): n is a, c, t, g, unknown, or other
  misc_feature (403)..(403): n is a, c, t, g, unknown, or other
  misc_feature (601)..(601): n is a, c, t, g, unknown, or other
aaaactggagctccccgcggtggcggccgctctataactagtggatcccccgggctgcaggaattcgcacgagaccattacctagaacatcctaatcgaaaacagccaaatcggcctatagatcaaacgctgcactgtagggagcgtgaagccagcggcgaatggaatccctagccgccacctccgtgttcgcgccctcccgcgtcgccgtcccggcggcgcgggccctggttagggcggggacggtggtaccaaccaggcggacgagcagccggagcggaaccagcggggtgaaatgctctgctgccgtgacgccgcaggcgagcccagtgattagcaggagcgctgcggccggcgaagcggcgggaggaagaccaagaggcgggttcctttcaaggntgnntggccggggggaacgggaaagggaaacctgtggcccatgggggaagggattcggggcggacaattccaccccccgggttcccttaccgcttggtcttcccccaagaaaaaaattaaaaacccccccattttcctttttaaaaaccccccaaaaaaggggccccccggggaacccaccaaaagtgtggggcggttaaan

SEQ ID NO: 25471 - protein, 145 aa, Zea mays
  misc_feature: Ceres CLONE 1397351-F
  misc_feature (80)..(80): Xaa is any aa, unknown, or other
  misc_feature (81)..(81): Xaa is any aa, unknown, or other
MESLAATSVFAPSRVAVPAARALVRAGTVVPTRRTSSRSGTSGVKCSAAVTPQASPVISRSAAAGEAAGGRPRGGFLSRXXGRGERERETCGPWGKGFGADNSTPRVPLPLGLPPRKKLKTPPFSFLKTPQKRGPPGNPPKVWGG

SEQ ID NO: 25472 - DNA, 674 bp, Zea mays
  misc_feature: Ceres CLONE 1397352-F
  misc_feature: Translation starting site: 246
  misc_feature (597)..(597): n is a, c, t, g, unknown, or other
tccccgcggtggcggccgctctagaactagtggatcccccgggctgcaggaattcgcacgagaccattacctagaacatcctaatcaaaaagagagagaagggagaggcgagggagctcaccaggagagaggggcctgtgtgagcattgagcaaagcaaacgaagcagtacatacatctctcgctcgcagaggcccggccggccggctccatgcaacaagggacgacgagcggtggcggtgggcgatgatgatgatgatggcgggggagcacgtgctggccgctctggccaccctgcttctggcctcgctcctgaccctggtgctgaaccacttcctgcccttgcttctgaaccccaaggcccccaggggaagcttcgggtggccgctcctcggcgagacgctcaggttcctcacgccgcacgcctccaacacgctgggcggcttcctcgaggatcactgctccaggtattgggcggggtgttcaagtcccacctgttctgcaccccccaaggggggtgtccctgcgaccaggacctcaaccacttcatcctgcagaacgagggagcgggctgcttccagtgcagctaccccgaggnccgatccatgggattccctgggcaagtcctcccaatgctccgtcgggcctggggcggagggaccacaaagcgccctc

SEQ ID NO: 25473 - DNA, 742 bp, Zea mays
  misc_feature: Ceres CLONE 1397353-F
  misc_feature: Encodes the peptide sequence at SEQ ID NO. 25474
  misc_feature (543)..(543): n is a, c, t, g, unknown, or other
  misc_feature (565)..(565): n is a, c, t, g, unknown, or other
  misc_feature (605)..(605): n is a, c, t, g, unknown, or other
aagctggagctccccgcggtggcggccgctctagaactagtggatcccccgggctgcaggaattcgcacgagaccattacctagaacatcctaatcgaaaaagttttccattccttgcgcccccttcagatccgatctgatccacgccggcgagacaccggaggaccgccatgacgctcagcctccgtcgcaagcagctcgatgttatcgtgcggatgctgcacctgaaccagcagcagttgccgaacggcggcgagggacagggagaggacgatgcgtacaagatcctggttatggatccgccctgtatctccatcctctcgcctgtgctcaagctcggcgacctccgccaccaaggtgtcaccctcaccctcgccatcgatcgtccgcggcaggtggtgcccgatgcgccggacgtctacttcgtccggcccacccccgagaacgtggaccgagtagcggccgacgccgccgcgcggctctacgggcttttcacgacaacttctccacctccgtcccgcgacccttgttgtagcggctcgnagccgtctggggcagcgatccncccggttggtgcggccctcttggagaacagtgctgaccantacatcgacttcgtctggatccaagaatgaccttcttttccctagggcgagccccggggcttacgttggaattagagaacccggcgggtcccgaaggcgaaatcattgccctcggaatgggttggccccatgggcct

SEQ ID NO: 25474 - protein, 154 aa, Zea mays
  misc_feature: Ceres CLONE 1397353-F
  misc_feature (125)..(125): Xaa is any aa, unknown, or other
  misc_feature (132)..(132): Xaa is any aa, unknown, or other
  misc_feature (145)..(145): Xaa is any aa, unknown, or other
MTLSLRRKQLDVIVRMLHLNQQQLPNGGEGQGEDDAYKILVMDPPCISILSPVLKLGDLRHQGVTLTLAIDRPRQVVPDAPDVYFVRPTPENVDRVAADAAARLYGLFTTTSPPPSRDPCCSGSXPSGAAIXPVGAALLENSADXYIDFVWIQE

SEQ ID NO: 25475 - DNA, 671 bp, Zea mays
  misc_feature: Ceres CLONE 1397358-F
  misc_feature: Translation starting site: 200
  misc_feature (553)..(553): n is a, c, t, g, unknown, or other
  misc_feature (574)..(574): n is a, c, t, g, unknown, or other
tcaccgcggtggcggccgctctagaactagtggatcccccgggctgcaggaattcgcacgagaccattacctagaacatcctaatcaaaaaaagaaaaaggcagcacaccaactcaccaagaaagtgtggagctgctcctgcctgcagcctcctgctcatcgaccctttcgccccacaagctcgattcctcgctcggccatggctgcacccgcggaggagacgcttgccgccgaggatacggcgtcgccaccgccgccggcgaggtctgcggggttctggttccttggcgaggataagtctgtccacaaggctctcggcgggggtaaaactgctgatgtacttttgtggaaagacaagaagacctctgctgcggtagttggtggtgcaaagggtcctaatgggttctgttcgaaattgtagaataccatctcctgaccctggtttctcatgtgctgatcgctgcactgacatcttggttcctgtggccaaatgcgactgtcttaatcaaaaagagcccctcctgatggttcctgaagtgagatatatctgaangacgttgctgtaaacattggnttaaacaattgcgtgctgacatcaacaaggcactgccctgcttttcgggagattgctctgggctaaacccctgatgaagtcctaaaagggggtggcc

SEQ ID NO: 25476 - DNA, 659 bp, Zea mays
  misc_feature: Ceres CLONE 1397359-F
  misc_feature: Translation starting site: 293
  misc_feature: SWISSPROT Homolog: EC 3.1.3.16 Phosphoprotein phosphatase
  misc_feature (405)..(405): n is a, c, t, g, unknown, or other
  misc_feature (463)..(463): n is a, c, t, g, unknown, or other
  misc_feature (467)..(467): n is a, c, t, g, unknown, or other
  misc_feature (501)..(501): n is a, c, t, g, unknown, or other
  misc_feature (502)..(502): n is a, c, t, g, unknown, or other
  misc_feature (595)..(595): n is a, c, t, g, unknown, or other
aaagctggagctccccgcggtggcggccgctctagaactagtggatcccccgggctgcaggaattcgcacgagaccattacctagaacatcctaatcgaaaagaggaaaaatctcgcattcgcaaaccaagcaaatggaggcatgagctccgccgcctccccgtctctcgccgatctcccccaaaccctagcctcgacctgaccgccagcgggcccgcaggccggagaaggagtcggagtcgcccccacccacccaccctctgccgcgggcggggagcgggcggcggacgagatgccgtcgcacggggatctggaccggcagatcgcgcagctgcgcgactgcaagtacctgcccgaggcggaggtcaaggtgctctgcgagcaggccaaggccatcctcatggnagaatggaacgtgcagcccgtgcgctgccccgtcaccgtctggcgcgacatccacggncagntctatgacctcatcgagctcttccgcatcggcgnngactctcccgacacaaaactactctcatgggcgactacgtcgatcgtggctaatattcaggtgaaacggtttctctgttagtggctttgaaangtccgtaaggagatagaataacatacttccaggaatcctgagagcagacaatcactcaggtggc

SEQ ID NO: 25477 - DNA, 653 bp, Zea mays
  misc_feature: Ceres CLONE 1397361-F
  misc_feature: Encodes the peptide sequence at SEQ ID NO. 25478
  misc_feature (214)..(214): n is a, c, t, g, unknown, or other
  misc_feature (216)..(216): n is a, c, t, g, unknown, or other
  misc_feature (219)..(219): n is a, c, t, g, unknown, or other
  misc_feature (221)..(221): n is a, c, t, g, unknown, or other
aaagctggagctccccgcggtggcggccgctctagaactagtggatcccccgggctgcaggaattcgcacgagaccattacctagaacatcctaatcgaaaaaacactccagtccactacaatcatcgctgtaggagatggaggaggcggccggcggcggcggcggcggaggtgaggtatgggatagtcggggtggggatgatggggcgggagnanatncnttcttcgacccaccccataaacagccaatgacgagtcgggtggtgacactctggtaccgccctccagagttgctgctgggtgcgacggattatggagttggcgtagacttgtggagtgcaggatgtatactggctgaattgctggctggaaagcctattatgcctggacggactgaggtggaacagctgcataaaatttttaagctatgtggctctccgactgaagaatattggaaaaaatcagaggtgccccatgccactatattttagcctcaacagccataccaaaggcgaatagcagatacattcaaagatttccctcaatcagcacttcgactgatcgagacactacttgcaatcgatccatctggccgattaactgcaacttctgcattgaacagggatttctttaaacagagccttatgcgggtg

SEQ ID NO: 25478 - protein, 117 aa, Zea mays
  misc_feature: Ceres CLONE 1397361-F
  misc_feature: SWISSPROT Homolog: EC 2.7.11.22 Cyclin-dependent kinase
  misc_feature (26)..(26): Xaa is any aa, unknown, or other
  misc_feature (27)..(27): Xaa is any aa, unknown, or other
  misc_feature (28)..(28): Xaa is any aa, unknown, or other
MEEAAGGGGGGGEVWDSRGGDDGAGXXXFFDPPHKQPMTSRVVTLWYRPPELLLGATDYGVGVDLWSAGCILAELLAGKPIMPGRTEVEQLHKIFKLCGSPTEEYWKKSEVPHATIF

SEQ ID NO: 25479 - DNA, 745 bp, Zea mays
  misc_feature: Ceres CLONE 1397363-F
  misc_feature: Encodes the peptide sequence at SEQ ID NO. 25480
  misc_feature (230)..(230): n is a, c, t, g, unknown, or other
  misc_feature (321)..(321): n is a, c, t, g, unknown, or other
  misc_feature (411)..(411): n is a, c, t, g, unknown, or other
gctctagaactagtggatcccccgggctgcaggaattcgcacgagaccattacctagaacatcctaatcgaaaatctcgcaccctaaaacagcggcgcacaagatgtccgacgaccccaccaacggcggcggcggtgatcgcgtggaggacgtcgtccgcaccgagggtgaaacacaacctcgtgatgatggcttgtcgaaatccaaggatagggacaaagatagagaanaggacaaggacagagatcgtcgcagagaccgtgacagagatcgagggagagacagggaccgtgatagggacagggacagggatcgggacangagacaggatcgccaaagtaggcatcaccgtgaaagacgggaacagcgagaccgtcctgatgatcacagagtccgtggatcttgaagaangaggagacgcgacaaagatgggcatcgtaggcatcgttcctcggctccgttcaggggtaaaaaatcgaaaatttaggccccgtttcaaaaaccagcgagttaaggattttaatgggccaccccccaaaggaagtggttcaaatttttccggttttccacccccaagtgggttacggggttttcccgtccacaaatggggggggggtttcaaaaaagggccccttttgggggtggggggggaataaaccccctttgttccccccccaaaaaaaggtcctcaagggttttcccctttgtgtcgggggtttttatttggggcgcttcctcctttggg

SEQ ID NO: 25480 - protein, 100 aa, Zea mays
  misc_feature: Ceres CLONE 1397363-F
  misc_feature (43)..(43): Xaa is any aa, unknown, or other
  misc_feature (73)..(73): Xaa is any aa, unknown, or other
MSDDPTNGGGGDRVEDVVRTEGETQPRDDGLSKSKDRDKDREXDKDRDRRRDRDRDRGRDRDRDRDRDRDRDXRQDRQSRHHRERREQRDRPDDHRVRGS

SEQ ID NO: 25481 - DNA, 697 bp, Zea mays
  misc_feature: Ceres CLONE 1397368-F
  misc_feature: Translation starting site: 159
  misc_feature (390)..(390): n is a, c, t, g, unknown, or other
  misc_feature (398)..(398): n is a, c, t, g, unknown, or other
  misc_feature (449)..(449): n is a, c, t, g, unknown, or other
  misc_feature (516)..(516): n is a, c, t, g, unknown, or other
  misc_feature (527)..(527): n is a, c, t, g, unknown, or other
  misc_feature (552)..(552): n is a, c, t, g, unknown, or other
aaagctggagctccccgcggtggcggccgctctagaactagtggatcccccgggctgcaggaattcgcacgagaccattacctagaacatcctaatcgaaaactagccgcatcccttctttcattcgccgccgccgcctgctctctgctgccgtcgccatggggagaaggcctgcgagatgctatcgccagatcaagaacaagccataccccaagtccaggtactgccgtggtgtccctgaccccaagatcaggatctacgatgttggcatgaagagaaagggtgttgatgagttcccctactgtgtgcaccttgtctcttgggagaaggagaatgtctccagtgaggctcttgaggctgcccgtattgcccctgcacagtacatgaccnagtctgcnagaaaggatgccttccccactcgggtccgggttcaccccctcccatgtccntcgtatcacagatgctttcgggtgctggggctgataggctccagactgaaatgaggggtgcctttgncaagctcaggncacctgggctagggtggacattggncaggtcctcttttctggtcaatggaagaacaacatgctgccaatggcagggaacttctgggtccgccaaattcaaagtccctggccgcccaaagattatgggaagccaaaagggggctttccccaatttaacccgggccaaatac

SEQ ID NO: 25482 - DNA, 705 bp, Zea mays
  misc_feature: Ceres CLONE 1397372-F
  misc_feature: Encodes the peptide sequence at SEQ ID NO. 25483
  misc_feature (543)..(543): n is a, c, t, g, unknown, or other
  misc_feature (544)..(544): n is a, c, t, g, unknown, or other
  misc_feature (654)..(654): n is a, c, t, g, unknown, or other
aagctggagctcaccgcggtggcggccgctctagaactagtggatcccccgggctgcaggaattcgcacgagaccattacctagaacatcctaatcgaaaaccgaatctcacacccaaaagtttcccactgccctcgtcccccattcaattcttccaactccgccgcttcgcctcgttccgtccgccgccctcatggcgtccgccgccgccacgaccacctccgcccccgcccagaacatcaatccccttagtatcaacatcaagctccccccatggctcagcgggctgcgctgccccttcaccttcgtctgcccgcccccgcccccgcctccgccgccgccgccgcctcctcccccgctgccacctacggaacccgtggtcccacggtcgcggaggttaccaagcctgcgggtgaccacggagtacgatagcgaagagggcgtgtttgtgaacaaggtgtcgtgcaagcttgcgggggacctcgccaaactgcggctctccttccagagcgacccgcagggcagggaaaaagaggggcgggnnaagaaaggggacccgctacagcagctcttcgccgcgccgttggtggggctcatcaccaagcgtttctccgtgctctacgacgtcgaggcacgcaacgcgctgctccgcgnagactgctcgcttcccgggagcgccgtccagctccgtgcctcgcatgatga

SEQ ID NO: 25483 - protein, 170 aa, Zea mays
  misc_feature: Ceres CLONE 1397372-F
  misc_feature (117)..(117): Xaa is any aa, unknown, or other
  misc_feature (154)..(154): Xaa is any aa, unknown, or other
MASAAATTTSAPAQNINPLSINIKLPPWLSGLRCPFTFVCPPPPPPPPPPPPPPPLPPTEPVVPRSRRLPSLRVTTEYDSEEGVFVNKVSCKLAGDLAKLRLSFQSDPQGREKEGRXKKGDPLQQLFAAPLVGLITKRFSVLYDVEARNALLRXDCSLPGSAVQLRASHD

SEQ ID NO: 25484 - DNA, 652 bp, Zea mays
  misc_feature: Ceres CLONE 1397375-F
  misc_feature: Encodes the peptide sequence at SEQ ID NO. 25485
  misc_feature (501)..(501): n is a, c, t, g, unknown, or other
  misc_feature (595)..(595): n is a, c, t, g, unknown, or other
  misc_feature (598)..(598): n is a, c, t, g, unknown, or other
  misc_feature (600)..(600): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (627)..(627): n is a, c, t, g, unknown, or other
aagctggagctccccgcggtggcggccgctctagaactagtggatcccccgggctgcaggaattcgcacgagaccattacctagaacatcctaatccaaaagcaccaccaccgtcactcaacacagcacaggctgctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgcaatcaagcactccctcggccagtcccacccggtcaagctcgcgcctttcagcccggaccaggaggacgcgtcggtgctgtggacgganagcaaggacgtgggcaagggcttccgctgcatccgcatggtcaacaacacccgcctcaacttcgacgccttccacggcgacagggacccacggnggngntgcacgacgggnnnccgccgtcgtggnttctggggaggtgggtgcaagggcc

SEQ ID NO: 25485 - protein, 164 aa, Zea mays
  misc_feature: Ceres CLONE 1397375-F
  misc_feature (114)..(114): Xaa is any aa, unknown, or other
  misc_feature (146)..(146): Xaa is any aa, unknown, or other
  misc_feature (147)..(147): Xaa is any aa, unknown, or other
  misc_feature (152)..(152): Xaa is any aa, unknown, or other
MSWFGHHHHNQPAPPASGPNQVFKIFCRANENYCLAVRDGAVVLAPVNPKDDHQHWYKDMRFSTRVKDEEGMPAFALVNKATGLAIKHSLGQSHPVKLAPFSPDQEDASVLWTXSKDVGKGFRCIRMVNNTRLNFDAFHGDRDPRXXCTTGXRRRGFWGGGCKG

SEQ ID NO: 25486 - DNA, 651 bp, Zea mays
  misc_feature: Ceres CLONE 1397380-F
  misc_feature: Encodes the peptide sequence at SEQ ID NO. 25487
  misc_feature (441)..(441): n is a, c, t, g, unknown, or other
  misc_feature (528)..(528): n is a, c, t, g, unknown, or other
  misc_feature (595)..(595): n is a, c, t, g, unknown, or other
tccccgcggtggcggccgctctagaactagtggatcccccgggctgcaggaattcgcacgagaccattacctagaacatcctaatcgaaaaaatcccttgtcctgtcctcgaaccgtccgccgccgcgttcaacatgggcgacccgccgacgctcaagaggcccaagctcgagaaggccgacgacgactccacctactgcccccgcccgtcctccaatggcgccgcgcccgtacgcacaccaggcgccaccgccgccataggggcggcgccgggtgacgacgtggaggaggaggatgacatcgcggaggaggcggtcatcgccctgatcgcgcaccgcgagcgcgacgtcgagcgctgcaaaagctcagtgctccactaccagtctctcctggacaccgcggagatgaagctggagggagcgcactcgaggctcgcagggntccgagatcgcaagccgcgccaaccttcgtcggaaccccaggcacgacgccgccatccagagggaacacaggcatccccgcgccgantccaagaggatctcaagccattgccgcagcgtaaaatccggagggtccttcgccgggccgaaacggntgggaaggccccaaatttggtttccctggggaacgaaaacggacgacccgggctgg

SEQ ID NO: 25487 - protein, 172 aa, Zea mays
  misc_feature: Ceres CLONE 1397380-F
  misc_feature (103)..(103): Xaa is any aa, unknown, or other
  misc_feature (132)..(132): Xaa is any aa, unknown, or other
  misc_feature (154)..(154): Xaa is any aa, unknown, or other
MGDPPTLKRPKLEKADDDSTYCPRPSSNGAAPVRTPGATAAIGAAPGDDVEEEDDIAEEAVIALIAHRERDVERCKSSVLHYQSLLDTAEMKLEGAHSRLAGXRDRKPRQPSSEPQARRRHPEGTQASPRRXQEDLKPLPQRKIRRVLRRAETXGKAPNLVSLGNENGRPGL

SEQ ID NO: 25488 - DNA, 667 bp, Zea mays
  misc_feature: Ceres CLONE 1397381-F
  misc_feature: Encodes the peptide sequence at SEQ ID NO. 25489
  misc_feature (451)..(451): n is a, c, t, g, unknown, or other
  misc_feature (463)..(463): n is a, c, t, g, unknown, or other
  misc_feature (466)..(466): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (476)..(476): n is a, c, t, g, unknown, or other
aagctggagctccccgcggtggcggccgctctagaactagtggatcccccgggctgcaggaattcgcacgagaccattacctagaacatcctaatcaaaaattcccttctccatccacaactgtcctccacacacatccacacacgccacactgaggagccctgagccctccgcccttaaaccctagcgagcgagccagcgagaggtctcatccccaccaacaccacccatggagctccgcctctaccacctcgcgctgctgctcggcctcgtcgcctgggcggcggctgctgccacgggagccgaggcgcagccggtgtgcgacccctccatcatcgccacccagatcgcgctcttctgcatgccggacatgcccacggcgccctgctgcgagccgatcatcgcctccgtcgacctcggcggcggcgtcccctgcctctgccgcgcgcgncccccaaacggnagnttnnnnntcncccgcctcaacgccacccacctcctcacgctctacgcttcctgcggaggacaacacaccgtgggcgctcacctcgctgccgcctgccaaggtccgacacctcgcgctagcgttcctgttatcgccccgacgacgctcgcctggcgccgcatcaaggaggcaacacgagaggccactccccctgcaacaatg

SEQ ID NO: 25489 - protein, 146 aa, Zea mays
  misc_feature: Ceres CLONE 1397381-F
  misc_feature (79)..(79): Xaa is any aa, unknown, or other
  misc_feature (80)..(80): Xaa is any aa, unknown, or other
  misc_feature (81)..(81): Xaa is any aa, unknown, or other
  misc_feature (82)..(82): Xaa is any aa, unknown, or other
  misc_feature (83)..(83): Xaa is any aa, unknown, or other
MELRLYHLALLLGLVAWAAAAATGAEAQPVCDPSIIATQIALFCMPDMPTAPCCEPIIASVDLGGGVPCLCRARPPNGXXXXXRLNATHLLTLYASCGGQHTVGAHLAAACQGPTPRASVPVIAPTTLAWRRIKEATREATPPATM

SEQ ID NO: 25490 - DNA, 676 bp, Zea mays
  misc_feature: Ceres CLONE 1397382-F
  misc_feature: Encodes the peptide sequence at SEQ ID NO. 25491
  misc_feature (448)..(448): n is a, c, t, g, unknown, or other
  misc_feature (563)..(563): n is a, c, t, g, unknown, or other
  misc_feature (607)..(607): n is a, c, t, g, unknown, or other
  misc_feature (632)..(632): n is a, c, t, g, unknown, or other
gctctcgaactagtggatcccccgggctgcaggaattcgcacgagaccattacctagaacatctaatcgaaaactccactccctcccccccgcctccactaccccactcccaggcgccgcacaggtacgtcgccggcggcgatgacgacgcgcttcaagaagaaccgcaagaagcgcggccacgtgtccgccgggcacggccgcatcggcaagcacaggaagcatcccggaggtcgcggtaacgccggtggcatgcaccaccaccgcatcctcttcgacaagtaccatcccggctacttcggtaaggtcggcatgcgctacttccacaagctccgcaacaagttctactgccccgcggtcaacatcgagcgcctctggtcgatggtgcccgccgaaaaggcggcggaagccggcggcgacaaggccccgcagatcgacgtcacgcagnttcggctacttcaggtgctcggaaaggggtgctgccgcccaagccatcgtcgtcagggcaagctcatctccaaggtccgcgagaagaagatcagggccgccggcgggcgccgtcntgctcaccaagctttggggaaggggaacaccccccattcccccnaaaaggggccccccccggggggggnccctaaagagaggggggggggcctttttctggggggtttttttg

SEQ ID NO: 25491 - protein, 178 aa, Zea mays
  misc_feature: Ceres CLONE 1397382-F
  misc_feature (103)..(103): Xaa is any aa, unknown, or other
  misc_feature (141)..(141): Xaa is any aa, unknown, or other
  misc_feature (156)..(156): Xaa is any aa, unknown, or other
  misc_feature (164)..(164): Xaa is any aa, unknown, or other
MTTRFKKNRKKRGHVSAGHGRIGKHRKHPGGRGNAGGMHHHRILFDKYHPGYFGKVGMRYFHKLRNKFYCPAVNIERLWSMVPAEKAAEAGGDKAPQIDVTQXRLLQVLGKGCCRPSHRRQGKLISKVREKKIRAAGGRRXAHQALGKGNTPHSPXKGPPPGGXPKERGGGLFLGGFF

SEQ ID NO: 25492 - DNA, 674 bp, Zea mays
  misc_feature: Ceres CLONE 1397387-F
  misc_feature: Encodes the peptide sequence at SEQ ID NO. 25493
  misc_feature (546)..(546): n is a, c, t, g, unknown, or other
cgcggtggcggccgctctagaactagtggatcccccgggctgcaggaattcgcacgagaccattacctagaacatcctaatcgaaaacttgccttcgtctccgcctcccgtctttcctcaagaagtcgattcccttccccaagaacccaagcccccaccatgacaagctcctcctctccttcccgaaaggcgctgagcaagatcgcttgcaatcggctgcagaaggaactcgccgagtggcaactcagcccccctgctggattcaagcacaaggtctccgataacctacaaaggtgggtaattgaggtcactggagcggcgggcaccctttacgccggcgagacctaccagttgcaggttgacttccctgagcattatcctatggaggcacctcaggtcatttttctcaatccagcgccaatgcatccacacatctacagcaacgggcacatctgcttagatattttgtatgactcgtggtctccagcgatgaccgtgagctctgtctgtatcagtaatcctgtctaatgttgtctagttcgcagncaaagcaaacgtccagtggacaatgaccgctatgtcaggaatgccgccaaacggaggggcgccgaggaaacccaaaatggtggttcatgacgacaccggtgtaattgagcgcctgacagccttccctt

SEQ ID NO: 25493 - protein, 122 aa, Zea mays
  misc_feature: Ceres CLONE 1397387-F
  misc_feature (19)..(123): Pfam Name: UQ_con Pfam Description: Ubiquitin-conjugating enzyme
  misc_feature: SWISSPROT Homolog: EC 6.3.2.19 Ubiquitin--protein ligase
MTSSSSPSRKALSKIACNRLQKELAEWQLSPPAGFKHKVSDNLQRWVIEVTGAAGTLYAGETYQLQVDFPEHYPMEAPQVIFLNPAPMHPHIYSNGHICLDILYDSWSPAMTVSSVCISNPV

SEQ ID NO: 25494 - DNA, 694 bp, Zea mays
  misc_feature: Ceres CLONE 1397390-F
  misc_feature: Encodes the peptide sequence at SEQ ID NO. 25495
  misc_feature (136)..(136): n is a, c, t, g, unknown, or other
  misc_feature (265)..(265): n is a, c, t, g, unknown, or other
  misc_feature (503)..(503): n is a, c, t, g, unknown, or other
  misc_feature (504)..(504): n is a, c, t, g, unknown, or other
  misc_feature (561)..(561): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (611)..(611): n is a, c, t, g, unknown, or other
  misc_feature (664)..(664): n is a, c, t, g, unknown, or other
aaagctggagctccccgcggtggcggccgctctagaactagtggatcccccgggctgcaggaattcgcacgagaccattacctagaacatcctaatcgaaaagctcaagtcaattcataaactcacaatggcggcnacggcataccccactgtggtgctcatcccactatgcgtcccaggccacctcgcgtccatgatcgaagccggcaagcggctgctcggcagaagccgctgccccatgtccctcaccgtgctcatcacgcanatgaccatgtccgccaacctgatgtccgacgtcgacgacatcatgcgacgggaagccgactccggcctggacatccgcttcgtccacctccccgccgtggagctccccaccgtccaccacggcctcgaggacttcatgatgcgcttcatacagctccacgcgacgcacgtcaaggaggccgtctccggcatgtcgtccccggtcgcccgcggtcgtggtggactacttctgcaccccnnctattcgacgtcgcgcgcgagcttcgcgctgccggcgtacgcctacatgccgtccgnccgcgtcgatggtcgcgctcatgctgcggttacgggctgannnnnnnggnaagggtgtccggggactccgaggcgatgggaagggaacggcgatcttacgggnattgtcccccccggtggcgggtcggtctct

SEQ ID NO: 25495 - protein, 157 aa, Zea mays
  misc_feature: Ceres CLONE 1397390-F
  misc_feature (46)..(46): Xaa is any aa, unknown, or other
  misc_feature (126)..(126): Xaa is any aa, unknown, or other
  misc_feature (145)..(145): Xaa is any aa, unknown, or other
MAATAYPTVVLIPLCVPGHLASMIEAGKRLLGRSRCPMSLTVLITXMTMSANLMSDVDDIMRREADSGLDIRFVHLPAVELPTVHHGLEDFMMRFIQLHATHVKEAVSGMSSPVARGRGGLLLHPXYSTSRASFALPAYAYMPSXRVDGRAHAAVTG

SEQ ID NO: 25496 - DNA, 677 bp, Zea mays
  misc_feature: Ceres CLONE 1397393-F
  misc_feature: Encodes the peptide sequence at SEQ ID NO. 25497
agagctggagctcaccgcggtggcggccgctctataactagtggatcccccgggctgcaggaattcgcacgagaccattacctagaacatcctaatcgaaaaagcaggcgttcggcccggcagcccccaagtcccatcgccgagcagaaagtcaggaacagaactcaggcgttggcgattggcatctccctcccctaagccatggctaccgggcggcccgtacgactcgtgctggatgcctccctcctcctcgacccctcctccaccagggaggcggcggcggtggcgctgcggcccggggtagaggagttgctgcggcggttgcgctactccaacctgagcgtggcaatctgctatgcagagggcatgccaactaatgagtcagactttcttgaaaaggtcgcaagctcacacttgtttggatctatagtacttcttgcaaaaagtgggaatctttctccaattgaattaatgatagaatggagccgaacaagtttttgtttttatgcgacttcaagagttgacaaaggtttaatttctgagctccagaatcagaactggagagttctttctgtagctaatgaatgtagcatagaggttcctggtgttttaaatgttcaaaggcttcaggagttgcttctcaccttggctactctaatgaaaaaggaactttgtgg

SEQ ID NO: 25497 - protein, 158 aa, Zea mays
  misc_feature: Ceres CLONE 1397393-F
MATGRPVRLVLDASLLLDPSSTREAAAVALRPGVEELLRRLRYSNLSVAICYAEGMPTNESDFLEKVASSHLFGSIVLLAKSGNLSPIELMIEWSRTSFCFYATSRVDKGLISELQNQNWRVLSVANECSIEVPGVLNVQRLQELLLTLATLMKKELC

SEQ ID NO: 25498 - DNA, 828 bp, Zea mays
  misc_feature: Ceres CLONE 1397394-F
ccccccccccccccctcctccccccgccgaatccccgccctcagaagatgcagctccaccgcggtggcggccgctcttcaactagtggatcccccggggtgcaggaattcccacgagaccattacctacaacatcctaatcgaaaaccccccgcctcgtccccgcctccgaacatggctgcgctcgggagactccgacgccacacccgccgcgatgacgagcacgtcctccccatctcccgtgagctccccacacccgccccggcgcgccgggacgaccgagcccgttgccatcaccttgacggacgcacaagagacaactccgccgcgaccgcgatccgcaccgcgcggccgccatcctacacgtcgtcgacacggcgtccatcgcctctgattccgcccggcacgcgatctgccacgaccgcgcgccgactttctcgctcacgcctctcccctggacgccgacggccatactagtcagagcattgtcaaggggtgcaatcccgcggacgacgtccccccggccggactgggaatctgctcacggcccggacctggccggagaaaggcgatcgaacccggacggttccgcggagcccctgccccttccatggcctctggaatcgccgctactccttctagggccgccgatgtcacctcacggccccccgcgtgagctagcccagcgccccggggccgcctgcaccgaagaccagcaagaagttgatcatccgccccccaggccacaagcctacggggcccctagcccaaggccccacagaacggcaccgcggacgatcgcgacagcccccgtaccgctatatgcctt

SEQ ID NO: 25499 - DNA, 761 bp, Zea mays
  misc_feature: Ceres CLONE 1397398-F
  misc_feature: Encodes the peptide sequence at SEQ ID NO. 25500
  misc_feature (707)..(707): n is a, c, t, g, unknown, or other
aaagctggagctccccgcggtggcggccgctctagaactagtggatcccccgggctgcaggaattcgcacgagaccattacctagaacatcctaatcgaaaaaaaaaggcactgctcatcgatccgccactacgccacaaaatcctctcctactccggcagttctgctcgccgccgcctccacgatgacggaagacgtgcagatgaacgactcggagccccagcctgcggcctcagctcccgccgtcggggcgccggcgctctccacactacaccatctgaaggagatcgcgtccgtgatcgaggccggttctctgtccaaggaggtccgccggatctcccgcgccttccgcctcaccgtcgcgctccgtcgccgcctcgccgcgcgggacgtctccgccttcctcgccttcgcgctacccgcgtcctccgaagcctacggacgcctcactgccctggtgcccaaggaagatgatactggagatgggatgttgatgctgcagctccagcaactcagatttcaatcaaacatggtgctccctgagattgaaatatattgctacttggctcgtactgattgttccttattgatcataagaaatatgatgaggctaaggcatgcgcaagtgtgagcattgctcgcctgaagaactaaccgaaaaaaagtggttgatgttttggcatcacgactgtacttctattactccntaatgtgtatgagcttaaccaacagccttggctgaaattccgtggggaaatttg

SEQ ID NO: 25500 - protein, 148 aa, Zea mays
  misc_feature: Ceres CLONE 1397398-F
MTEDVQMNDSEPQPAASAPAVGAPALSTLHHLKEIASVIEAGSLSKEVRRISRAFRLTVALRRRLAARDVSAFLAFALPASSEAYGRLTALVPKEDDTGDGMLMLQLQQLRFQSNMVLPEIEIYCYLARTDCSLLIIRNMMRLRHAQV

SEQ ID NO: 25501 - DNA, 708 bp, Zea mays
  misc_feature: Ceres CLONE 1397402-F
  misc_feature: Translation starting site: 427
  misc_feature (353)..(353): n is a, c, t, g, unknown, or other
  misc_feature (393)..(393): n is a, c, t, g, unknown, or other
  misc_feature (400)..(400): n is a, c, t, g, unknown, or other
  misc_feature (413)..(413): n is a, c, t, g, unknown, or other
  misc_feature (431)..(431): n is a, c, t, g, unknown, or other
  misc_feature (432)..(432): n is a, c, t, g, unknown, or other
  misc_feature (462)..(462): n is a, c, t, g, unknown, or other
  misc_feature (486)..(486): n is a, c, t, g, unknown, or other
  misc_feature (495)..(495): n is a, c, t, g, unknown, or other
  misc_feature (499)..(499): n is a, c, t, g, unknown, or other
  misc_feature (511)..(511): n is a, c, t, g, unknown, or other
  misc_feature (550)..(550): n is a, c, t, g, unknown, or other
  misc_feature (551)..(551): n is a, c, t, g, unknown, or other
  misc_feature (583)..(583): n is a, c, t, g, unknown, or other
  misc_feature (584)..(584): n is a, c, t, g, unknown, or other
  misc_feature (595)..(595): n is a, c, t, g, unknown, or other
  misc_feature (621)..(621): n is a, c, t, g, unknown, or other
  misc_feature (622)..(622): n is a, c, t, g, unknown, or other
  misc_feature (630)..(630): n is a, c, t, g, unknown, or other
  misc_feature (631)..(631): n is a, c, t, g, unknown, or other
gctctagaactagtggatcccccgggctgcaggaattcgcacgagaccattacctagaacatcctaatcgaaaaaaatttggatcattccaaacgagactgtgaaccctcccagctcaagcccacctccctgctcaagcccagccgtccactgcctggctccctcgtccggtcgttcccgtctccctcctcgcgtcgcgtccaccattgttcctgtcgacgctgcgccgcacggctcacaccgccgacagtgcctcagtcctatcgagcctccctcttcccagatcaggccctagctgggctacagccgccgccgccgctgccgcatccgtcaccttcacaccgcgtgcgcgngcgcgctctctctctctctctgcgacgactggacgggctnacgtagncgcccccataggnacaacgcccttcgatganntattcgctggcgacaaacggtctgaattanaagaacgatgtcaagcgggggggngggcactcnttangaacagtatggncttgctttagagggccacaccccacacctccttcaaggnngttcacagaagattaaatgggttcttcctttnnaaaagacgganccacaaatgatcattccatcaagccnnggctttgnnctgatccaacatgaaagggatttattaataatactaaatctgttttctctttttcttccccatacaagaataaacaa

SEQ ID NO: 25502 - DNA, 738 bp, Zea mays
  misc_feature: Ceres CLONE 1397403-F
  misc_feature: Encodes the peptide sequence at SEQ ID NO. 25503
  misc_feature (13)..(13): n is a, c, t, g, unknown, or other
  misc_feature (14)..(14): n is a, c, t, g, unknown, or other
  misc_feature (16)..(16): n is a, c, t, g, unknown, or other
  misc_feature (17)..(17): n is a, c, t, g, unknown, or other
  misc_feature (46)..(46): n is a, c, t, g, unknown, or other
  misc_feature (48)..(48): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (738)..(738): n is a, c, t, g, unknown, or other
aatatgtaggatnngnntgcacgcgccagccctcagtttttaaaanancaannnnccacaactggagctccccgcggtggcggccgctctattctagtggatcccccgggctgcaggaattcgcacgagaccattacctagaacatcctaatcgaaaaccggaatggtatcgtgcgacctgtagtcgtcgccagccacctcgctccctcctagacgacacccagctagtgctcccttccacacccaggaaccagccacctaaccccgcccgccatgccgggcctcgccgcctccgacaactcgcccccggcgccggcgccgccgccgcgccggctctcgtcgccgctaccccgtcgcgcgccgacgtccccgtcgccgtccgcctcctcgcgcgccaagcctcggaagccctcgccctctcccgcggccttccccaccgacgccgacgactcgctccacaccccggatgtggggcccttcctcctcaagcaggcgagcgacgccatggtggcaagcgagggcggtggcgccgcgcgcgccctcgagttcgccgagcgccccggcatgagcgctcaagcgaagccggcgagggccgcccgagcctctagtcccgccctggaccctcctacgtcgcccgccgcgcttccactggggggcctcaggcgcggcacgtctgaaagcctttccccggcgccctccagagcggggcccatttggtaatttgatacaaagctcgcn

SEQ ID NO: 25503 - protein, 148 aa, Zea mays
  misc_feature: Ceres CLONE 1397403-F
MPGLAASDNSPPAPAPPPRRLSSPLPRRAPTSPSPSASSRAKPRKPSPSPAAFPTDADDSLHTPDVGPFLLKQASDAMVASEGGGAARALEFAERPGMSAQAKPARAARASSPALDPPTSPAALPLGGLRRGTSESLSPAPSRAGPIW

SEQ ID NO: 25504 - DNA, 647 bp, Zea mays
  misc_feature: Ceres CLONE 1397404-F
  misc_feature: Encodes the peptide sequence at SEQ ID NO. 25505
  misc_feature (492)..(492): n is a, c, t, g, unknown, or other
tggcggccgctctagaactagtggatcccccgggctgcaggaattcgcacgagaccattacctagaacatcctaatcgaaaaccctctctcccggatcgtcctctcccccacaggatctagggtttgctcgctcggccttcgtccttcttgggccgagccctaattcttctgcaccgccacccagcaggcttcggtttggttcgcatccgctgcgcccgcttcgtccccgtattcttggattccattggcttctatcttcagcatggatgagccaaacaacaattttaatgcaacggtgcatgccaatgagatgtttgatagcaatggtgtgatccatgaagatgagatggcccatgacgatgagatgatccatggccatgcgatgttccttggcgatgagatgattcgtgggaccgagatggttgaaggaagtgagatgatccatggtcatgatatggttcaggttaatgatctcatccacggcaatgagnatggttccagttcacgacatggtcaacggtgacaagatagcccatggtaatgaattggttaatgctcagatgaccccacgaatatcaagacgtcgggaagaggaagtcgcctagtttgggagcacttcactatagaactctggcccaggggggaa

SEQ ID NO: 25505 - protein, 86 aa, Zea mays
  misc_feature: Ceres CLONE 1397404-F
  misc_feature (77)..(77): Xaa is any aa, unknown, or other
MDEPNNNFNATVHANEMFDSNGVIHEDEMAHDDEMIHGHAMFLGDEMIRGTEMVEGSEMIHGHDMVQVNDLIHGNEXGSSSRHGQR

SEQ ID NO: 25506 - DNA, 692 bp, Zea mays
  misc_feature: Ceres CLONE 1397405-F
  misc_feature: Translation starting site: 222
  misc_feature (402)..(402): n is a, c, t, g, unknown, or other
aaagctggagctccccgcggtggcggccgctctagaactagtggatcccccgggctgcaggaattcgcacgagaccattacctagaacatcctaatcgaaaagttccaactcctacctacgcagcagaggccagccacctccccgtcgctctcacgctcttcgtgcccgccgcctctcctccgtctctgcctctctccctctcccctcccgtctgacgcacatggcctccatcgccggatcttcggccctctccttcgccaggcccgtcaagacaatcaacacaaattctctagctttctccccggcgaggaagggcaacacattcctccgcctgcaaccaatgcctatgagatctgtttcctgcgctgccaagaaggatacaacagacaaggtttgtgagnatgtgaagaagcagcttgctcttcctgaccatactgaaagtttgcgtggatcgaaaatctctggactcggtgcagatcactgaacacggttgagattgtgatgagtctcgaggagcacttcgaaattagcgggaaggaggccaggggacaaaaaatcgcccaggtggaagacgcccggaccctcatcgacaagttgttggtgggaaagggaaattcgaaccccccctatgggtggccaaccacctggggcaacccctggtaagggttcaaagggcggaaaaattgggatt

SEQ ID NO: 25507 - DNA, 725 bp, Zea mays
  misc_feature: Ceres CLONE 1397406-F
  misc_feature: Translation starting site: 294
  misc_feature (576)..(576): n is a, c, t, g, unknown, or other
  misc_feature (577)..(577): n is a, c, t, g, unknown, or other
  misc_feature (583)..(583): n is a, c, t, g, unknown, or other
  misc_feature (612)..(612): n is a, c, t, g, unknown, or other
  misc_feature (618)..(618): n is a, c, t, g, unknown, or other
caaagctggagctccccgcggtggcggccgctctataactagtggatcccccgggctgcaggaattcgcacgagaccattacctagaacatcctaatcaaaaactttaaaatggacgcgcacctccacctgggtctgtctgcgcagggacgcggacgcggcggcaccggcaagcaattgtctcatctgctccactccatctccatttaacgcactctccactccttcgcggtgggggtttaggcgcacggcggcaggccaattaacgccgctgcggcgagcgccgggggggaaatgggcggcgacggcacgagggcgctggaccagacgccgacgtgggccgtgaccgccgtctgcgctgtcatcgtcgcggcgtccatactcctcgagggattcctccaccacctcggtcagttgctcaacaagaagcgcaagaaggcgctgtttgacgctctggagaaggtaaatcggagctgatgactctggtgttcatatcgctgctgctgaccgtgacaggaaagtacatcgcgcgcatctgcatcccggaaggagccgcaaacacatgctgcactgccgnnctgtcngtcactcggtggaggaagaagcccagggncatgtncgacgggacctatctgaagatccaacaaacttttttcctggcgcaaagcatggtgtcgcttgtttcaaccgacgaatgcatcagctgaacatttcgggttcctctcc

SEQ ID NO: 25508 - DNA, 636 bp, Zea mays
  misc_feature: Ceres CLONE 1397408-F
  misc_feature (636)..(636): n is a, c, t, g, unknown, or other
gcggtggcggccgctctagaactagtggatcccccgggctgcaggaattcgcacgagaccattacctagaacatcctaatcgaaaaacccctgttcctctgcgatttgggctcgtcctgtgtccttcctgttgctcaaaagctcgctcattcgatgtccctgtctgaaaggcgacaaatcccactggaattcggagcacagagctttgaatccaggggccaaaactttttgctcatctcccttgcggaaaagcgcctcctctgcgtctgaaagtcggatcttttttcacagattcgatttgaagttcccgagcagctcgaggaccgcggtgtcggtaagacttgctttgaagatcttgatcaccacaagagatttgctgaaattccggtcactgtactttttccactggacatgtcctttcgcagcatagttccgtgatgttaaggaaaagttttggaagcttatcaagacggaagccttgaaggccaggaatttctggttttggcctggcctgccaaaaatcgggttggaaactgggaagggacccgggccggccgaaccgtgatataaatgataaaaaaaaaagggggggttgggccctccccccctggaatgacgctccagaagggaaagggn

SEQ ID NO: 25509 - DNA, 761 bp, Zea mays
  misc_feature: Ceres CLONE 1397422-F
  misc_feature: Encodes the peptide sequence at SEQ ID NO. 25510
  misc_feature (1)..(1): n is a, c, t, g, unknown, or other
  misc_feature (701)..(701): n is a, c, t, g, unknown, or other
  misc_feature (717)..(717): n is a, c, t, g, unknown, or other
  misc_feature (725)..(725): n is a, c, t, g, unknown, or other
naaaagtggagctccccgcggtggcggccgctctacaactagtggatcccccgggctgcaggaattcgcacgagaccattacctagaacatcctaatcgaaaaagtttgttcaactacatacgcaaatcggaatcgaaaccctatctcggatccgatggctcgttcgccgccgccttcttcgtcggccggcggcgcgcagtacgcgcagcagttcctcaacacggcgctctcccagcgggggccgtccgcgctgccgtacgccgaggacgtcaagtggctcatccgcaaccacctggtggcgctggccgaggccttcccctccctccatcccaaggccgccctcttcacccacaacgacggccgcgccgctcacctcctccaggccgacggcaccatccccatccaccacgccggtgcctcctacaacctccccgccgtcatctggctgcccgagccctacccgcgctccccgccgctcgtcttcctctcgccgacccgagacatggtcatcaagccccaccaccgccttgtcgacagctccggcctcgtcgccaacgcgccctacctccgctcctgggtcttcccctcctccaacctcgtcgacctcgtccgatccctctcgcacctattcggcctcgacccgcgccttcttcacccaggaaccctcctgccgccgctcaggctccgccaccgaatcccntcgccgacccagcccncacacggntcgggccgcctccccttcccccctctacggaagggt

SEQ ID NO: 25510 - protein, 202 aa, Zea mays
  misc_feature: Ceres CLONE 1397422-F
  misc_feature (43)..(165): Pfam Name: UEV Pfam Description: UEV domain
  misc_feature (188)..(188): Xaa is any aa, unknown, or other
MARSPPPSSSAGGAQYAQQFLNTALSQRGPSALPYAEDVKWLIRNHLVALAEAFPSLHPKAALFTHNDGRAAHLLQADGTIPIHHAGASYNLPAVIWLPEPYPRSPPLVFLSPTRDMVIKPHHRLVDSSGLVANAPYLRSWVFPSSNLVDLVRSLSHLFGLDPRLLHPGTLLPPLRLRHRIPSPTQPXHGSGRLPFPPLRKG

SEQ ID NO: 25511 - DNA, 680 bp, Zea mays
  misc_feature: Ceres CLONE 1397424-F
aaagctggagctccccgcggtggcggccgctctagaactagtggatcccccgggctgcaggaattcgcacgagaccattacctagaacatcctaatcgaaaagtcccttcgtctccggtcagagctcggctagccaggagtcccactatagatctacgagaaagcttctcgccttggtgctgcgatcttctctctacagcttgggtagcagaggggacgtgtatactgccaagtcggtgaaggcgagcggcgtgcgatacatcctggcgcacccgtctaccgcgtccgatggggccgtgtcggatctcgacgttcaggacctcgatttgcaagttgatcattatgaactgacgcgtatgatgcacaacgaccgatgggaacgagcaaatcaaggtaatgatcctcacttaatttgggacgaatgtccactccagctatcagaataagtgccgactcatccgcatcatcaaatacacttggaactccgtaagaggatacgctgacacaattctgactgtccacagatgacagactgagtgcaaaacgctcaacttctaaatctatggctaggacaagaaagaggatcctccaattgtgctgagaactagagacgaacgctcaatcatgcttgacgaacataattctcccacactcgtgatgaggcctaagtaagaggtgca

SEQ ID NO: 25512 - DNA, 633 bp, Zea mays
  misc_feature: Ceres CLONE 1397426-F
  misc_feature: Encodes the peptide sequence at SEQ ID NO. 25513
  misc_feature (439)..(439): n is a, c, t, g, unknown, or other
  misc_feature (555)..(555): n is a, c, t, g, unknown, or other
  misc_feature (612)..(612): n is a, c, t, g, unknown, or other
cgctcttaactagtggatcccccgggctgcaggaattcgcacgagaccattacctagaacatcctaatcgaaaaaaccccccttgtcgcgccacgccatctcctcgccgctttccgccacctctctcccatgtctgcgccatctgagtccacgcgcaggatactgcagcgcaggttccgcctaccatgcttcaccctcagggtggacgtcctcgagtatgccgacgccttcctcgacggcttccccgacacccaggacgacacgctcgatctcctcctcgacgagctcgactaggagccgctgtagtcgacgatcctgaaccagggacgcggtcaggcgcgtggtgtcgctgcttgtcaaggccaaggagtctctcgatgtggagtcgactgcgtccacaagtgcaaggtctgcgctggttcctgctgtactcgttctncgtgccgcgattgcgctactgttgaatcatgatagtattttacgatcacacaagccgatgaactggcgatgtaccacttggacatcaagcttccgtgtatatgcatagtgcatgangcgctgttgcacagactgtcttgtgcataatatttcgctaagccggcccttgacgcnctgctacctgaatgatgtagt

SEQ ID NO: 25513 - protein, 54 aa, Zea mays
  misc_feature: Ceres CLONE 1397426-F
MSAPSESTRRILQRRFRLPCFTLRVDVLEYADAFLDGFPDTQDDTLDLLLDELD

SEQ ID NO: 25514 - DNA, 693 bp, Zea mays
  misc_feature: Ceres CLONE 1397430-F
  misc_feature: Encodes the peptide sequence at SEQ ID NO. 25515
  misc_feature (544)..(544): n is a, c, t, g, unknown, or other
  misc_feature (631)..(631): n is a, c, t, g, unknown, or other
  misc_feature (632)..(632): n is a, c, t, g, unknown, or other
  misc_feature (647)..(647): n is a, c, t, g, unknown, or other
  misc_feature (653)..(653): n is a, c, t, g, unknown, or other
tccccgcggtggcggccgctctagaactagtggatcccccgggctgcaggaattcgcacgagaccattacctagaacatcctaatcgaaaaaacgaaccaaacataatttcaggccaccgctactggtgctgctgcttcgaggacaagaaagagggaactcacgcgcagacaaagaaaagcacaagcaggaatgggaatctgctgcgtggaaggtgcaaggcggcggcaggggtagcccgacgcacgacaaggggctgggcttcccatggatgcacgacgacctgttccacagccacctgtgggccagcgccggcgtctccgtgcacaccaagcagggatggaagggcgccaaccaggacgccatgaccgtctgccaggacttcgccggccagaaaggccacatcctctgcggagtgttcgatggccacgggcctcgtgggcgggaagtcgctcgccacgtccgcgacaccctcccggtggaactaggcgccgctctgaagccgagaaccggggacgaagatccctccggctcgagcgacgctncgaagcctatacctgacgaagatggctcaagcgagaatgcagaaagatgctcaggcaagaatggggatgcttcgagcaacgccgatnntggattccttcgacnagtcangaaggtagcgggtcgttcagcgacgtttacgagcggacaa

SEQ ID NO: 25515 - protein, 141 aa, Zea mays
  misc_feature: Ceres CLONE 1397430-F
  misc_feature (92)..(92): Xaa is any aa, unknown, or other
  misc_feature (121)..(121): Xaa is any aa, unknown, or other
  misc_feature (126)..(126): Xaa is any aa, unknown, or other
  misc_feature (128)..(128): Xaa is any aa, unknown, or other
MHDDLFHSHLWASAGVSVHTKQGWKGANQDAMTVCQDFAGQKGHILCGVFDGHGPRGREVARHVRDTLPVELGAALKPRTGDEDPSGSSDAXKPIPDEDGSSENAERCSGKNGDASSNADXGFLRXVXKVAGRSATFTSGQ

SEQ ID NO: 25516 - DNA, 660 bp, Zea mays
  misc_feature: Ceres CLONE 1397432-F
  misc_feature: Encodes the peptide sequence at SEQ ID NO. 25517
  misc_feature (261)..(261): n is a, c, t, g, unknown, or other
  misc_feature (404)..(404): n is a, c, t, g, unknown, or other
aaaagctggagctccccgcggtggcggccgctctagaactagtggatcccccgggctgcaggaattcgcacgagaccattacctagaacatcctaatcgaaaaaccatcccggaggtaatcttgcgccgattcggtgccgatttgcgccatccgcgaccggaggctccgccgggtcttgtgttcttgcggggcgggggctcaggacaacctggcctctgcttgattggattcggggcgttcggcgcccccagctcgcgtcntttcctgccggtttcgtcgaccgctggcaacctggccggtcggtcccgggggctcttcacctccgtgctgcctgccaccgtcgctttagtcaagtcttggccaagattttagctatctccggtcaaaaggctttaccgattcnttggattggtggcttcttgggggcgagaagccggttcctgtttcgtctcttgtgctccagcatgttctgtagcacaccggttcccctctccaagtgaagggtgttcgtgtgctccttggttttgtgcctcccggaatcgttcccggaaagctacttttggccgcctgcggcgatggcgtcgagcaccagcgagatggccgaggggaaggagaagctgaagaggtccggcagcttgggaagcaacgatacgtatgtg

SEQ ID NO: 25517 - protein, 123 aa, Zea mays
  misc_feature: Ceres CLONE 1397432-F
  misc_feature (87)..(87): Xaa is any aa, unknown, or other
KAGAPRGGGRSRTSGSPGLQEFARDHYLEHPNRKTIPEVILRRFGADLRHPRPEAPPGLVFLRGGGSGQPGLCLIGFGAFGAPSSRXFLPVSSTAGNLAGRSRGLFTSVLPATVALVKSWPRF

SEQ ID NO: 25518 - DNA, 600 bp, Zea mays
  misc_feature: Ceres CLONE 1397438-F
  misc_feature: Encodes the peptide sequence at SEQ ID NO. 25519
  misc_feature (311)..(311): n is a, c, t, g, unknown, or other
  misc_feature (342)..(342): n is a, c, t, g, unknown, or other
  misc_feature (423)..(423): n is a, c, t, g, unknown, or other
aaagctggagctccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggncggtgtcgacggcctcccgccggggcctccngggttggccgggtggtggggaacctgttccaggtgatcctgcagcgacggccttcatgtacgtggtgcgcgacctccgggnagaagtacgggcccatcttccccatgggcggatgggggcagccaccccctcaatcggtggtcaccctccggcggaagctcctcccacccaagggcttggggggaaaaaagggcccccattgtttttcaaagaccgggccccagaagaaaaaaccccccccccccccccctctttttt

SEQ ID NO: 25519 - protein, 123 aa, Zea mays
  misc_feature: Ceres CLONE 1397438-F
  misc_feature (38)..(38): Xaa is any aa, unknown, or other
  misc_feature (65)..(65): Xaa is any aa, unknown, or other
MDVNDVLLVVLAAALAAMWWRRCSKTGRCRRPPAGASXVGRVVGNLFQVILQRRPSCTWCATSGXKYGPIFPMGGWGQPPPQSVVTLRRKLLPPKGLGGKKGPHCFSKTGPQKKKPPPPPPLF

SEQ ID NO: 25520 - DNA, 754 bp, Zea mays
  misc_feature: Ceres CLONE 1397439-F
  misc_feature: Encodes the peptide sequence at SEQ ID NO. 25521
  misc_feature (727)..(727): n is a, c, t, g, unknown, or other
aaagctggagctccccgcggtggcggccgctctagaactagtggatcccccgggctgcaggaattcgcacgagaccattacctagaacatcctaatcgaaaaacgcacctcccgacttctccggttctcccttcttcatagcagccacccacgcatctcaccgccgaggcgagcgaggacctcgtggttcgtgccctgctcacctcgtgaggatgtggatcgcgagccggctcttcctcgcggcgtcggcgctgctgatggctgtgcttctgctcgtcgcggggccggtggcggcgcaggacgcggcggtggagggcgtggccccgcctgcggaggagatcgcgctgaacgcgaggtccaaggaggcggtggctctggccgccgagctagtgcaggtcatggcgaagatctccgcgttagagtctcgcattgcagagcagaacctggagttcaagaccaagaatgatgcaatcgaaacactgaatatgattgtcaaggaaaagtcacagaagattgctactatgcagaatgaagccaaagggtctttagctgcagaggagcaggcaagcaaggccaatgcactggctattgagctcaagaagcagaccgagaagctcaagaaggatattacagaacaaaaaattatgaaagcagctctggaggctagggctggcaatgctgagtataaggtgcaagagctacatatgaagctgcagaagctccagangacaagcagtgatcacaagcgcatgat

SEQ ID NO: 25521 - protein, 180 aa, Zea mays
  misc_feature: Ceres CLONE 1397439-F
  misc_feature (172)..(172): Xaa is any aa, unknown, or other
MWIASRLFLAASALLMAVLLLVAGPVAAQDAAVEGVAPPAEEIALNARSKEAVALAAELVQVMAKISALESRIAEQNLEFKTKNDAIETLNMIVKEKSQKIATMQNEAKGSLAAEEQASKANALAIELKKQTEKLKKDITEQKIMKAALEARAGNAEYKVQELHMKLQKLQXTSSDHKRM

SEQ ID NO: 25522 - DNA, 713 bp, Zea mays
  misc_feature: Ceres CLONE 1397443-F
  misc_feature: Translation starting site: 150
  misc_feature: Pfam Name: UPF0187 Pfam Description: Uncharacterised protein family (UPF0187)
acccgcggtggcggccgctctagaactagtggatcccccgggctgcaggaattcgcacgagaccattacctagaacatcctaatcgaaaagacccacccatccaaccacttccacgaatggacctcgatctgagaactcgtctgtttccatgggggcgccgtcgcctaaacccccgacaccacgcgggcgctgccaccacccgtccaatgccacccgccgtctccacgtggccacccgctgcttccccgacccaccaccaccacctgcctccatgccgacgataccgagtccgaaccctgtgctgtcccttctctccgcggtgcccgactggaccaacgccatacaagagagccgcgtcagcgaccgccgcccgctctacaaccacgccacctggtgacaccatcgtagatcccgacgccaactgtgacacctcctcacctcactgtcctcccgtgtcatcctctccctggcgcccgcggagtccgacttcaccgccttctacgccgccatcgctcacctacaacacgctcctaccggtctacggagtaatcgcatcctcgctcctatactagctcactgcgcacgaggtcgagctcatcctcgtcttccgtaccgaggcttcctacgagcgcttcgacaagggacgcaaggtctggatgctcttgctctacattgacagcgacctctacgaaatgctcatgcgacatcctcc

SEQ ID NO: 25523 - DNA, 703 bp, Zea mays
  misc_feature: Ceres CLONE 1397446-F
  misc_feature: Translation starting site: 598
  misc_feature (384)..(384): n is a, c, t, g, unknown, or other
  misc_feature (422)..(422): n is a, c, t, g, unknown, or other
  misc_feature (501)..(501): n is a, c, t, g, unknown, or other
  misc_feature (566)..(566): n is a, c, t, g, unknown, or other
  misc_feature (687)..(687): n is a, c, t, g, unknown, or other
  misc_feature (688)..(688): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
caaagctggagctccccgcggtggcggccgctctagaactagtggatcccccgggctgcaggaattcgcacgagaccattacctagaacatcctaatcgaaaaaccaaaagaaagaaaccaactaaaatcccaaaagagaggaaaggcataaacagacggtagaaggaagaaagggacgctcgtctcggctcgtcacgtgccgccgccatggctgctctgggccgtggcctgcccctcctcctgctcctcctcctcgccgtagcgggggccgccaacgccgcggcggcgcccggcggcatgtccatcatcacctacaacgaggagcacggcgcgcgggggctggagcgggacggagccggaggtgcgggccatgtacgacctcntggctcgcggagcacggccgcgcctacaacgcgctggngcggagggcgagggcgagcgcgaccgccgcttcctcgtcttctgggacaacctccgcttcgtcgacgcgcacaacgagncgcgcgggcggcccgcggcttccggccctcggggatgaacccagttcgccgacctcaccaaacgnacgagttcccgcgccgcgtacctccggcgccatggtccgcccgcccccccgggggaaaacccctccggggggggaaaaaaggtacgcgccacgaacgggcgccgccgaggagctgccggannagcgcannnnnnnnn

SEQ ID NO: 25524 - DNA, 675 bp, Zea mays
  misc_feature: Ceres CLONE 1397447-F
  misc_feature: Encodes the peptide sequence at SEQ ID NO. 25525
  misc_feature (337)..(337): n is a, c, t, g, unknown, or other
  misc_feature (443)..(443): n is a, c, t, g, unknown, or other
tccccgcggtggcggccgctctagaactagtggatcccccgggctgcaggaattcgcacgagaccattacctagaacatcctaatcgaaaagtaagagaggattttgctaggtttttgcccccaaccgcccaactgcgcgtgctcctgccgacctcccacccctccactccccggcggttggcggctgtctcgccgaagcgacccagccgatatggcgaagggcgacgacgcgctggcgcggaagcgcaaccgtgtgcgccgcaagcgcctccgtagcagcgagaacgctgtttccgcgcgtgtcgcggcgatcatcgcctccaagcaccgccgcanatcggggaagcgccgcgcctgcgagggcatgtgcttctcgctccccacgcccgacgacccgttcaacgagcgccatggcaggaagcacaagctcgatgacgagccnggcgacgaccaggccgccgaggcccgctgaaggacagcggcaacccccagaaagaagggcgcgaacaccaaaagcagcagccgggggaaaggatggcgcccgagccagctccaaaggcgtttcccaaaaggaaaacgtttgcgggagggggttccccgggaacttccaccggccggcaagatctccgggggggccgggccacacctattacgggaagggggggggcccccca

SEQ ID NO: 25525 - protein, 86 aa, Zea mays
  misc_feature: Ceres CLONE 1397447-F
  misc_feature (42)..(42): Xaa is any aa, unknown, or other
MAKGDDALARKRNRVRRKRLRSSENAVSARVAAIIASKHRRXSGKRRACEGMCFSLPTPDDPFNERHGRKHKLDDEPGDDQAAEAR

SEQ ID NO: 25526 - DNA, 664 bp, Zea mays
  misc_feature: Ceres CLONE 1397448-F
  misc_feature: Encodes the peptide sequence at SEQ ID NO. 25527
aagctggagctccccgcggtggcggccgctctataactagtggatcccccgggctgcaggaattcgcacgagaccattacctagaacatcctaatcgaaaaagctaggttcctatgcccaaagtcacacagcttcttctccttctacttctccttcctcctctcctcaccggcaccttgatctaatctcttccatcctagcttgctcgccgctgccagtctctcctccgcctgcaacgactcccatgtctcagtcttctcctctcttctccgtcgcccgagcgcacgccggagcaggagggcgagccgtggcagccgctctcctgctccgtcgtcgccccattgcacagctgccgcacagcatccatggcctacggtgtctctctccagccagagcgacaccttccaagacgctcctcagcctcccccgcgccacgctgtcctccttcgccgaccccgacggcgacggcggctccagcgcgaaagccagcgacggcggcgccaaggccggcgccggcggggaggagcaggtcggggaatgcgagatgtcggagatggccagggcgttccacatctcgccaggggtggcgacgtccatctccgtgacgatcgcgttcgccgccctcaccgtgccgctggcgatgcgctcgctggtctgcccggga

SEQ ID NO: 25527 - protein, 40 aa, Zea mays
  misc_feature: Ceres CLONE 1397448-F
MSEMARAFHISPGVATSISVTIAFAALTVPLAMRSLVCPG

SEQ ID NO: 25528 - DNA, 715 bp, Zea mays
  misc_feature: Ceres CLONE 1397451-F
  misc_feature (715)..(715): n is a, c, t, g, unknown, or other
ggagctcaccgcggtggcggccgctctacaactagtggatcccccgggctgcaggaattcgcacgagaccattacctagaacatcctaatcgaaaagcgtttctttaccctaagatattagatgggccaacgaaaggcacacagcccgacagccgccgctgtttcttcatcttcctcgcagcgccggcgctccttcttccgctccctctccgattcgcgctcggcacgcaggcgacggcggcggagctcgtgctcgggctctcaacgacggcgggcagtcccagactcggtgtcggcggcagaggacccccttccgactgacaccaatcgcctcgcgccctcgcctacggtcctccgcacaacgaccggcgccctgcgagcacgcctcccgctcccctcctggctccgacggaccgtcgacgacggtcggacccggaggctgcactgcgcgccgcgagcgaccggcgaacagacgggagccagtagccgagccgatttggtagcgcttatacccccaaatgaatcctgaccgaccgcttagctcttcagatgcgctgaagcgagcgcttagtgacgatttttggaaccctgatagttgagaggatgacataccaactggcatatgtggtaaccctattgcagagatatattctatgctcgcgatgtcaggtatcctgaattaagttcgcactatctactttattgcaggctggan

SEQ ID NO: 25529 - DNA, 567 bp, Zea mays
  misc_feature: Ceres CLONE 1397458-F
  misc_feature (211)..(211): n is a, c, t, g, unknown, or other
  misc_feature (217)..(217): n is a, c, t, g, unknown, or other
aaagctggagctccccgcggtggcggccgctctatcactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgnttcaantcaaagcttaattaggctccctctacatctgatccagctaagtagctagccagcactaaccgaaggggcggggcgaaaaaaccccgggaaagaaaaatacagggggtttatttacttatttccgggcaaaaaagggccaaattggagaaatgggggggccttccgggggccacccccatggggaatccccccccggctttccggggggaacccaaaacccctttttaggggggggaccccacccccccggggggggggaaaaaagggggtaagcaaatattctctggggggcccccccccggcccccccggggggggggggccccccccaaacaaagggggggggggccc

SEQ ID NO: 25530 - DNA, 690 bp, Zea mays
  misc_feature: Ceres CLONE 1397461-F
aaagctggagctccccgcggtggcggccgctctagaactagtggatcccccgggctgcaggaattcgcacgagaccattacctagaacatcctaatcgaaaaatcgatcgtattagtgagaccgaccattcacatagaacgtgaatactgtgtactaccaacgcgagtgccactgtgccgcatctgtctgctccccgttactgtctgcatgtgctcgatcaaagcttaattatgctccctcgatctctgattcctataagtacccttcctccactacacatcgcagcggcaagaatcacgagatagataaaaccggttctacctacctcagctcccgccacgaaaactgagcggaattgttaccaacatgcacgcttgcgtctcccgatgctcatcctcctcatgtacatcatcgacctcggctgcatcgagttggaacctgaaccacttcatcaagagtacaccaactaccccgagcgtggccggctgcgctgcgacgtctacttcctggcgtccccccccgaccagcttgatggaagtctgcttctaattggcgagaacgcaactacgattcagctgcgacaccattctccgtactctcaggaagagtcatctcttccattctagcaactgcctacgctgaaccctcgctgtgaccttggcaggagctcctattaccatttacaccgg

SEQ ID NO: 25531 - DNA, 687 bp, Zea mays
  misc_feature: Ceres CLONE 1397465-F
  misc_feature: Encodes the peptide sequence at SEQ ID NO. 25532
  misc_feature (670)..(670): n is a, c, t, g, unknown, or other
caaagctggagctccccgcggtggcggccgctctagaactagtggatcccccgggctgcaggaattcgcacgagaccatttacctagaacatcctaatcgaaaatcaagccaacagcttccgaaaagtttccgaaagctccttcagatctgttggttaatggatacactcatcctgtacctatgtctactgctggctggccaaccaatgctagtttagtgcctgttcagagcactggatcaatgactgcaactggttggccacccaatggtgggtcaaatgcttttccaagtactgcatctctatcagctgctggtaattacaacattaaccagtcgcttcccaggtcttccgttggttgggctgtcaatggtgagcaaagtgttatttcctagcattgctccaagatttgaactcgtgcagcctgttgaagagcctgtttccagctggacaagcagtggtgcacagcatgttggtactcagcacaagcacacaggtttaactttcccagatgttatgtctgaaccacttgtatctgcatcaatggttcaacgtttcagtagcactgattattcgaaatttctcagtgaacaagaaatgctcttagtgaatggactgaatactgtcaacttaactggaaatggctatttaaagcagagactgcacctaanatttgagtgtttaaggt

SEQ ID NO: 25532 - protein, 70 aa, Zea mays
  misc_feature: Ceres CLONE 1397465-F
MSTAGWPTNASLVPVQSTGSMTATGWPPNGGSNAFPSTASLSAAGNYNINQSLPRSSVGWAVNGEQSVIS

SEQ ID NO: 25533 - DNA, 682 bp, Zea mays
  misc_feature: Ceres CLONE 1397468-F
  misc_feature: Encodes the peptide sequence at SEQ ID NO. 25534
gctctagaactagtggatcccccgggctgcaggaattcgcacgagaccattacctagaacatcctaatcgaaaattccctccctccactcgcgtccaaattctctcctcaccacaccacctctccctccgacgcacgggtgcatcgcagtgctagatagagtgaccatgcaggcggcggcggtgacggtgaatggcgcgggcgacgtgcagaagccccagcagcagccgatggtggtgggggcgccgccgccggcggccatggtgccgccccattgggttgccataccgatgccgccgcacccgatggcgccgccccagttcgcggcggctcaattcgtgccgttccacgccgtcgtgcagtcgccgcagctggcggcacctgtgccagcggtcgtcctgggatcgccggcgccgcatcaggccggggcaggaggagaacagaccatctgggggtcggtgatctccatttcctggatggacgagaattatctgcacaacttgcttcggtacaccccgggggaggtttgtggcaatttaaaggttatccgggaataagcagaaacgggacagcctggaaggaatacggcatttgcgtggacgttccaccggccatgctggcaccctgaaaaggggttgcttggagagggctctttcggggttcattttttttcgcccacccct

SEQ ID NO: 25534 - protein, 129 aa, Zea mays
  misc_feature: Ceres CLONE 1397468-F
MQAAAVTVNGAGDVQKPQQQPMVVGAPPPAAMVPPHWVAIPMPPHPMAPPQFAAAQFVPFHAVVQSPQLAAPVPAVVLGSPAPHQAGAGGEQTIWGSVISISWMDENYLHNLLRYTPGEVCGNLKVIRE

SEQ ID NO: 25535 - DNA, 687 bp, Zea mays
  misc_feature: Ceres CLONE 1397469-F
  misc_feature (203)..(203): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (480)..(480): n is a, c, t, g, unknown, or other
  misc_feature (538)..(538): n is a, c, t, g, unknown, or other
  misc_feature (545)..(545): n is a, c, t, g, unknown, or other
  misc_feature (572)..(572): n is a, c, t, g, unknown, or other
  misc_feature (573)..(573): n is a, c, t, g, unknown, or other
  misc_feature (620)..(620): n is a, c, t, g, unknown, or other
  misc_feature (655)..(655): n is a, c, t, g, unknown, or other
  misc_feature (658)..(658): n is a, c, t, g, unknown, or other
  misc_feature (659)..(659): n is a, c, t, g, unknown, or other
cgcggtggcggccgctctagaactagtggatcccccgggctgcaggaattcgcacgagaccattacctagaacatcctaatcgaaaacttcccctctctcgcccctcctccctccgtctcgtctcccaggtcatggcaaaagctggagcaccgggaaaaataacaagtgggagataaacaggaagagctaggtgaatacttgngagaaaaaggtcccccacaccccccacgcaggtgaatactacaagtagcagtacaaggaagagagccaatctgcccgtgactgccagtgagttgctcgggtgtggtggttagttgaggtcacgatgatgggaggcgggctgatgatggatcagagcgctgttccctggcgtccacaacttcgtggatctcctgcagcagaacggcgacaagaacctgggcttcgcctcactcatgccgcagacgtcctccggcgacagtgcggatgggnnnnaaggntgatctcgtggacccaccgccagacagcttcccggacggccgtggaggacgacagcgnatgaccnacgttgagggacttcgagggagctggnnagcgccgcatgtggcgcgaccgcatgaagctgaaagcggctcagggnagctgcagcagagccggcggcaagatccatggggntannaaggggggggggggcccctggcccgacg

SEQ ID NO: 25536 - DNA, 679 bp, Zea mays
  misc_feature: Ceres CLONE 1397471-F
  misc_feature: Encodes the peptide sequence at SEQ ID NO. 25537
  misc_feature (256)..(256): n is a, c, t, g, unknown, or other
  misc_feature (270)..(270): n is a, c, t, g, unknown, or other
  misc_feature (347)..(347): n is a, c, t, g, unknown, or other
  misc_feature (387)..(387): n is a, c, t, g, unknown, or other
  misc_feature (404)..(404): n is a, c, t, g, unknown, or other
  misc_feature (409)..(409): n is a, c, t, g, unknown, or other
  misc_feature (431)..(431): n is a, c, t, g, unknown, or other
  misc_feature (470)..(470): n is a, c, t, g, unknown, or other
  misc_feature (494)..(494): n is a, c, t, g, unknown, or other
  misc_feature (534)..(534): n is a, c, t, g, unknown, or other
  misc_feature (608)..(608): n is a, c, t, g, unknown, or other
aaagctggagctccccgcggtggcggccgctctagaactagtggatcccccgggctgcaggaattcgcacgagaccattacctagaacatcctaatcaaaaacctcctctgcctgccgcttctcctgctgcgggcggtcacggctgcaagtactagaggaggacatccgcttccattactgcgcctgcggaggatcggaggaaccagtagcggaggcttcgattttcggcgggcgcaataaatttcccgcatgggnctcggagggccgcngtcctcgctcgtctcccgctgcctccctggcgagggcccctggccggcgcgccgccccgctgcccccctctgcgctngcgcaggacagtggcctgcagatgggatgcacaggctggntgccaggtgtcccttcnaaggntcagcactggcagcagcagtangaagagcccatcaacgccgtcagtccatggtgaactacnacaaagcttcctcattaatgggcnaccttttggtggattccgccatccgggaagacctttcccnactctggaccctcgtaacaaggggaaggtgatttgctccatgggggctgaaggtgggacgcaaaggaacataancccgttgcagtagctgccggctccgcaaggcttttttgaatgaggggccatggggccgaagatgacgtcct

SEQ ID NO: 25537 - protein, 35 aa, Zea mays
  misc_feature: Ceres CLONE 1397471-F
  misc_feature (5)..(5): Xaa is any aa, unknown, or other
  misc_feature (13)..(13): Xaa is any aa, unknown, or other
  misc_feature (26)..(26): Xaa is any aa, unknown, or other
MVNYXKASSLMGXLLVDSAIREDLSXLWTLVTRGR

SEQ ID NO: 25538 - DNA, 705 bp, Zea mays
  misc_feature: Ceres CLONE 1397473-F
  misc_feature: Encodes the peptide sequence at SEQ ID NO. 25539
gctcataactagtggatcccccgggctgcaggaattcgcacgagaccattacctagaacatcctaaacaaaaaagagctatggaccattctcataccgcaggagacatcgaccacaactgtgacggtcgtgttcggcaccactctggctgcactgaagaacgagacatctccacggcacagaacgttatgatatgccccacatattccaccggccctatcgctgatccgggggaccagcatatacgatcagtcgacctgaactttacgtgccaacgcagctcaccggtgggactacactgaccactgctccgtccacgacggaggaaggtccccatgactacatcattgaggacgatctagcatgtcggaagcacaaagaagcgcccccctggtggtcacgtacaagtgcggatagaaaccatccctgatatcccttttggcttcctcgttctagtagattaggatttcttttctgacacttcgattcttaccaatccccctgggctgctgctttcctgacaatcgaccagatccccagtcttgctccctgcagtcctccctcctccatctccagcgctgtgctctgactcacctgcaccaatggctgttctttctgctgctggtgctcccccggactcaggtatcgggattgagggctatgagaagcgccttgagatcacattctctgaggcacctgtctttgt

SEQ ID NO: 25539 - protein, 34 aa, Zea mays
  misc_feature: Ceres CLONE 1397473-F
  misc_feature: SWISSPROT Homolog: EC 4.1.1.50 Adenosylmethionine decarboxylase
MAVLSAAGAPPDSGIGIEGYEKRLEITFSEAPVF

SEQ ID NO: 25540 - DNA, 499 bp, Zea mays
  misc_feature: Ceres CLONE 1397475-F
  misc_feature: Encodes the peptide sequence at SEQ ID NO. 25541
  misc_feature (253)..(253): n is a, c, t, g, unknown, or other
  misc_feature (322)..(322): n is a, c, t, g, unknown, or other
  misc_feature (434)..(434): n is a, c, t, g, unknown, or other
aagctggagctccccgcggtggcggccgctctagatctagtggatcccccgggctgcaggaattcgcacgagaccattacctagaacatcctaatcgaaaaatcgcacatattattgagaccaactagcaacatagaaagcacaatagtgtaccaacaatggcagccaaaatattttgcctccttatgctccttggtctttctgcaagtgctgctacggcgaccattttcccgcaattggctcgcaagctccntatagcttcccttcttccccgtacctctcaccagcgggtgtctttcggtatgtgaaaaccccattcttncaaccctacagggatcccaacaaggcaatcacaggctggaatctttacctttatcaacctttggttcttcccaaaaaaattaattttagccccctaattaaaccctctccgntttcaccccttgtgggggggggcattttttaatgggggggccaaaaaaaaaaaatattctggggg

SEQ ID NO: 25541 - protein, 49 aa, Zea mays
  misc_feature: Ceres CLONE 1397475-F
  misc_feature (32)..(32): Xaa is any aa, unknown, or other
MAAKIFCLLMLLGLSASAATATIFPQLARKLXIASLLPRTSHQRVSFGM

SEQ ID NO: 25542 - DNA, 649 bp, Zea mays
  misc_feature: Ceres CLONE 1397478-F
  misc_feature: Encodes the peptide sequence at SEQ ID NO. 25543
  misc_feature (271)..(271): n is a, c, t, g, unknown, or other
gctctagaactagtggatcccccgggctgcaggaattcgcacgagaccattacctagaacatcctaatcaaaaacatgccacattgccaccaagccacagttccacctttcgattcatgcacgctcagtcatgggcgccctccggagtttagccatctcctacccggagttcctcgtggccgggctgtgcttcgtctccctctcggcctgcgcacgcgatgcgtgagcggcggcaacgcgcccccctgagctggcctgtggtgggcatggnctcccgttcgtgctcgcgaacctcgggcgcctctacgacgccatcaccgacgccctccacgggtccgggtgcacgctcttgttcccgcggggcgtggctcggcccgcgcggactccctgctgacgtgcgaccccggcggccggccagaactggcctgcggccaaacccggggggcttacgaaagggggccgagaattttgggggaggagggtcgcacctcctgggcgacagggctggctggttttcggacccccccccggcctgggggggcccccaaagggaaaagtttcaccgccccggtgttttgggaaacccccgaggagtgtcggggtcccttcgatccatatgggcccccccgggcgacgccctaatacgacc

SEQ ID NO: 25543 - protein, 31 aa, Zea mays
  misc_feature: Ceres CLONE 1397478-F
MGALRSLAISYPEFLVAGLCFVSLSACARDA

SEQ ID NO: 25544 - DNA, 666 bp, Zea mays
  misc_feature: Ceres CLONE 1397491-F
  misc_feature: Translation starting site: 183
  misc_feature (388)..(388): n is a, c, t, g, unknown, or other
  misc_feature (472)..(472): n is a, c, t, g, unknown, or other
  misc_feature (623)..(623): n is a, c, t, g, unknown, or other
cgcggtggcggccgctctagaactagtggatcccccgggctgcaggaattcgcacgagaccattacctagaacatcctaatcaaaaacaagaggtggccgccgcagtccgcaccccctccccaatcacgccacccgacaccgcgctccgcagattcgtagtcgccgctaggcttccggcgagatggacgtggtgaaggcggcgcagttgtcggggcggacgctggaacgggtagtggtgcatcccttggtgctgctcagcatcgtcgaccactacaaccgcgtcgcccgcgacacccgcaagcgcgtcgtcggcgtcctcctcggcacctcatcccgcgggtccgtcgatgtcaccaactcctacgccgtgccgtttgaggaggatgnacaaggatcctaggatctggttccttgaccacaattaccacgagtcaatgttctccatgttcaagaggattaatgccaaggagncatggttgttggctggtacagcactggcccaaaactaagggagaccggacttggatgtccatgcattatcccaacagttatggtcctaatccagtcttggggggaattattgatgtccaacccaagggagctgggtataccgaccaagcgnactaaggctggggggaagggagggttaaagagaatgcaactca

SEQ ID NO: 25545 - DNA, 685 bp, Zea mays
  misc_feature: Ceres CLONE 1397492-F
  misc_feature: Encodes the peptide sequence at SEQ ID NO. 25546
  misc_feature (362)..(362): n is a, c, t, g, unknown, or other
  misc_feature (375)..(375): n is a, c, t, g, unknown, or other
  misc_feature (450)..(450): n is a, c, t, g, unknown, or other
aaagctggagctccccgcggtggcggccgctctagaactagtggatcccccgggctgcagcaattcgcacgagaccattacctagaacatcctaatcgaaaaaccgcatacaccgctgcccgcgcgcagccgcgcaggtgcatctgcgccgccgccggcccgccgcacccgcacgtctccttatacccatccggccatctacacacggcagtccacgctcgtggcaccgcactcactccgaatcctgaagcaacaaacaccagaagcgcaccaactccccaaccaccggagaccgcaccccagcaaaggatgtcatctgactccacggccgccgtgacggtggacggcagcgcgcttgcggncgccgcgctgggnccgcggcgggcacgcggcacatggttcgggggtggtgggcatccccgtcacctccctcgcgtcccgtgccgccgncggccggggtccgcttcctcgctttccgcaacgagcagtccgcggggtacgccgccgccgcctacggcttcctcacgggctccccgggcgccctactcaccgtctccggcccaggatgcgtccacggggctcgcgggcctctcccacgccaccgccaacgcctggccgctcctcatggatctcgggatcctgcgatcaggctgacgccgggcaggggcgacttccaggagctcga

SEQ ID NO: 25546 - protein, 96 aa, Zea mays
  misc_feature: Ceres CLONE 1397492-F
  misc_feature: SWISSPROT Homolog: EC 4.1.1.8 Oxalyl-CoA decarboxylase
  misc_feature (19)..(19): Xaa is any aa, unknown, or other
MVRGWWASPSPPSRPVPPXAGVRFLAFRNEQSAGYAAAAYGFLTGSPGALLTVSGPGCVHGARGPLPRHRQRLAAPHGSRDPAIRLTPGRGDFQEL

SEQ ID NO: 25547 - DNA, 708 bp, Zea mays
  misc_feature: Ceres CLONE 1397493-F
  misc_feature: Translation starting site: 199
  misc_feature: SWISSPROT Homolog: EC 4.4.1.5 Lactoylglutathione lyase
  misc_feature (517)..(517): n is a, c, t, g, unknown, or other
  misc_feature (588)..(588): n is a, c, t, g, unknown, or other
  misc_feature (607)..(607): n is a, c, t, g, unknown, or other
  misc_feature (665)..(665): n is a, c, t, g, unknown, or other
  misc_feature (666)..(666): n is a, c, t, g, unknown, or other
caaagctggagctccccgcggtggcggccgctctagaactagtggatcccccgggctgcaggaattcgcacgagaccattacctagaacatcctaatcgaaaaatcaaccaaaccctctaatccatttcggcatttccaacgccttcgccctaccagccacgtcgcttcgaggccgatcgaccgagcagctggtggcaatggcggcggcggcggaggtcgtgctgctggacttctgggtgagccccttcgggcagcgctgccggatcgcgctggcggagaagggcgtggcctacgagtaccgcgagcaggacctcctggacaagggcgagctgctcctccgctccaaccccatccacaagaagatccccgtcctgctccacgccggcaggcccgtctgcgagtcgctcgtcatcctccagtacatcgacgaggcctggccggacgtcgcgccgctcctccccaaggacgacccctacgcccgcgcgcaggcgcgtttctgggccgattacatcgacnagaagatctatgacagccagactcgggctgtggaagttcgagggcgaggcgcgggagcaggcgaagaaggnccctggtggaggcctggangaaccctgggagggggagctcgccgacaagccctttcttcggcggcggcgccctccgnntttcgtggaacgtggctctggttgccttttcacgtcctggtt

SEQ ID NO: 25548 - DNA, 677 bp, Zea mays
  misc_feature: Ceres CLONE 1397494-F
  misc_feature: Encodes the peptide sequence at SEQ ID NO. 25549
aagctggagctccccgcggtggcggccgctctttcacagaggatcccccgggctgcaggaattcgcacgagaccattacctagaacatcctaatcgaaaacccactctccctttccactctcacgctcccactccccccctaccggctaccctacccatcacacacaaacagccactcctcacctcccccgtcctccggttcatgtcctgctgctccccatgtcgcccccactcgacctcgactacataggcctctcgccggcggcggctgccgccgctgcccacgacgacctgaagggtaccgagctccgccttggactgccggggtccggttcgccggaccgccgtgttgtggctgccaccgcaaccaccctggatctgctcccggctaagggagccaagcgcggattttctgacgaggcgccgacgccatcgcccggtgcagcttccggaaagggaaagaaggtagcggaagaggaggacgacaataaggttgcagcgacgccgcagccggtcgcaaaagttcaggtggtgggatggccaccaatccgaagctaccgcaagaacacgatgtctaccacccagctgaagggcaccaaggaggatgctgaggtcaagcaggaccaggggctcctgtacgtcaaggtccgcatggatggcgcgccgtacctcaggaa

SEQ ID NO: 25549 - protein, 152 aa, Zea mays
  misc_feature: Ceres CLONE 1397494-F
  misc_feature (24)..(152): Pfam Name: AUX_IAA Pfam Description: AUX/IAA family
MSPPLDLDYIGLSPAAAAAAAHDDLKGTELRLGLPGSGSPDRRVVAATATTLDLLPAKGAKRGFSDEAPTPSPGAASGKGKKVAEEEDDNKVAATPQPVAKVQVVGWPPIRSYRKNTMSTTQLKGTKEDAEVKQDQGLLYVKVRMDGAPYLR

SEQ ID NO: 25550 - DNA, 669 bp, Zea mays
  misc_feature: Ceres CLONE 1397499-F
  misc_feature: Encodes the peptide sequence at SEQ ID NO. 25551
  misc_feature (646)..(646): n is a, c, t, g, unknown, or other
  misc_feature (647)..(647): n is a, c, t, g, unknown, or other
cgcggtggcggccgctctagaactagtggatcccccgggctgcaggaattcgcacgagaccattacctagaacatcctaatcaaaaatcgagctgagctgagcatcatggggtagtgtgtgtgtgaggcgatagagaagctagtgctcataaccaaccaccactcagtcctcctcctctaccctttcccttccgccgcgttcctacttggtcctagagggagagagatctcgaactccaagggcgcatgctccggttgctagctacgatgccgtgtgcgtagctgcggcagcccttgatcgatcaatcgatcgcttgtgcggaatgagccggatcgagtggagtcagctagctagatactccgtggtcgtcgtcgtcgttggacgtacgccagaagagggagctagagaagaataccgtacagctgcttccaacatggcagctgcctcgtctgcccacctgttcggactcggcgacgggcagatgcagatgcagccgcagcagcagcaggcgccgcctcctcctcttgtgaacaacccggccgcgccgccgcccaaagaagaagcggaaccaacccggtaaccaacctttgaagcggcggaggtgatcgcgctttccccaagacgtgaggggacgaaaaaacggtnntggggggggggggtggggaaaa

SEQ ID NO: 25551 - protein, 85 aa, Zea mays
  misc_feature: Ceres CLONE 1397499-F
MSRIEWSQLARYSVVVVVVGRTPEEGAREEYRTAASNMAAASSAHLFGLGDGQMQMQPQQQQAPPPPLVNNPAAPPPKEEAEPTR

SEQ ID NO: 25552 - DNA, 686 bp, Zea mays
  misc_feature: Ceres CLONE 1397505-F
  misc_feature: Encodes the peptide sequence at SEQ ID NO. 25553
  misc_feature (686)..(686): n is a, c, t, g, unknown, or other
aaagctggagctccccgcggtggcggccgctctatcactagtggatcccccgggctgcaggaattcgcacgagaccattacctagaacatcctaatcgaaaaatcatcaactgatcaaacagagacaaacctatactgctacatgcataatggttggtacatggtaaaactatagcaagctaaggtcgatcgctcgtctatagctagaccactaccacctccatggtttcttgactgatagatagacggacgagaatgaagaagctagctagctactagatatatcatcagtagagtgttcagttgttgatgatggcctcctccttgcccctggtcaccactgggctgcgccatcctcctcctccgcagcagtcgccgagggtggtcctgcagagcgaggacccgaccgagtggtgcgcgtgggcgcaccaggggcaccgcctgtgggtggccatgccggactccttctgggtgtacacgtacaaggtggaccggtgcccgttccggggcaaccacgtgtggacgacgtgcccgtacgcgcactggggggagcgcgcgcgccgccgcgaccccagccgctacgcgtacgccgccgcgacgtgcccggactacgccgactccaagcgccggaaccgcctggccgggtccaccgcgccccccacctgcgcgcgcggcctccgctgcgn

SEQ ID NO: 25553 - protein, 125 aa, Zea mays
  misc_feature: Ceres CLONE 1397505-F
MMASSLPLVTTGLRHPPPPQQSPRVVLQSEDPTEWCAWAHQGHRLWVAMPDSFWVYTYKVDRCPFRGNHVWTTCPYAHWGERARRRDPSRYAYAAATCPDYADSKRRNRLAGSTAPPTCARGLRC

SEQ ID NO: 25554 - DNA, 696 bp, Zea mays
  misc_feature: Ceres CLONE 1397506-F
  misc_feature (410)..(410): n is a, c, t, g, unknown, or other
  misc_feature (428)..(428): n is a, c, t, g, unknown, or other
  misc_feature (650)..(650): n is a, c, t, g, unknown, or other
aaagctggagctccccgcggtggcggccgctctagaactagtggatcccccgggctgcaggaattcgcacgagaccattacctagaacatcctaatcgaaaatcagcatctcgcgcttcagatctcgcccaccgatctggaactggaattccctcccgatctgtatgtatctcacgcacgcttgctcgcgttcttggctttgctcccacctctctctagcagagtaacagtctagcagagcaagcatgtcgtcgtcggcggagaacgaccccacggtgacggtgaccgagcgcggaggcaaggacaagcacgaggacggcggcgacaaggagcagggcggcggcggcttcatcgacaaggtgaaggacttcatccacgacatcggcgaaaaatacggaggagggtcgtcngggttcggcaagcccacnggccgacgtgtgcggcatccacatcccgcacatcagcctccaccgcgccgacctcggtcgtggacgtgctcatcaagaacccgaacccggtcccgatcccgctcgtggacatcgactacctcatcgacagcgacggcgcaagcctggtgtcgggcctcatcccggacgccggcaccatccacgcgcacggccaggagaccgtcaaggaatcccggtgtcgcntcgtcttcgacgacatcaagagcacctacaaggacatccagccggg

SEQ ID NO: 25555 - DNA, 737 bp, Zea mays
  misc_feature: Ceres CLONE 1397508-F
ccccgcggtggcggccgctcttcactagtggatcccccgggctgcaggatttcgcacgagaccattacctagaacatcctaatcgaaaagaatacaccacccctcgtctccccacggaggccgccctctcctctcctctgcgtccgccactggccaccggtcgcccgcgcgcgctccattacctcggcgggcgatggccgacctatccaacaccggctccacctaacacgagcagtgcccccgcctaagcggcagctggctggtcggtcgtcgagcagctagcggcggcagcgcccggagggaggacgtctcactctcctcatcggggcggcatggagatggaggacatcgtgggcgtccgcgcgccgacgcgtggacgagcctggtccggactctagaagccgccgcgcgccggttgccgcgccagagtcccgacggcgacgctcgcggccgcgggggacaggccgcggaggctgtggctgctggtggccgatacgcggaggtgcgcgtatcctgccctccgttgcgccgcgcaatctgcaggcgaaaccggaaaggaccactactctgctgatgacgctctcatactacaggataagaaaatgtgcaccaccccacccccacccaacaggaactgatgcactggtaacttctttggagcgagatgatatgtcacacagctatagctctttacatgttggatatatattagtaatacgacaggcatgtcaacactc

SEQ ID NO: 25556 - DNA, 656 bp, Zea mays
  misc_feature: Ceres CLONE 1397510-F
  misc_feature: Encodes the peptide sequence at SEQ ID NO. 25557
  misc_feature (605)..(605): n is a, c, t, g, unknown, or other
  misc_feature (617)..(617): n is a, c, t, g, unknown, or other
tggcggccgctctagaactagtggatcccccgggctgcaggaattcgcacgagaccattacctagaacatcctaatcgaaaaaaactcgattgcagctcgtgcaccacacacggacacgaatcctcctccggtcctccctctgggaaaccaggactacctcggatcagatgcagtgcctaccctgcggaccgtccaccaacgcgcccgctgcgcatgccgcggccaggagcgtcagccgtcggagggttgtcgtcgagggcgtcacctcggcaacccacgacagcgaggaagcgcctccaaggtcaatgagggcaacaggtgaccgtggtgcaatgtcaggcaaaaccttatggctcgtgtcaaagaggaagcttattgctttgtcagccttttgtcttagcttacattcttcaaggtactttccagcatttgctttgggtgatacgtctgtcaaaatcgaggatgtgactcctaagatttttccatctgggccattatttccaactgagaaacggattgcagagctatttgaaataaatacttactcagttgtgaacatttttgatgcaacactacggccgcagttaatggttaactggggggntgtggaatcccnaaaagaaaaaagggttttgggggtggaagggggggaaaa

SEQ ID NO: 25557 - protein, 116 aa, Zea mays
  misc_feature: Ceres CLONE 1397510-F
  misc_feature (100)..(100): Xaa is any aa, unknown, or other
  misc_feature (104)..(104): Xaa is any aa, unknown, or other
MRATGDRGAMSGKTLWLVSKRKLIALSAFCLSLHSSRYFPAFALGDTSVKIEDVTPKIFPSGPLFPTEKRIAELFEINTYSVVNIFDATLRPQLMVNWGXVESXKEKRVLGVEGGE

SEQ ID NO: 25558 - DNA, 696 bp, Zea mays
  misc_feature: Ceres CLONE 1397514-F
  misc_feature (461)..(461): n is a, c, t, g, unknown, or other
  misc_feature (507)..(507): n is a, c, t, g, unknown, or other
  misc_feature (533)..(533): n is a, c, t, g, unknown, or other
  misc_feature (534)..(534): n is a, c, t, g, unknown, or other
  misc_feature (540)..(540): n is a, c, t, g, unknown, or other
  misc_feature (546)..(546): n is a, c, t, g, unknown, or other
  misc_feature (549)..(549): n is a, c, t, g, unknown, or other
  misc_feature (678)..(678): n is a, c, t, g, unknown, or other
aaagctggagctccccgcggtggcggccgctctagaactagtggatcccccgggctgcaggaattcgcacgagaccattacctagaacatcctaatcgaaaaaatctctctcttctcctcgcctcgccttggtgttcacgccgtcgctagcgcctgccgcggcgaagcttctgccctccccggcgccaggctcgggtcgtcgtcggccaggcagctgctacgcgtgaacacggtcacaccagtacggcagtaccacgcgacgtgaacggtgaactcgtgaagaacagagccgccactgaggaaaccctagcgacggcggcgtgctaccggtgacattgtccccctcggcccctccatccctgacgcagcggcgccagcctgcaggaagccagcccctattcgagacaaggtcgatctttgctgccttggcgagcttcagccgaatcaaggtcgagcatggncggcaggcagtaaatagagcaacacaaaacccttcaaattaatggnagactctgcagaaaccccgacccggnncgcacncacagnggncacttccccatcgcatccgccctcgtcgtcccttgaagctgggaagcccaggggcgcaccgaacatgcgcaatcagtggtcccatctgagggcgcccaagaaaaagggttggcccccctttttagaagncggcccaccgctcccggt

SEQ ID NO: 25559 - DNA, 763 bp, Zea mays
  misc_feature: Ceres CLONE 1397518-F
  misc_feature: Encodes the peptide sequence at SEQ ID NO. 25560
  misc_feature (21)..(21): n is a, c, t, g, unknown, or other
  misc_feature (22)..(22): n is a, c, t, g, unknown, or other
gggggggggggcccccccgcnncacacccacaacccccaacaccaacgccccccccccccctactggagctccccgcggtggcggccgctctagaactagtggatcccccgggctgcaggaattcgcacgagaccattacctagaacatcctaatcgaaaaaggaagccaccgaaggagagaattggatagcagagagtttgcgtgtggaagcacagatggggtccggcatgagccgcggccggcggcgcggtttcggcgcaggggcgtcgggagggatgctgccactgctggcgcttcaggttctgatcgagcacggtcgcgcgggcgcctctcggccgcccgtgacggcggtgttgctcgccgtgaacgcgctcatctatctccgtcccggggcgatcgacgggatcctgccctctgtcacacgcggctccttcaatccgcggctcatcgtcgagaatggcgacttggtgcgcttcttgttgtcaccattctaccatttgagggaaaggcacctgttctacaatatgacatcgctccctatggaaaggctattccgcttcggaaacacccatgccccagggggccaagttcggcctcccccgggctggttgggatggagttggggggggaaacaagggcactcggcggggattccttggcacaaatgggcgtaggtacggcgggctgggggggggtttaaacccgcgcgtaaccaaaaccaccctctaccggccgcgatgagcgcttccctcaccccgcgg

SEQ ID NO: 25560 - protein, 152 aa, Zea mays
  misc_feature: Ceres CLONE 1397518-F
MGSGMSRGRRRGFGAGASGGMLPLLALQVLIEHGRAGASRPPVTAVLLAVNALIYLRPGAIDGILPSVTRGSFNPRLIVENGDLVRFLLSPFYHLRERHLFYNMTSLPMERLFRFGNTHAPGGQVRPPPGWLGWSWGGKQGHSAGIPWHKWA

SEQ ID NO: 25561 - DNA, 655 bp, Zea mays
  misc_feature: Ceres CLONE 1397522-R
  misc_feature: Translation starting site: 279
cgattgggtaccgggccccccctcgaggtcgacggtatcgataagcttttttttttttttttttgtaaggcaataccaaagaaaacatccggatcggaggaggcacgtacatacagtggtgaactagaaggaaagaagaagaatcacaaatatgcatggcaactgaagctagtgacgaactagccactagtatatattaggcgcacaggaagccctgagggacgctcttgccgcagtagttgaggagcagggtgagcttgacggggacgtcgaggttgatgccgagcacgttggccttgagcgcggtgcagaggcagacggcggcctacaggtcggcgaggccgtccagcagcgggcagcacgagtcggtgggcaccttgccgatggacaccttgacgaggcccagcacgttggcgcacacgcccagtttcagcgcgttcttggggcacttgccgccggagctggacggtggcggagggcacggcgtgctggtgggcgacggcggtggtggcgatggaggaggaggagttggtttcgggcagccgccgcacgccgccacctcgctggccaggaaggcgctggcggcgagcagcaggacgagggccacggccgggaacctcgtcaccgaggccattgctgctgctgctgctagcct

SEQ ID NO: 25562 - DNA, 729 bp, Zea mays
  misc_feature: Ceres CLONE 1397524-F
  misc_feature: Encodes the peptide sequence at SEQ ID NO. 25563
gctctttcacaaatggatcccccgggctgcaggtattcgcacgagaccattacctagaacatcctaatcgaaaaacatcgacccagccatctcctcaccctcgttcaccacacagtccgccactcctttactagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcatgcgtgcgagtggcagtacccaaaggacaccccgcggaaaagggaatgcgagagccagtgccgttagcggcaccaacaacttgaccccggcggaggacggcgaacggcgccgtggacgccctacgtctccccgcttccgggagggggcaaagtggccgtctcccagtgcccggcgccccccccgaaggcccaccccggggggacaaccccagcaatgccttgaggccggttgccacccccccccggaactgggcccctctaaaattggacgaaagaaaacacgcgcccgcgcgacccaaaaaacgccgggccaaagtgacccgcaaaacagagggcgagaaagcccccccccccccccggaacctgttgttaggaaaaagaccccctcctctcctcccataat

SEQ ID NO: 25563 - protein, 68 aa, Zea mays
  misc_feature: Ceres CLONE 1397524-F
MGKGSVGASWWAFLLLAGVLLVVAATAGAEDGVVERDRKEDLRWCKHACEWQYPKDTPRKRECESQCR

SEQ ID NO: 25564 - DNA, 734 bp, Zea mays
  misc_feature: Ceres CLONE 1397531-F
  misc_feature: Encodes the peptide sequence at SEQ ID NO. 25565
aagctggagctccccgcggtggcggccgctctataactagtggatcccccgggctgcaggaattcgcacgagaccattacctagaacatcctaatcgaaaaacccaacacccgattgaacatcgtcccacctccaaaccactgactcccttgcctccacctaatgacatacagactgggacggtcttctccgccccgctcgtggccgaggactgcccgtgctgggacatggactaccacacgtccaggtccccctcacacgtaccacgaggggtccgacctcgcgcagcgcggcacacgagcctgtccataccgacctcatcgacaagagaatatcctgctacactagaactcaaaattagacgaccagatccaattatgctcgaccaccgaatcgtgactttctgccggttcaaaccaactgttgagggagagataagcagacgactctcgaatatcaccccttgaatggccatgatcctacaactcatgacagagataactctgaaggatgcagacaagatattatctatcaacatgaattctcctagaccatatattctcaaggaatatgccgctatttctgatggagcattagcatgacgccaccgacaccctacctgctggtcttcaaagtgatcccctcactcatgtcttgcaaaactggctgaatgatctggataggaatacaaatattgcagctgcggcaaggagtaccagggtaactaggattga

SEQ ID NO: 25565 - protein, 44 aa, Zea mays
  misc_feature: Ceres CLONE 1397531-F
MAMILQLMTEITLKDADKILSINMNSPRPYILKEYAAISDGALA

SEQ ID NO: 25566 - DNA, 595 bp, Zea mays
  misc_feature: Ceres CLONE 1397533-F
  misc_feature (312)..(312): n is a, c, t, g, unknown, or other
cgctcttaactagtggatcccccgggctgcaggaattcgcacgagaccattacctagaacatcctaatcgaaaatttctctcaatctctctcttctcctcgcctcgccttggtgttcacgccgtcgctagcgcctgccgcggcgaagcttctgtcctccccggcgccgggctcgggtcgtcgtcggccaggaagatggctggcggcttcagggtactgcatctggtcaggccttttctggctttcttgccagaggtgcagagcgcgcgatagggaagactacctttcagaagaaacaggtatataccctggntatttcccctcttcatttttctggggctggagcccagtttcccacttcttttggggggtttttttttttccaaacaacccggggggggggccccttctttcggggggggggggggtttccccccaaaaaaccggggggattttgggggggggggggttaaaccccccctgggaaacccggggggggggaagagccttttttggggtgggaagaaaattttttgttggccccccccccccgggggaagggtcggccccccctcttttaagggggaaaaacaaaa

SEQ ID NO: 25567 - DNA, 811 bp, Zea mays
  misc_feature: Ceres CLONE 1397534-F
  misc_feature: Encodes the peptide sequence at SEQ ID NO. 25568
  misc_feature (1)..(1): n is a, c, t, g, unknown, or other
ntgccccccccgccccccctaaactataaaagttgaaaatcgaggttcttcaaactggagctccccgcggtggcggccgctctagaactagtggatcccccgggctgcaggaattcgcacgagaccattacctagaacatcctaatcgaaaagaagaaagctgccggcctgccgctgcctgctcgcagttgccagcccccgccgccgcggaggacggaaggaagcgaatcaaccgcgactgtctccgacgggaataaagcaggcgaggccagccggtcgcggaacccccaattctcagctgcggccggcgatcgagtcggttccgtcccgcgccgatgcggatcccgcggcggaagggcggggccgggccgctcgctgtcggggtgcccagcaggcgggcgcaggtcgccgcggtcttcgcgctcgccgcactgctgggggtctccgtgctctacgacaacgcccacatcgccgcctcgctgcggaggcacggcggccccgaggacgtacgccaagctccccctccctttcgaagggggccacccgctagtccccagcatgcgccaaaggaaagaaggcgtccagccggcgcgtcgcccacgcaaaaaaccggaccccctagcccgcctgtcccgccctcggcaatcgatatcaagattacgtccttccgccatcgagcacgcgactggaaatcatgaccgggggcccacagacagcctagacatatccgtgcgccgccgccacgaccaccgatacaagaaatcagaactcacaagagcacctgcgacctgcgcacgtaaacgcatccccg

SEQ ID NO: 25568 - protein, 120 aa, Zea mays
  misc_feature: Ceres CLONE 1397534-F
MRIPRRKGGAGPLAVGVPSRRAQVAAVFALAALLGVSVLYDNAHIAASLRRHGGPEDVRQAPPPFRRGPPASPQHAPKERRRPAGASPTQKTGPPSPPVPPSAIDIKITSFRHRARDWKS

SEQ ID NO: 25569 - DNA, 722 bp, Zea mays
  misc_feature: Ceres CLONE 1397538-F
  misc_feature: Encodes the peptide sequence at SEQ ID NO. 25570
cgctttacaactagtggatcccccgggctgcaggtattcgcacgagaccattacctagaacatcctaatctaaaaatccaacgacccacactgagacgtcccctccccgctccgtcctctctcctctgccgccgagacgacgcgatggcggggtccgccgccttgccgccgctcgccgccttcgcgtcgctccttaccgcgcggcgcttcgccgccgccaggtccaagctccggtccctgctcacgccgcgcctactggcggtgccgttcgcggacctcgccgcctcgtcgctcccgcgcggcgcgccgccgcacgccgtggcggcgttccacgacatgctcttccgcgcgtacgcggacgcgggcgcggagtgccgcgcggacgaggcgctcgacgccgccgtgacccgcctcggcagcctcgacccgcgctcgctcacggtctcgctgctctcgctccgccgcgccgggcgcctcgcggacgccgcgggcctcctggagcggtcgctcggctcgtgcccgagctccgtctcgacgatcgccgcgtccgtcgtcgtcgacgggctctgcaagtcgaggtgcgtggacgacgcgcgccggctgctcgacgatatgcctcgccacggagtgagtctgtatgcgctgtgctacgactcgctgcttgactgttacgggcgacaaacgatgacgggcggatcccaggagatctaagatcatgtaga

SEQ ID NO: 25570 - protein, 188 aa, Zea mays
  misc_feature: Ceres CLONE 1397538-F
MAGSAALPPLAAFASLLTARRFAAARSKLRSLLTPRLLAVPFADLAASSLPRGAPPHAVAAFHDMLFRAYADAGAECRADEALDAAVTRLGSLDPRSLTVSLLSLRRAGRLADAAGLLERSLGSCPSSVSTIAASVVVDGLCKSRCVDDARRLLDDMPRHGVSLYALCYDSLLDCYGRQTMTGGSQEI

SEQ ID NO: 25571 - DNA, 694 bp, Zea mays
  misc_feature: Ceres CLONE 1397547-F
  misc_feature: Encodes the peptide sequence at SEQ ID NO. 25572
  misc_feature (438)..(438): n is a, c, t, g, unknown, or other
  misc_feature (450)..(450): n is a, c, t, g, unknown, or other
  misc_feature (474)..(474): n is a, c, t, g, unknown, or other
  misc_feature (513)..(513): n is a, c, t, g, unknown, or other
aagctggagctccccgcggtggcggccgctctatcactagtggatcccccgggctgcaggaattcgcacgagaccattacctagaacatcctaatcgaaaaaccacagcatccgcagttccccgaccacaccgttcctccgagcccaggagcagccccgcgccaggaggaagtttgttcttttaacaatatgtcgagggaggagaatgtttacatggccaagttggctgagcaggctgaaaggtatgaggagatggttgagtatatggagaaggtggctaagactgtagatgcggaagagctcactgttgaggagcgtaaccttctgtctgttgcatacaagaatgtgattggggctcgccgcgcttcatggcgcattgtttcttccattgaacaaaaggaggagtcccgtaagaacgaagagcatgtgaaccttatncaggaatatcgntggcagatcgaggctgaactgagncatatctgtgatggaatctttgagctgcttgactcccanctagtggcctcttctactgctgctggatcaaaggtcttctacctcaagatgaagggtgactatcacagtattcttgcgaaatttaaaactggtgctgaaagaaagaatcctgttaaaaccaaatgttgcctaatagggtgctcaggaattgcttgggctgactggcaccaacctccaaaag

SEQ ID NO: 25572 - protein, 168 aa, Zea mays
  misc_feature: Ceres CLONE 1397547-F
  misc_feature (3)..(168): Pfam Name: 14-3-3 Pfam Description: 14-3-3 protein
  misc_feature (83)..(83): Xaa is any aa, unknown, or other
  misc_feature (95)..(95): Xaa is any aa, unknown, or other
  misc_feature (108)..(108): Xaa is any aa, unknown, or other
MSREENVYMAKLAEQAERYEEMVEYMEKVAKTVDAEELTVEERNLLSVAYKNVIGARRASWRIVSSIEQKEESRKNEEHVNLXQEYRWQIEAELXHICDGIFELLDSXLVASSTAAGSKVFYLKMKGDYHSILAKFKTGAERKNPVKTKCCLIGCSGIAWADWHQPPK

SEQ ID NO: 25573 - DNA, 666 bp, Zea mays
  misc_feature: Ceres CLONE 1397553-F
  misc_feature: Encodes the peptide sequence at SEQ ID NO. 25574
  misc_feature (429)..(429): n is a, c, t, g, unknown, or other
  misc_feature (507)..(507): n is a, c, t, g, unknown, or other
  misc_feature (543)..(543): n is a, c, t, g, unknown, or other
  misc_feature (548)..(548): n is a, c, t, g, unknown, or other
  misc_feature (560)..(560): n is a, c, t, g, unknown, or other
tccccgcggtggcggccgctctagaactagtggatcccccgggctgcaggaattcgcacgagaccattacctagaacatcctaatcgaaaaactagtaccgccacacgaattcccgaccccgatggcgacatcgccaccgcagaaccctagctccggcgagccctccgatgcgtcgagcctcgcagccgcggcgctcgaggcgcccgtgcgcgtatggagatccctcgtcgcgcgcttccctcccctcccggactcctccagcttccttgctggcgtctccgacctccagctccgctacttcggcaacagccggccccgccgccgcaggcgctccgctctacctctccctctccgcccggtggccgcgcactctgctcggattgctggtgagatgcccaaagcctttgtgatcttagatgatgttgtgncacacaccctgactaatttgcacagtattcacaaaagcttactattttggcaggccaaggctgagggaacaaattctncagaagtgtactttatggatatttgagagaggtccnagggnctttgttgatgncacatatcaaacactcactagactcgggagcaatggacgccctggtccatacattttgcattctgcatcctgatatggtggtcaacaaactcgctgccctgacagt

SEQ ID NO: 25574 - protein, 136 aa, Zea mays
  misc_feature: Ceres CLONE 1397553-F
  misc_feature (103)..(103): Xaa is any aa, unknown, or other
  misc_feature (129)..(129): Xaa is any aa, unknown, or other
MATSPPQNPSSGEPSDASSLAAAALEAPVRVWRSLVARFPPLPDSSSFLAGVSDLQLRYFGNSRPRRRRRSALPLPLRPVAAHSARIAGEMPKAFVILDDVVXHTLTNLHSIHKSLLFWQAKAEGTNSXEVYFMDI

SEQ ID NO: 25575 - DNA, 643 bp, Zea mays
  misc_feature: Ceres CLONE 1397557-F
  misc_feature: Encodes the peptide sequence at SEQ ID NO. 25576
  misc_feature (222)..(222): n is a, c, t, g, unknown, or other
  misc_feature (265)..(265): n is a, c, t, g, unknown, or other
  misc_feature (283)..(283): n is a, c, t, g, unknown, or other
  misc_feature (354)..(354): n is a, c, t, g, unknown, or other
  misc_feature (357)..(357): n is a, c, t, g, unknown, or other
cgcggtggcggccgctctagaactagtggatcccccgggctgcaggaattcgcacgagaccattacctagaacatcctaatcgaaaactctattagaatagccaggggcctcgctcctctccaccacgtactccactccatccatccatcatcgtctatccatgaagagcttgcagggagagagggcggcgttggtgccgtcgccgtgccccagcaacagangaaggacggcggcgagcatgatccggagcagctgatggatgangatgaacgtgaccatgangaggatctgcgagatgagcagccaccagaacaattaggacgtcgaccaagacgcggaagcatcgtcatcancgnaacgggggtggccgcctggggggaaacgcccccgggcgcacaagctgtgccaccacaagggggtgggcctgggcatcgcgggctccccggggttggggtggggcgcgccgccggggggggggggaaaaccaggggggggcggcggggaccccccgacaagagtcgcggggttttgctaaaaaagggggggggagggggggttttaaaaccataaaggggggcctccacacggggccttatcccggaggggggccccgggggcaaaaacctcaggggggggggggaa

SEQ ID NO: 25576 - protein, 31 aa, Zea mays
  misc_feature: Ceres CLONE 1397557-F
  misc_feature (21)..(21): Xaa is any aa, unknown, or other
MKSLQGERAALVPSPCPSNRXRTAASMIRSS

SEQ ID NO: 25577 - DNA, 656 bp, Zea mays
  misc_feature: Ceres CLONE 1397559-F
  misc_feature: Translation starting site: 133
  misc_feature: SWISSPROT Homolog: EC 1.10.3.3 L-ascorbate oxidase
  misc_feature (405)..(405): n is a, c, t, g, unknown, or other
  misc_feature (448)..(448): n is a, c, t, g, unknown, or other
  misc_feature (491)..(491): n is a, c, t, g, unknown, or other
  misc_feature (518)..(518): n is a, c, t, g, unknown, or other
  misc_feature (524)..(524): n is a, c, t, g, unknown, or other
  misc_feature (525)..(525): n is a, c, t, g, unknown, or other
  misc_feature (544)..(544): n is a, c, t, g, unknown, or other
  misc_feature (546)..(546): n is a, c, t, g, unknown, or other
  misc_feature (656)..(656): n is a, c, t, g, unknown, or other
tggagctccccgcggtggcggccgctctagaactagtggatcccccgggctgcaggaattcgcacgagaccattacctagaacatcctaatcgaaaaaatccattcgcgctctcgtttcccggagcttcgcgatgcagcgccttctcgcgctgggggcagccctgctgctggcgtcgcgtccagcgctggccaccgacccctacgccttcttcgactgggacgtctcctacgtcactgcggcgccgctcggcgtcaagcagcaggtgataggcatcaacggcaagttcccagggcccgtcgtggacgtcagcaccaactggaacgtcgtcgtcaacgtgctcaacgacctcgacgagcccctcctcatcacctgtaacgtgatccagcaccggaagaactgctgncatggacgtagtgctctggaccaactgccccatcccgcccgantggtacctgtacgtacgagttccaggtcatggaccagatcggnagcttcttctacttcccctccaccganctgcanncgcgcccgcggaggaatcngnggccatcgtcgtcaacaaccgcgacggtcatcgccgtgaccttccgcccgccccgacggagacatcaccatccccatggggggactggtaacaccagaaccacccggatn

SEQ ID NO: 25578 - DNA, 632 bp, Zea mays
  misc_feature: Ceres CLONE 1397559-R
tcgaggtcgacggtatcgatattttttttttttttttttggagagctcttggagatgctcttagccagttgaagaacaggactacatgaggtgcgatacaaaacgctaagatcggaatcatcaacaaaaggaatgaactaatcagagaaaaaccatggacccttcctaacagaggctaacacacgcacacaatgaaagcgagggagaactgtaccaggcggaggccagcactgctggcatatgaacaattctcataggtaatgacgcggcctacgcctctaatcctaatcaaacatacataaacgggtgccgcctcggtgcagaagtaacggttgccatcactcactctacggcgcgaatacgaaggatccggcgaggagcagcgccgtcgcgagcagccagcgcgctagtgacaccaacgagcgtggcgccgcagcagacgcccccatcttgtggtgcggagtctgctccttctggtacttgtggagctggccgcagtagagagcgttggcggggatggccatctcggtcttgttgccggtgtcctcacggttgacgaccctgaactagacctcctgccccaggacccacgagtccaggttctgggaccgcacgtttccgaacaccgactg

SEQ ID NO: 25579 - DNA, 688 bp, Zea mays
  misc_feature: Ceres CLONE 1397562-F
  misc_feature (211)..(211): n is a, c, t, g, unknown, or other
  misc_feature (240)..(240): n is a, c, t, g, unknown, or other
  misc_feature (264)..(264): n is a, c, t, g, unknown, or other
  misc_feature (284)..(284): n is a, c, t, g, unknown, or other
  misc_feature (285)..(285): n is a, c, t, g, unknown, or other
  misc_feature (295)..(295): n is a, c, t, g, unknown, or other
  misc_feature (308)..(308): n is a, c, t, g, unknown, or other
  misc_feature (315)..(315): n is a, c, t, g, unknown, or other
  misc_feature (660)..(660): n is a, c, t, g, unknown, or other
  misc_feature (661)..(661): n is a, c, t, g, unknown, or other
ccccgcggtggcggccgctctagaactagtggatcccccgggctgcaggaattcgcacgagaccattacctagaacatcctaatcaaaaaggacccttgtttgcctatacgctgccagcctgccttttctaagttcttcttccatcgctccacccccacccccttctctctcgtagcaacgtttggggcgccgtcgctgccgctctactcnggtgcccaggtcttggtcgggcccttccngcgagcaggggacactttcttggnatgagagggatcatgtccanntatatgatgnatacgacgacttngatgagnatgaggtgactatgaaatggatgacccggctgaagaactgaaaaaaacagcgaggggttagggattctgatgcgggggtaatgtttatggccacccatgggcaaatccccaaactttctttcggaaggcgaaaagggggagggttttgggggaacccggggagataaaaaataccccaaaaaaataaccggcccattaaaaccgccacaaatttgggggggccccccctccggaaaaaaattttgggtgttgccccccaaaaagggggggggttttttttttcaaaaaaaaccccccgagaaaacaatcttctccttcttctcacaaaaggggggggggggaccnnggtttcccccaaaaaaaaaaaatgtgg

SEQ ID NO: 25580 - DNA, 670 bp, Zea mays
  misc_feature: Ceres CLONE 1397563-F
  misc_feature: Encodes the peptide sequence at SEQ ID NO. 25581
  misc_feature (524)..(524): n is a, c, t, g, unknown, or other
ggagctccccgcggtggcggccgctctagaactagtggatcccccgggctgcaggaattcgcacgagaccattacctagaacatcctaatcgaaaagacaaccccagcgcacgaactccaaaatagcgagccgaagggggccacgagtcctccacctccctctccgccgcgtcgctcgcgcttgacgcgcgccgagagccgaatcggagccacgaggcagccgccccgggcggatcgatcctagggccagggcatgggcggaggggacgccgacgccggcggcgagcccgcggacgcgcaggccacgctccacatccggtgcaccaacgcctccaagttcaccgtgcgggccgacctgggcgccaccgtcggggcgtttaaggcgatcgtcgccgacagctgcgacgtgccggcgccgcagcagcggctgatctacaagggccggatcttgaaggacgagcaaaccctagccagctacggtgtggagacagaccatacaatccacatgggtacgtggtgctgtngcatcaccaacatctactgcacctgcagccaaccaagaacctaccactgctgctcctgccagttcccggcacaggggattgggtggtttgttgcaaagtctgggtactacagcgtgtgtaaagggagagggggggggggggttttt

SEQ ID NO: 25581 - protein, 139 aa, Zea mays
  misc_feature: Ceres CLONE 1397563-F
  misc_feature (22)..(90): Pfam Name: ubiquitin Pfam Description: Ubiquitin family
  misc_feature (91)..(91): Xaa is any aa, unknown, or other
MGGGDADAGGEPADAQATLHIRCTNASKFTVRADLGATVGAFKAIVADSCDVPAPQQRLIYKGRILKDEQTLASYGVETDHTIHMGTWCCXITNIYCTCSQPRTYHCCSCQFPAQGIGWFVAKSGYYSVCKGRGGGGVF

SEQ ID NO: 25582 - DNA, 669 bp, Zea mays
  misc_feature: Ceres CLONE 1397567-F
  misc_feature (393)..(393): n is a, c, t, g, unknown, or other
  misc_feature (434)..(434): n is a, c, t, g, unknown, or other
tggagctccccgcggtggcggccgctctagaactagtggatcccccgggctgcaggaattcgcacgagaccattacctagaacatcctaatcgaaaaaaaaaataaaaagaaaaaaaataaaaaaaagagaggaaaaggggacaaaccaccaacaacaaccagaatatcgcatcgccgtcgcgtcgtcgtcgatctccccgccccgccccgcccgcgccgcggaatctgacacatctccctaatctctcctaggaccgggtgcccttacatccacgccgcaacgcaaatcgccgtccgagccctcgcggtctctcgtctccccgtgcgagaggacgccggcagcagcggcgtgccagtgcggtggcttggtgggggaagaccggaggcggcgncagagctcgcgcccagaggtgcacggcaggcctgttctcgncgtcggctggggaaaggcgagtaccccccggaaggacgagtgaataatcatgagctcgatctgcccttttgcgggagcaccacttggtggtggtgtatgccctggtgaaatctgataagagcaacactggggggtggcctgcaaaatctgacaagagcatcaggggggtatgccctggtcctggcaaggattcttgttagcaagttccaggaaagggggggatcttgggtgaaaa

SEQ ID NO: 25583 - DNA, 678 bp, Zea mays
  misc_feature: Ceres CLONE 1397568-F
  misc_feature: Translation starting site: 132
tggcggccgctctagaactagtggatcccccgggctgcaggaattcgcacgagaccattacctagaacatcctaatcgaaaaatatataatggtattacccccgtcgtcaaatgcaccgccacccaaccccatggccgccgccaccggaagaaccatgaagacgatggcgctcgtcgtcgtcctcgccgccctcctctgctccatctcggtcgccgctgcagccagcggcggcctttcttcgtacgtggtgtacctcggccagcacgcgcacggcgcggcgctgggcacgcacggcgccgaggagctgcaggcgctgggagcggcgacgccgccgaggcgcactgcgacctccctccgccggcgtcttgggcggagacaagaagaaggcgcggggaggcgatcttctactcgtacacgaagcacatcaacggcttcgcagccaacctggacgccgcaccgccgcccgagattgcgggaaaacccggcgtgaatctctgtgttccccaaccagggccgcaagcggcaccgaccggggtcatggcaggttcgtcggcctggccgggccccggaggcgcccccaacggtgggggggggggggaaggccaagtttcggggccgaaaccataatcgggaacttcaaaccatggggtggtggccggaaagccgggggtttaaga

SEQ ID NO: 25584 - DNA, 669 bp, Zea mays
  misc_feature: Ceres CLONE 1397569-F
  misc_feature: Encodes the peptide sequence at SEQ ID NO. 25585
  misc_feature (542)..(542): n is a, c, t, g, unknown, or other
  misc_feature (574)..(574): n is a, c, t, g, unknown, or other
  misc_feature (627)..(627): n is a, c, t, g, unknown, or other
  misc_feature (669)..(669): n is a, c, t, g, unknown, or other
tggcggccgctctagaactagtggatcccccgggctgcaggaattcgcacgagaccattacctagaacatcctaatcgaaaaaaaaaaaaaaaaaagcttctcgtgccggcttctcgtgccgttttttttttttttttttggaaaatccataggtgaatattgatacaggattcaatggttcacacaaagatcataggaacatacagtgaaaattatcagtgctaccgttcaggaaagcaaatgctaaatctgtttcttggatccgagaaggccggcacatgttcagatgatgatgaaaggtcattcatgaatagaacggaagtatataatgatattcaacttccacactgctttgtccagatcattaaattcagcgcctaccagcccgtcttttactctgcctcctcgccctccgccgcctcaaccgcgacacgggactcttcaagcgccgccgcgacgagcccgctcccgccgtccctgcctccgatctgactcctacacgcgccgaaacagccccattcgcaggaatcacccgtccggnattcactccctcctcaacggccgacgtacggnttcccccgggatgctgctgagcaaaagcttgaaaggcctggcaaaactgtccnacaaaactatagttcagatgacaccaccagtcagctcgagcn

SEQ ID NO: 25585 - protein, 28 aa, Zea mays
  misc_feature: Ceres CLONE 1397569-F
  misc_feature (15)..(15): Xaa is any aa, unknown, or other
MLLSKSLKGLAKLSXKTIVQMTPPVSSS

SEQ ID NO: 25586 - DNA, 679 bp, Zea mays
  misc_feature: Ceres CLONE 1397573-F
  misc_feature: Encodes the peptide sequence at SEQ ID NO. 25587
  misc_feature (679)..(679): n is a, c, t, g, unknown, or other
cgcggtggcggccgctctagaactagtggatcccccgggctgcaggaattcgcacgagaccattacctagaacatcctaatcgaaaaagcggcgaggacgaagtggcccgcccaggaaatggcgtcgatgcagagctggcgcaaggcctacggcgccatcaaggacaccacaaccgttagcctcgccaacctcaactcggacttcaaggatctggatgtggcgatcgtgaaggcgactaatcacgtggagtgcccacccaaggagcgacacctgcgaaaggttgttgcggcgacatccatcgccaggcctagggcggatgtcgcctactgcatccacgcgcttgcccgccgtcttgccaagacccgcaactggattgttgctctgaaagcacttgtagtaatccatagacttcttcggtgagggtgatcctacatttcgagaagagcttcttaactttacacaaagggggcgtattctgcaactttcaaactttaaggatgactccagtccatttgcttgggattgttctggctggggcgaacaatatggtttgtttttgaagaaaaggtgaagggggtttcaaaagttcgaaagtatgatgggaaggattaggcgtttgccaaaaaaagggcaagggtcctggaaaagggtcacagaaaaaccaaaagagtggctttn

SEQ ID NO: 25587 - protein, 100 aa, Zea mays
  misc_feature: Ceres CLONE 1397573-F
MASMQSWRKAYGAIKDTTTVSLANLNSDFKDLDVAIVKATNHVECPPKERHLRKVVAATSIARPRADVAYCIHALARRLAKTRNWIVALKALVVIHRLLR

SEQ ID NO: 25588 - DNA, 599 bp, Zea mays
  misc_feature: Ceres CLONE 1397578-F
  misc_feature: Translation starting site: 156
  misc_feature (252)..(252): n is a, c, t, g, unknown, or other
  misc_feature (253)..(253): n is a, c, t, g, unknown, or other
  misc_feature (267)..(267): n is a, c, t, g, unknown, or other
  misc_feature (287)..(287): n is a, c, t, g, unknown, or other
  misc_feature (352)..(352): n is a, c, t, g, unknown, or other
  misc_feature (386)..(386): n is a, c, t, g, unknown, or other
  misc_feature (402)..(402): n is a, c, t, g, unknown, or other
  misc_feature (403)..(403): n is a, c, t, g, unknown, or other
aaagctggagctccccgcggtggcggccgctctagaactagtggatcccccgggctgcaggaattcgcacgagaccattacctagaacatcctaatcaaaaaaaaatcccaccacccttttccccttccaaccctcgggatctctccggcccgccatggaagtgttctactacctcgtgttcggcgcgctcgccgccatcgtggcggcgctggagctcgccaagtccggcaaggaccgcgtcgccacctccnncggccttcactcantttaagaacaactacatccntcgtttactccctcatgatgtctggggactggctgcaggggccctacgtgtactacctctacagncagtacggctttcgacagggcgacatttggccgnctccttcatcggcggnnttcgggttcctccatggctcttccggaacccatcgttcggattccctcggggaaaaaaaggggcggaaaaaggggggggtacaggattggaatacctaattcccccagtgtggttaccaaggaatttcccccaataaaaagttttttaagatggggcgggggcccttgggggggtttgcccttttcgtgggttttt

SEQ ID NO: 25589 - DNA, 688 bp, Zea mays
  misc_feature: Ceres CLONE 1397581-F
  misc_feature (456)..(456): n is a, c, t, g, unknown, or other
  misc_feature (462)..(462): n is a, c, t, g, unknown, or other
  misc_feature (688)..(688): n is a, c, t, g, unknown, or other
aaagctggagctccccgcggtggcggccgctctagaactagtggatcccccgggctgcaggaattcgcacgagaccattacctagaacatcctaatcgaaaaatttccgtccatttcccaggttctaaccggttcctcaaaccctaaaacctccaaaccccagcaatggcggattccccttcgttccgtcgctacccgatcgcctcctccgtcgacctcgtccgctgggtcccttcctcctccatctccccttccggtcgcctcctcgccgccgccgtccacgatcccacctccggctccttcgcctccagcatccgccttctccccctctccgaccctgtctcccggctcgcctccgtcccgctcccgtcccgcgacacggaactccgctgctcccatgctgcgctcgccgctgccacctcctcgggctcgatccacttcgttccctcctcatgngactcnggaaacgccgcagtgtacgtcacggagaggcgcgacgtttccatagtcggatcctgtccggctactcgactgcggaagtaaacaggagtgggtcacagcagcacgaacacgcaagagtgtatgctggtccgtcggtgatatgtgcacgttagatcgtcacctcaggacgtatgtggtcacggtacatgcaaatgtcagggtatgatccctgccagtaggttgctgn

SEQ ID NO: 25590 - DNA, 714 bp, Zea mays
  misc_feature: Ceres CLONE 1397585-F
  misc_feature: Encodes the peptide sequence at SEQ ID NO. 25591
  misc_feature (472)..(472): n is a, c, t, g, unknown, or other
  misc_feature (587)..(587): n is a, c, t, g, unknown, or other
tcaccgcggtggcggccgctctagaactagtggatcccccgggctgcaggaattcgcacgagaccattacctagaacatcctaatcaaaaaacaccaaagatttcctcttccgcgtgcgcttccctttgccccgctctcccccagcctcgctcgccatataatacgggccggccggccggccagctgggtccccgcggatgggctcggtctcgcgaggctagggtttggtcggtcgtctcgccggcgtcgaggccgccagcgctgctagctagctctctcgcgttagggttccccgtagccatggtgctgcagcgcttctcgtggccgtacggcggccggagcgccaccttctgcggtagcttcaccgggtggagagagtgtcccatggggctggtcggggccgtgttccaggtcgtcttcgatctgccccccggagtttacagtaccggtttttgggtgatggtgtctggnagtgtgatgagacaaaaccctttgtacgtgatgaatatggactggatcagcatgaagtgctgtggaaaacatgtacaaactggtgtgcagccagagccctctatcaaaggactantatggataagggtaccattttgaaaacatggccccggagcatcatctcagaaccagcatggcaatgcagtatcccgcctgggtctctggaatatattcccatcctttttttggcgtggtccccttca

SEQ ID NO: 25591 - protein, 102 aa, Zea mays
  misc_feature: Ceres CLONE 1397585-F
  misc_feature (96)..(96): Xaa is any aa, unknown, or other
MVLQRFSWPYGGRSATFCGSFTGWRECPMGLVGAVFQVVFDLPPGVYSTGFWVMVSGSVMRQNPLYVMNMDWISMKCCGKHVQTGVQPEPSIKGLXWIRVPF

SEQ ID NO: 25592 - DNA, 816 bp, Zea mays
  misc_feature: Ceres CLONE 1397586-R
ggtgtttacgattgggtaccgggccccccctcgaggtcgacggtatcgataagcttttttttttttttttttattgaaaccaaatttcatacataaccatcaccagctgaagtgggcatagaaacctccgacggtagagcaaacataacagggctcagaatacatatagatgggcatttatctgtccagaccattacggtccaacaagggtaaccacacaaacacatatatcactagtccagacatatatgccagcaataaaataactgcaaggtactactcaatatagcaaggaaacagcaagtcatggtgtcaaaaacaacaggcagaaaaaaaaataacttgtagttgtagaccctaaattagatgcgtaattatattaagcaacagcgcggaggaaaccacacggcagggtcttggaaaatgtttgttcccaattagctgctgaagctcaagtttcagcggatgtttgggcgcccccactgttttcaggagctgtcgaagctgttgttccaagggccgcagcaggggcagcagagtgatcctgggatgcagcaggaggtgttgcttcagtagagtaggctggaggctgcccatagcttgcactaccataagcatcgccataagactgctgctggccatagccctggtggcttgcaatgggtgcaccagggtaagctggtggtgcaccgtaagcaagttggctgtaaccatactgcccgtaaccagcctgagcagaaccaggaggcagagcctgtccataaagtgacaatgggaggaggtttctggcccctgtgggagaaggctgcccataaa

SEQ ID NO: 25593 - DNA, 715 bp, Zea mays
  misc_feature: Ceres CLONE 1397590-F
  misc_feature: Encodes the peptide sequence at SEQ ID NO. 25594
  misc_feature (515)..(515): n is a, c, t, g, unknown, or other
  misc_feature (627)..(627): n is a, c, t, g, unknown, or other
  misc_feature (675)..(675): n is a, c, t, g, unknown, or other
gctctagaactagtggatcccccgggctgcaggaattcgcacgagaccattacctagaacatcctaatcgaaaagtcggaagctcccttcatttctttcacctccgattcgattccttgtcccctcttgatccgagccgccaccaaaccctaactatctaaaacccccgtctcgctgtccgatggccgccgcctcgccgccgccctccccaccccacgcaaagcgccccaagatgtcctcctcctccgacccggaagccgatgctgagcccacctcggcctccgccgccgttgagggcgccgatcctgcgcagcgtcgtcccaggtacaagcgccgcaaggtcgccatccttctcgggtactgcggcgcggggtatcagggcatgcagaagaatccgggcgcgcgcaccatcgagggggacctcgaggaggcgctctaccaggcgggcgccgtgcccgaggccgaccggtccgcgccgcgccgttacgattgggcacgtgctgcgcgcaccgacnagggcgtcagcgccgcggccgcagggtggtgtccgggcgcttctacgtcgacccgccgggcttcatcgatcgcttggacgcgcagttcgcgccgcagatccgcgcctacggntacgtgcgcgttaccactcatcaaacgcaaaaagtctgcaaacgccgnaggtacctggatcggctccccgaatttgctcctgaccccg

SEQ ID NO: 25594 - protein, 178 aa, Zea mays
  misc_feature: Ceres CLONE 1397590-F
  misc_feature: SWISSPROT Homolog: EC 5.4.99.12 tRNA-pseudouridine synthase I
  misc_feature (112)..(112): Xaa is any aa, unknown, or other
  misc_feature (149)..(149): Xaa is any aa, unknown, or other
  misc_feature (165)..(165): Xaa is any aa, unknown, or other
MAAASPPPSPPHAKRPKMSSSSDPEADAEPTSASAAVEGADPAQRRPRYKRRKVAILLGYCGAGYQGMQKNPGARTIEGDLEEALYQAGAVPEADRSAPRRYDWARAARTDXGVSAAAAGWCPGASTSTRRASSIAWTRSSRRRSAPTXTCALPLIKRKKSANAXGTWIGSPNLLLTP

SEQ ID NO: 25595 - DNA, 670 bp, Zea mays
  misc_feature: Ceres CLONE 1397592-F
  misc_feature: Translation starting site: 189
  misc_feature (581)..(581): n is a, c, t, g, unknown, or other
aaagctggagctccccgcggtggcggccgctctagaactagtggatcccccgggctgcaggaattcgcacgagaccattacctagaacatcctaatcgaaaaactgcaccgagaagcaagaaaactagaaaaggctcctcccgaccgtaacgtccctcatctccctcgaccccgacatccccgacccgatggcgcccaaggcggagaagaagccagcggagaataagccggcgtccgaggagaaggcggataagacgaccgcagggaaaagcccaaggccgagaagcggctgcccgcgaccaagtcctccggcaaggaggtcggccagaataaggcgaagaagaaggtcaagaagagcgcggagacctactagatctacgtcttcgaggtggtgaagcacgtgcaccccgacctcgacatatccgccaaggccatgtacatcatgaactcgttcatcaacgacatctttgagaagctggtcgacgaggccgcctagctggagcggtacaacaagaagcccaccatcacgtcccggatgatccatacctccgtgcgcgtagtcctccccggagagatcgccnagcacgccgtctacgaggggaacaagccgcacccaaggtcagccagcactgagcgcgctgcggtatccgcgatctgatagcaagtttct

SEQ ID NO: 25596 - DNA, 737 bp, Zea mays
  misc_feature: Ceres CLONE 1397593-F
  misc_feature: Translation starting site: 297
  misc_feature (430)..(430): n is a, c, t, g, unknown, or other
  misc_feature (431)..(431): n is a, c, t, g, unknown, or other
  misc_feature (509)..(509): n is a, c, t, g, unknown, or other
  misc_feature (547)..(547): n is a, c, t, g, unknown, or other
aagctggagctccccgcggtggcggccgctctagaactagtggatcccccgggctgcaggaattcgcacgagaccattacctagaacatcctaatcgaaaacaataattctctccacccctgcttgctgcagcttcaagcactaccgaatcagggcgagtgggagcagaggagggaatcccatgtctccgcccctcgctggagcagatcgttgtcgagccgacgtggagctgctgcggtagaaagctagcggagcctgcgagctagcctgatccgtccgcagtccgatcgggatcgatgggtggggaggcgccggagccgcggcggctgacccgggcgctgagcatcggcggcggtgacggcggctgggttcccgaggagatgctgcaactcgtgatggggttcgtcgaggacccgcgcgaccgggagcnncgcgtcgctggtgtgtcaccggtggcaccgcgtcgacgcgctctcgcggaagcacgtgacggtgcccttctgctacgncgttttcccggcacgctgggctcgcgcgggtcccgcgnctcgagtcgctcgcggggggaggggaagccccgcgcggccctgtacgggctcatacccgacgaatgggggcgctacgcccgcccggggatcaccgagcttcgcgggccgctcgaggggctcaggcgctccacctccgaacgagggccggcacaaaagacgactcgcaaagtcgtccgggccaggggaaca

SEQ ID NO: 25597 - DNA, 686 bp, Zea mays
  misc_feature: Ceres CLONE 1397594-F
  misc_feature: Encodes the peptide sequence at SEQ ID NO. 25598
  misc_feature (407)..(407): n is a, c, t, g, unknown, or other
  misc_feature (410)..(410): n is a, c, t, g, unknown, or other
  misc_feature (555)..(555): n is a, c, t, g, unknown, or other
  misc_feature (565)..(565): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (600)..(600): n is a, c, t, g, unknown, or other
ctggagctccccgcggtggcggccgctctagaactagtggatcccccgggctgcaggaattcgcacgagaccattacctagaacatcctaatcgaaaataccgcctgatccaccgcggtttgcttgccgcgagcatggaaattattagtcattcgacaagtcagagagattttatttcctctcgtcgtctcgtggccgctggtgcccgcgcgtcagatttggcctgctccgctccgcctccgcagtgtgaatttctgagagataggtttctgtgctgcagacagcccggcggcgacgcggtggcagtttgcggcgaggtccggcgtcgcgccggcgttcatgtcgttcaggacggaggcgacgggcgagggctctgaggcgttctcggtctccgagctccggtcggncgnagacgccttcgacggcatcaagaagcagagctccatgctttcgatctaccagcagaggcagtttgggcacaacagcagccaggtcacgtcacagcagcagtaccctgcagcagcgcacagcagcgctcgcaggtggcggattacngcgcggcgcnacgatctctcctgggtggggnnnnnnnnnnnnngnattcagcttaggggacccccggtgtcggtgcgccaaccctgtggccgttcatcagcccacccgggatggccaaggtcatcaagtgg

SEQ ID NO: 25598 - protein, 115 aa, Zea mays
  misc_feature: Ceres CLONE 1397594-F
  misc_feature (23)..(23): Xaa is any aa, unknown, or other
  misc_feature (24)..(24): Xaa is any aa, unknown, or other
  misc_feature (76)..(76): Xaa is any aa, unknown, or other
  misc_feature (83)..(83): Xaa is any aa, unknown, or other
  misc_feature (84)..(84): Xaa is any aa, unknown, or other
  misc_feature (85)..(85): Xaa is any aa, unknown, or other
  misc_feature (86)..(86): Xaa is any aa, unknown, or other
  misc_feature (87)..(87): Xaa is any aa, unknown, or other
MSFRTEATGEGSEAFSVSELRSXXDAFDGIKKQSSMLSIYQQRQFGHNSSQVTSQQQYPAAAHSSARRWRITARRXDLSWVGXXXXXIQLRGPPVSVRQPCGRSSAHPGWPRSSS

SEQ ID NO: 25599 - DNA, 684 bp, Zea mays
  misc_feature: Ceres CLONE 1397597-F
  misc_feature: Encodes the peptide sequence at SEQ ID NO. 25600
  misc_feature (611)..(611): n is a, c, t, g, unknown, or other
gctctagaactagtggatcccccgggctgcaggaattcgcacgagaccattacctagaacactaatcgaaaaatcttcaccattggtgccaagttcataaatatcagatctggtgataaaccatgaccggaaaaaagaccacggtctcctctgtcggccgcactcgaaagaaggccaaggtggtgttggaggatgaggaagaggcagggttggaagatgaggaagaggtgactgtgacattatccgtggagaaggacgcgctggagtgcgacatctgctgcctacccttccagtccgaagttttcgtgtgcaagaacgggcattctggatgtgcaaaatgctgcatccgcacggacggtaagtgctggacctgttccgagcgcattgacgacatgcgttaccgtccgctcgagaagctcctggcggcggcgaccacctcctgcatgttcaagagcaacggctgctacgacgccatcagctacctggagaaggtgacccacgaggagacatgccagcgcgcgccgtacaagtgccccgtcgacggctgcgcctatagcggcctgcggctcggctaccacgtcgcacaggaccacggccacgacgacgacggnctcgcctccgtcgtctttatctacggcaaggcggtggcgaccgtgcgcaaggacgagccgttccgcgtcctgc

SEQ ID NO: 25600 - protein, 187 aa, Zea mays
  misc_feature: Ceres CLONE 1397597-F
MTGKKTTVSSVGRTRKKAKVVLEDEEEAGLEDEEEVTVTLSVEKDALECDICCLPFQSEVFVCKNGHSGCAKCCIRTDGKCWTCSERIDDMRYRPLEKLLAAATTSCMFKSNGCYDAISYLEKVTHEETCQRAPYKCPVDGCAYSGLRLGYHVAQDHGHDDDGLASVVFIYGKAVATVRKDEPFRVL

SEQ ID NO: 25601 - DNA, 710 bp, Zea mays
  misc_feature: Ceres CLONE 1397598-F
  misc_feature: Encodes the peptide sequence at SEQ ID NO. 25602
aaagctggagctccccgcggtggcggccgctctagaactagtggatcccccgggctgcaggaattcgcacgagaccattacctagaacatcctaatcgaaaaaatttgcttgcagttttgataatttgcttgcagttttgcactaggcattgattgcatctctagtgcccgtcctccgtcctccggagcggctatgggcgaagagagggagttcgtgggcgctaggttggacgccggcctccgcgctgcccgcttctcgtcgccgccgtctgccgacgagtttgcggcagatgtcgagcccaagaacgtccctgcggtctttcgcggcgtggttaaggagtgggcggcctcctcccgttgggatcctctccatggcggcctcgattacctgctggaaaaagtgggacctgacgtggctgtggaagctatgatgtcaaacactggccatgtgttctacggggatctcagaagccatgagagggtgtctgtttcattctccacgttcattcagtcgtgcaagtcttacctggatcatatgaatgcagctagtgattcatccaaagagcagggaatgcttggggagccagctagttcaagggagacatgttcgaacagttcagagaacttggagcaagtctatttggcacagagaacaaagaaggatgctcattacaagttctggaaggcgacatccaagagcctatatttct

SEQ ID NO: 25602 - protein, 172 aa, Zea mays
  misc_feature: Ceres CLONE 1397598-F
MGEEREFVGARLDAGLRAARFSSPPSADEFAADVEPKNVPAVFRGVVKEWAASSRWDPLHGGLDYLLEKVGPDVAVEAMMSNTGHVFYGDLRSHERVSVSFSTFIQSCKSYLDHMNAASDSSKEQGMLGEPASSRETCSNSSENLEQVYLAQRTKKDAHYKFWKATSKSLYF

SEQ ID NO: 25603 - DNA, 649 bp, Zea mays
  misc_feature: Ceres CLONE 1397600-R
  misc_feature (649)..(649): n is a, c, t, g, unknown, or other
caattgggtaccgggccccccctcgaggtcgacggtatcgataagctttttttttttttttgttaacgatgcacatcttctccttcgaaaggtatcaagtcgttgagatacgctgacaatctttagctactatagacaggcagtaacgtatatcagatgttaataaaaagaaccgagacgatcagacttcagaagtcactgtcttacaacacaaacgacacagatggagaaagaaagatgtagtatcatcgacgagtttcaatggaaaatcccccacaggcctaaggtgaggcatatgatgagctaaacgcctcttcagatcacagcagctggcatgatgtgccgtccctgctgctgctgctagctactagggcccctaggcacagccaagggccaacgaatgatatatcaccgaagccaatgggtcaaactgctggtgttacgaaccggccgccgtttcatcttcagatgaaacatcgtgcttggatgacagcttctgtttccggccgttcctcctccggctggcgttctgacctggcagcttcggcgtttccttcgtgtcgctcaccccaaaacagaatccagcctggttctggcctgcaccaccttcaacaggctttggaggcttccctgaatccagagctgatgn

SEQ ID NO: 25604 - DNA, 716 bp, Zea mays
  misc_feature: Ceres CLONE 1397602-F
  misc_feature: Encodes the peptide sequence at SEQ ID NO. 25605
  misc_feature (264)..(264): n is a, c, t, g, unknown, or other
  misc_feature (482)..(482): n is a, c, t, g, unknown, or other
  misc_feature (483)..(483): n is a, c, t, g, unknown, or other
  misc_feature (581)..(581): n is a, c, t, g, unknown, or other
  misc_feature (659)..(659): n is a, c, t, g, unknown, or other
aaagctggagctccccgcggtggcggccgctctagaactagtggatcccccgggctgcaggaattcgcacgagaccattacctagaacatcctaatccaaaaatttcgggctgggtccgggaacctcgaatctatctcctaaccctatcaagctagctagctgcgatgccgagcttccctccgccgggcgccgtcaccatctgcgagatcaaccgcgacctcgttgcggtggatgccctctccgacgaccgcgccaaggacgantatggggatgtcctcgggatggtgttcgccccgattccgttccagccggaggctcttcttctcgccagccgcgagcctgctgctcctgccgcggaccaagtcgagcctgctgacctgtgcccacccgctggtttggcagccaccatatccgacttcttcagggcgggatggtcttccctccactagacccaaatctggctagaagaatttgacacgcnnagaaagtaagttggaatccatacaagcattgcttagcatttcggggtctgggaagaacccaggttactgtccaaggactttgagggactcagatgctnaagaaccatgcatttttaacaatgatcattcaacgggatgggtagggtttggttgagtggagacccaataatgggggnaaaaaggaattgcagttgcttgcaaaggagggaatatgggcctctggtcggcatcta

SEQ ID NO: 25605 - protein, 94 aa, Zea mays
  misc_feature: Ceres CLONE 1397602-F
  misc_feature (33)..(33): Xaa is any aa, unknown, or other
MPSFPPPGAVTICEINRDLVAVDALSDDRAKDXYGDVLGMVFAPIPFQPEALLLASREPAAPAADQVEPADLCPPAGLAATISDFFRAGWSSLH

SEQ ID NO: 25606 - DNA, 701 bp, Zea mays
  misc_feature: Ceres CLONE 1397604-F
  misc_feature: Encodes the peptide sequence at SEQ ID NO. 25607
  misc_feature (340)..(340): n is a, c, t, g, unknown, or other
  misc_feature (344)..(344): n is a, c, t, g, unknown, or other
  misc_feature (345)..(345): n is a, c, t, g, unknown, or other
  misc_feature (368)..(368): n is a, c, t, g, unknown, or other
aagctggagctccccgcggtggcggccgctctagaactagtggatcccccgggctgcaggaattcgcacgagaccattacctagaacatcctaatcgaaaaaccccaaagctccgcctccgcaccttctctcactcgcccagccgcggctatggcggccaccacatccacggcggcggcggcagtatccttctccctcccctcaccaccgcactgccgcggggcccggcgccgccgcgcgccttccctcctccgtgccgcctccaccgccgcgcccccctcccccgaactctcccatcagctctcgccccgcgcgtccccgcccgcgtctaccaacggcngcgnncacgcgcttggaccccccgtggntcgctccttttgccgtgaccgccccgaggacctggcagccgaggccccgccgatggcccggggccgtggggccaaagtttaaagtcccgattcccccgcggccgtaagggtccgcccctttaagggggctcccgaaaagggaaagggtgccaaatgggcctcctcccgggggagggcccttcggcggggggggagggggggccccttccaaaaaggggcccccccgcggggggaatttcccccccttttaaaggggccgccccttctttttaatgggggggggttccccccccccccctccttcgggcggaaaatcaaaagagactccccaag

SEQ ID NO: 25607 - protein, 99 aa, Zea mays
  misc_feature: Ceres CLONE 1397604-F
  misc_feature (64)..(64): Xaa is any aa, unknown, or other
  misc_feature (65)..(65): Xaa is any aa, unknown, or other
  misc_feature (73)..(73): Xaa is any aa, unknown, or other
MAATTSTAAAAVSFSLPSPPHCRGARRRRAPSLLRAASTAAPPSPELSHQLSPRASPPASTNGXXHALGPPVXRSFCRDRPEDLAAEAPPMARGRGAKV

SEQ ID NO: 25608 - DNA, 711 bp, Zea mays
  misc_feature: Ceres CLONE 1397605-F
  misc_feature: Translation starting site: 112
  misc_feature: Pfam Name: IF3_N Pfam Description: Translation initiation factor IF-3, N-terminal domain
  misc_feature (319)..(319): n is a, c, t, g, unknown, or other
  misc_feature (580)..(580): n is a, c, t, g, unknown, or other
tggagctccccgcggtggcggccgctctagaactagtggatcccccgggctgcaggaattcgcacgagaccattacctagaacatcctaatcgaaaaaaggaaaaaaaaggatggctctccggcgcaacgccggatccctcgcgctccgcgccgccgcctacctccgccgccaccgtccccatcctcctcccccactggccctcgccgcccccgctcccactcccatacgctccccgctggccccgcctttccggcacttcgctgctccgcctggtactcagaccaataggaagcgaggcaaggaggaggacgatgccngcgcgggcccgcgcatgaacaacgccatcgccgctcccttcgtcaggctcgtcatggatgaaggccacaacattctcccccggcatgaagccttgcagcttgcgatcaggatggacatggactttggttgaggtcgataggaaatcagacccacctgtatgcaaaatcatggattttcacagagagaagtataagaaagaaaccaaggagaaagaacgcttgaaaaccaagtctgctattggtcttaacgtgggtgggagnaaacaaagaagtgcgattttaaaggggaagactgaactaaaagaattggatggtgaaaggcagatgggattacaatttaatgggagcgggggtaaaaagggggggaggtgcatggccatgccctcaagtaa

SEQ ID NO: 25609 - DNA, 691 bp, Zea mays
  misc_feature: Ceres CLONE 1397606-F
  misc_feature: Encodes the peptide sequence at SEQ ID NO. 25610
  misc_feature (436)..(436): n is a, c, t, g, unknown, or other
  misc_feature (522)..(522): n is a, c, t, g, unknown, or other
  misc_feature (523)..(523): n is a, c, t, g, unknown, or other
  misc_feature (532)..(532): n is a, c, t, g, unknown, or other
  misc_feature (533)..(533): n is a, c, t, g, unknown, or other
  misc_feature (538)..(538): n is a, c, t, g, unknown, or other
  misc_feature (540)..(540): n is a, c, t, g, unknown, or other
  misc_feature (547)..(547): n is a, c, t, g, unknown, or other
aaagctggagctccccgcggtggcggccgctctagaactagtggatcccccgggctgcaggaattcgcacgagaccattacctagaacatcctaatcgaaaacttcttcttttttccctacccctccgccgttgctctgcaaggcacgcgtcctgcacgcgccaaagctaggcgataaactggaaaggagcgcgcagcgcaggcttcgggctcctgtctccgccgcggcgtcctctcgctttttcaggactttcaggacttgcaggctctgcgcagcgcgatctgacatctgaccgggtcagacgatacagcccatatactacgttacgtcgagtcctcaaagttcaattctacctggaccattgcacccatcttggcccaaagtacttgcgcgccgcgctacgaacgaggccatccgccgccacacgccgtcggncatgccgcagaggtcagaggcggcactgcctgggggagggcgacgaggagcagcggctgcgggctgctctgcgtcactgcagcggnnaagcggggnntctgnancgcctgnggtacaagaaccgaaaccagaacgcggcgcccgccaatttccaaaaccttccccggggggaggagggaccttgaagttttgggtcgggccccggcctttgttaggggccccaaggccggggtccccagttctgaagggccaaag

SEQ ID NO: 25610 - protein, 84 aa, Zea mays
  misc_feature: Ceres CLONE 1397606-F
  misc_feature (29)..(29): Xaa is any aa, unknown, or other
  misc_feature (32)..(32): Xaa is any aa, unknown, or other
  misc_feature (34)..(34): Xaa is any aa, unknown, or other
  misc_feature (35)..(35): Xaa is any aa, unknown, or other
  misc_feature (37)..(37): Xaa is any aa, unknown, or other
MPQRSEAALPGGGRRGAAAAGCSASLQRXSGXSXXPXVQEPKPERGARQFPKPSPGGGGTLKFWVGPRPLLGAPRPGSPVLKGQ

SEQ ID NO: 25611 - DNA, 674 bp, Zea mays
  misc_feature: Ceres CLONE 1397610-F
  misc_feature: Encodes the peptide sequence at SEQ ID NO. 25612
  misc_feature (395)..(395): n is a, c, t, g, unknown, or other
  misc_feature (501)..(501): n is a, c, t, g, unknown, or other
  misc_feature (599)..(599): n is a, c, t, g, unknown, or other
aaagctggagctccccgcggtggcggccgctctagaactagtggatcccccgggctgcaggaattcgcacgagaccattacctagaacatcctaatcgaaaaaaaaaccgcagccggaggtcgccggtcgccaccaccaatggggccacccgccatggcgttccaagccctcaccctcacgccactccccttctcactccacagctcgagccgccgcgtccgcgtgcttgccgttgcggccgaccagactcctccgcccgcccccccttcggagccggcgaacagccctagccgcctccttcgcgagctcgcgcagcggaagaaggccgtatcccctaagaagaagcatccgccgcgtcgcttcatcctgaagccacctctcgatgacgagcgcnttaacccggcggttcctcagcagcccgcagctgtcgctcaaggcgctcccgctgctctcttcctgcctcccctccgcgccgctctccaccggcgaagggacttggnatggacgagtacctctcgaggggcaagcaaggggggctcgggtacccgctcgcggccctcggaagacgctcggcgaaaggcgatgactgccccgccgnccatttcgaggtggctggtcaacctcggggtccaaaaactgggacccctctagcgagggaacgcggagggggaac

SEQ ID NO: 25612 - protein, 57 aa, Zea mays
  misc_feature: Ceres CLONE 1397610-F
  misc_feature (33)..(33): Xaa is any aa, unknown, or other
MDEYLSRGKQGGLGYPLAALGRRSAKGDDCPAXHFEVAGQPRGPKTGTPLARERGGG

SEQ ID NO: 25613 - DNA, 568 bp, Zea mays
  misc_feature: Ceres CLONE 1397612-F
gctctagaactagtggatcccccgggctgcaggaattcgcacgagaccattacctagaacatcctaatcgaaaaaccccgcgtcccaccaacttccattccctaccgcccggccaccccactccactccgctcctcccactcgaggcatcatggccctcgcctcccgcgcggccgaaaccgccgtggggtgcgtccttcctggggttcgccgcctccgccggggggggggggtccaaatcccctggaaccggggcggggggggaatggattttccaaggccgcccaccggactaatgggctcgacaaaaccccaaaaggggaaaaaagggggccttccccccccggggtggggtggggggggggaaaaaacaccattgggccacccccccccttttgggggggtggtgtttgggtcccccctcccgggggtatacaataaaaaaaaaagagggggttttttcactccaaaaaaaaaaaaggggggggggggggcctccccccgccgggggggggggggggggaaaaacaacacaccgcttctttataaggagggagagaatttttttg

SEQ ID NO: 25614 - DNA, 696 bp, Zea mays
  misc_feature: Ceres CLONE 1397615-F
  misc_feature: Encodes the peptide sequence at SEQ ID NO. 25615
  misc_feature (444)..(444): n is a, c, t, g, unknown, or other
  misc_feature (479)..(479): n is a, c, t, g, unknown, or other
  misc_feature (540)..(540): n is a, c, t, g, unknown, or other
  misc_feature (541)..(541): n is a, c, t, g, unknown, or other
  misc_feature (555)..(555): n is a, c, t, g, unknown, or other
  misc_feature (576)..(576): n is a, c, t, g, unknown, or other
  misc_feature (616)..(616): n is a, c, t, g, unknown, or other
  misc_feature (647)..(647): n is a, c, t, g, unknown, or other
aaaagctggagctccccgcggtggcggccgctctagaactagtggatcccccgggctgcaggaattcgcacgagaccattacctagaacatcctaatcgaaaaatcaccatcgcctggaaccacagaccacaaaggaggggacacacacacacacacaccgtctccgcccgcccgccgcgacgcgccatggctatggctcgctccgtcgcgcacctcttctttcccatcctccttatctccaccgcgcccgccgtgcgggccatcaccgacgccgccggcggccccggatacctccaggaggcgtgcaacaagacgctgttccccaaggtgtgcatgcacgcgctcaaggacaacccagagtgccaggcggagacggcggtcacgccgcgccggctggccgagctgctcgtgtacgtgtcggccgaggtgggcatgaccgtggncgcgttcgcgcaccacgagctcaacgccatcaggnacgacgacgtcctgtacaagtgcatcgacacctgctcccgagacatcgaggaaagcgtggnngcactcagcgcccntctccgcgacttctccgacgnccagttcctcgaggtcaagtcctggctcacctccacgctncgcggcaccgccacccctgcgagacgctgcnaggacgcccccgtcagcgacaatcagaacgtctgcataaccagagcttc

SEQ ID NO: 25615 - protein, 169 aa, Zea mays
  misc_feature: Ceres CLONE 1397615-F
  misc_feature (86)..(86): Xaa is any aa, unknown, or other
  misc_feature (98)..(98): Xaa is any aa, unknown, or other
  misc_feature (118)..(118): Xaa is any aa, unknown, or other
  misc_feature (123)..(123): Xaa is any aa, unknown, or other
  misc_feature (130)..(130): Xaa is any aa, unknown, or other
  misc_feature (154)..(154): Xaa is any aa, unknown, or other
MAMARSVAHLFFPILLISTAPAVRAITDAAGGPGYLQEACNKTLFPKVCMHALKDNPECQAETAVTPRRLAELLVYVSAEVGMTVXAFAHHELNAIRXDDVLYKCIDTCSRDIEESVXALSAXLRDFSDXQFLEVKSWLTSTLRGTATPARRCXDAPVSDNQNVCITRA

SEQ ID NO: 25616 - DNA, 760 bp, Zea mays
  misc_feature: Ceres CLONE 1397618-F
  misc_feature: Encodes the peptide sequence at SEQ ID NO. 25617
aagctggagctccccgcggtggcggccgctctagaactagtggatcccccgggctgcaggaattcgcacgagaccattacctagaacatcctaatcgaaaaaatcaactcgtttctctccgattgctcctccgagtccgagactccgttctctcccgcatccaccgccgtctcatccccaatccgagcaacgcctcccctcgcctccaaaaccctacccctcctgtcaccggcgggggcatgaaccggtgatcgcttacctggtctcgtctgtctgcgcacgcgcgaggtcagtgagtgagcattgcggtggtccgatcgcccgcggggggccatggcgtctgtggcgggatcgggcggcggggcaagcgcgggggccggtgggttgaagacttacttcaagacccccgaggggcggcacaagctgcagtacgagaagacgcactcccccgccgtcgtgcactacaaccacaacggcaagaccgtcgcccagatgacggtggcatatttgaaggagaagccagcaggccagggttccacgccttcaacaccaagtgctggtagttgggatgcggtctgcagctgcgagactgcttggcactgggaatggtagccggacacttagcttcgggagcatgggacccagcagggctgtctcaggagcaccgcatgggtggggggggaattgggtgtggcaactagttgcaagtggatcgcagggcatgcccgacttacgatggaaaagggctcatacatcatat

SEQ ID NO: 25617 - protein, 92 aa, Zea mays
  misc_feature: Ceres CLONE 1397618-F
MASVAGSGGGASAGAGGLKTYFKTPEGRHKLQYEKTHSPAVVHYNHNGKTVAQMTVAYLKEKPAGQGSTPSTPSAGSWDAVCSCETAWHWEW

SEQ ID NO: 25618 - DNA, 750 bp, Zea mays
  misc_feature: Ceres CLONE 1397619-F
  misc_feature: Encodes the peptide sequence at SEQ ID NO. 25619
  misc_feature (513)..(513): n is a, c, t, g, unknown, or other
  misc_feature (655)..(655): n is a, c, t, g, unknown, or other
  misc_feature (659)..(659): n is a, c, t, g, unknown, or other
  misc_feature (737)..(737): n is a, c, t, g, unknown, or other
  misc_feature (741)..(741): n is a, c, t, g, unknown, or other
  misc_feature (742)..(742): n is a, c, t, g, unknown, or other
  misc_feature (750)..(750): n is a, c, t, g, unknown, or other
acccgcggtggcggccgctctagaactagtggatcccccgggctgcaggaattcgcacgagaccattacctagaacatcctaatcgaaaagtgctgccgccagatctaaccaaaccccgcgccctcctcaccgtccggcgagctacggactcagcagatcaccgtcgctcgagttgtacctgaaggcgcgcccgtggaaccggccgcgagataacggcggcgggaaggcgggcgacgatgccggtggcagcgtcggccatctacttcctcaaccttcgcggggacgtcctcatcaaccgcctctaccgtgatgatgttgggggaaatatggttgatgcgttcagaatgcatatcatgcaaacaaaagaacttggcacatgccctgttcgtcaaataggaggctgctccttcctttatatgaggatcagtaatgtttacattgtgatcgtagttagcagcaatgctaatgttgcatgtgctttcaaatttgttgtcgaggcggtggctctcttncagtcctacttcggtggagcttttgatgaagacgctatcaggaataactttgttttgatatatgaacttcttgatgagatcatgggattttggttatcctcaaaacctttcaccctgaattttgaaagtgtatataactcangaanggtgttcggtcaccatttttccctcaagccctcagagaagcctgttccaaatgcgactcttcagtcactggcgcctgntggnntggagaan

SEQ ID NO: 25619 - protein, 170 aa, Zea mays
  misc_feature: Ceres CLONE 1397619-F
  misc_feature (92)..(92): Xaa is any aa, unknown, or other
  misc_feature (140)..(140): Xaa is any aa, unknown, or other
  misc_feature (141)..(141): Xaa is any aa, unknown, or other
  misc_feature (167)..(167): Xaa is any aa, unknown, or other
  misc_feature (169)..(169): Xaa is any aa, unknown, or other
MPVAASAIYFLNLRGDVLINRLYRDDVGGNMVDAFRMHIMQTKELGTCPVRQIGGCSFLYMRISNVYIVIVVSSNANVACAFKFVVEAVALXQSYFGGAFDEDAIRNNFVLIYELLDEIMGFWLSSKPFTLNFESVYNSXXVFGHHFSLKPSEKPVPNATLQSLAPXGXE

SEQ ID NO: 25620 - DNA, 768 bp, Zea mays
  misc_feature: Ceres CLONE 1397620-F
  misc_feature: Encodes the peptide sequence at SEQ ID NO. 25621
  misc_feature (524)..(524): n is a, c, t, g, unknown, or other
  misc_feature (653)..(653): n is a, c, t, g, unknown, or other
  misc_feature (704)..(704): n is a, c, t, g, unknown, or other
aaagctggagctccccgcggtggcggccgctctagaactagtggatcccccgggctgcaggaattcgcacgagaccattacctagaacatcctaatcgaaaaaatcccattttcggtgcccgcgcccgtgccgtaccgtccctatcacaccggatcgccactcgctcccccccaccccactccgccccacctccgcgcctcagatccatccccaaccggcaaccctagcgccgggttcctcctcctcggatccgcccgccgccgcgcggactccattgccagaggtgatcgagggggagagatagagcttgggtgggtcggattagggagagagggagggggaggatgtccagacggtcgttgaacccgagccggcgggtgggcggacgggggtctgccgacagtcggaggcctgttccaccccaagtcacgctcgcctcccgtgcttactattgccctagtcggtcctgggtgtcattcttctcgtcgcctacttcaacagcggctcaggtgtaactgttacnagcagagagtctgtgaccaaggtctggaagttcttgcacatcagaagtttatggcgggtgcttcccatatctaaaaaggcatatggaaatgccattgcaaaagggttctccatgtaggcccctgatagnttggtacaggtagttttcttatttgggtgaaaagaaggaaaggttgaaaanctttggggaagtggaaggcttatatgatttggaaggaataatgggacggacttgccaaaagctc

SEQ ID NO: 25621 - protein, 56 aa, Zea mays
  misc_feature: Ceres CLONE 1397620-F
MSRRSLNPSRRVGGRGSADSRRPVPPQVTLASRAYYCPSRSWVSFFSSPTSTAAQV

SEQ ID NO: 25622 - DNA, 665 bp, Zea mays
  misc_feature: Ceres CLONE 1397621-F
  misc_feature: Encodes the peptide sequence at SEQ ID NO. 25623
  misc_feature (128)..(128): n is a, c, t, g, unknown, or other
  misc_feature (291)..(291): n is a, c, t, g, unknown, or other
cacccgcggtggcggccgctctagaactagtggatcccccgggctgcaggaattcgcacgagaccattacctagtacatcctaatcgaaaaacctgccacatctggccatctctcagtctcacacgcngctgccatgggacggatccatgggtggtgcgctgccaactacgtgcctctgacgccgctcagcttcctggagcgcgccgcggtcgtgtacggcgaccgcgcggccgtcgtttgcgccgataggcggttctcgtggcgcgagaccagggagcggttgcctcccnggggcagccgctctcgctcgtcctcggggttggccgccgccgactggggtcccgggcctttcccttcaaaaggacccggggaaagggacggaggtcccttttcagcggggggccaagaaacggggcccccctcccgtgtggaaccctttaaaaaaccccgccacgaaaggggggcaatgggggggtcccccccccgggtggaaacaccccctcgaaagccgagggccttctcccccgaggggggcttaaattatcccccccccgggggggcccccggacacggcgtccatgtcctcccctcacacaacccaacaaaaaaagagttttctcttccccgaatatcccggggtgtggtgtacctccatagatgggga

SEQ ID NO: 25623 - protein, 177 aa, Zea mays
  misc_feature: Ceres CLONE 1397621-F
  misc_feature (53)..(53): Xaa is any aa, unknown, or other
MGRIHGWCAANYVPLTPLSFLERAAVVYGDRAAVVCADRRFSWRETRERLPPXGSRSRSSSGLAAADWGPGPFPSKGPGERDGGPFSAGGQETGPPSRVEPFKKPRHERGAMGGSPPRVETPPRKPRAFSPEGGLNYPPPGGAPGHGVHVLPSHNPTKKEFSLPRISRGVVYLHRWG

SEQ ID NO: 25624 - DNA, 738 bp, Zea mays
  misc_feature: Ceres CLONE 1397622-F
  misc_feature: Encodes the peptide sequence at SEQ ID NO. 25625
  misc_feature (525)..(525): n is a, c, t, g, unknown, or other
  misc_feature (636)..(636): n is a, c, t, g, unknown, or other
cgcggtggcggccgctctagaactagtggatcccccgggctgcaggaattcgcacgagaccattacctagaacatcctaatcgaaaagctagggttttagtgtttttagcctcctgcgtccctcccctgttccctcaacgcttctctcctccacctcttctcgacagccgctgccacccggaaccttctcgcagcgacgctatgtgggctctccgccgagctggtaaccccctcaggttccatgcccaaaaagttgtgagtccccgtggttgtgcgagccttgaggtgctgctaactgctgatacaaaaaatgttgaagaacaccatgaggcagactgtcagaaagtgtgctactgtcataagccaaagccaccatccttcttattgtcattttcatctggccaatttgcttggagtaggggtttctcctctcagccaggtgcaaattctagtgacaaggatgatgagttagaggatgtattttctgatctcaatgttccaccagaagctggtaaaaaggatgcntgggtgacatctgaagatacttctgatgagggatgcactgatgaaattggcttgcctagtatggatgctgatgcaaaacctgagacggagcacattaaaaggacttttggntccacccttctcaagactgtgttggaagctcaaagggatcaagtcacttcagcgcttgagaaatgggcaaaggatgcaatgcacttgataggggcgaactcc

SEQ ID NO: 25625 - protein, 179 aa, Zea mays
  misc_feature: Ceres CLONE 1397622-F
MWALRRAGNPLRFHAQKVVSPRGCASLEVLLTADTKNVEEHHEADCQKVCYCHKPKPPSFLLSFSSGQFAWSRGFSSQPGANSSDKDDELEDVFSDLNVPPEAGKKDAWVTSEDTSDEGCTDEIGLPSMDADAKPETEHIKRTFGSTLLKTVLEAQRDQVTSALEKWAKDAMHLIGANS

SEQ ID NO: 25626 - DNA, 714 bp, Zea mays
  misc_feature: Ceres CLONE 1397624-F
  misc_feature: Encodes the peptide sequence at SEQ ID NO. 25627
  misc_feature (450)..(450): n is a, c, t, g, unknown, or other
  misc_feature (486)..(486): n is a, c, t, g, unknown, or other
  misc_feature (502)..(502): n is a, c, t, g, unknown, or other
  misc_feature (539)..(539): n is a, c, t, g, unknown, or other
  misc_feature (645)..(645): n is a, c, t, g, unknown, or other
  misc_feature (646)..(646): n is a, c, t, g, unknown, or other
  misc_feature (675)..(675): n is a, c, t, g, unknown, or other
aaagctggagctccccgcggtggcggccgctctacaactagtggatcccccgggctgcaggaattcgcacgagaccattacctagaacatcctaatcaaaaaactctcctccttcctccaccgccgccaacgtcgcctggcggccgtctgcagctccgcgcctctgctcggaagttggtgaaggtttcttgaagctgagaagatggtgctgaagacagaactctgccgcttcagcggccagaagatttatcctgggaaaggcatccgatttatccgtgctgattctcaggttttcctttttgccaactcaaaatgcaagcgctacttccacaaccgcctgaagcctgcaaagcttacctggacagcaatgtacaggaagcagcacaagaaggatatccatgctgaggctgtcaagaagaggcgccgcgccaccaagaagccatactcganggtccattgtgggtggcttccctagaggtgatccangaagaagagggctggnaaagcccgaggtccgcgatgctgctagagaagctgcntcttcgtgagatcaaggagcgcatcaagaagaccaagggatgagaagaaggcgaaaaaaggctgaggtgaccaaagtcccagaaggcacagacggaagggagcggnncccagaagggttccaaggggcccccaagnttgggttggtgggcggtggccaaccgcttaaagaaacct

SEQ ID NO: 25627 - protein, 90 aa, Zea mays
  misc_feature: Ceres CLONE 1397624-F
  misc_feature (3)..(73): Pfam Name: Ribosomal_L24e Pfam Description: Ribosomal protein L24e
  misc_feature (83)..(83): Xaa is any aa, unknown, or other
MVLKTELCRFSGQKIYPGKGIRFIRADSQVFLFANSKCKRYFHNRLKPAKLTWTAMYRKQHKKDIHAEAVKKRRRATKKPYSXVHCGWLP

SEQ ID NO: 25628 - DNA, 773 bp, Zea mays
  misc_feature: Ceres CLONE 1397626-F
  misc_feature: Encodes the peptide sequence at SEQ ID NO. 25629
  misc_feature (122)..(122): n is a, c, t, g, unknown, or other
  misc_feature (207)..(207): n is a, c, t, g, unknown, or other
  misc_feature (221)..(221): n is a, c, t, g, unknown, or other
  misc_feature (350)..(350): n is a, c, t, g, unknown, or other
  misc_feature (382)..(382): n is a, c, t, g, unknown, or other
  misc_feature (383)..(383): n is a, c, t, g, unknown, or other
  misc_feature (402)..(402): n is a, c, t, g, unknown, or other
  misc_feature (408)..(408): n is a, c, t, g, unknown, or other
  misc_feature (409)..(409): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (443)..(443): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (473)..(473): n is a, c, t, g, unknown, or other
  misc_feature (499)..(499): n is a, c, t, g, unknown, or other
  misc_feature (571)..(571): n is a, c, t, g, unknown, or other
  misc_feature (598)..(598): n is a, c, t, g, unknown, or other
  misc_feature (599)..(599): n is a, c, t, g, unknown, or other
  misc_feature (608)..(608): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
tccccgcggtggcggccgctctagaactagtggatcccccgggctgcaggaattcgcacgagaccattacctagaacatcctaatcgaaaaaaaggtggcaggcacagagagagctagcttntggccaggcgtccacagcagccagcacaagatgtcgacggtggtcatggggggtgggatctttgagtgccacaagtgctacaagnaagatcaggaaggntcctctgcaaggtccaagacaaggtgagcatcaggaccatctcctacgacgagaagaacaacacggggtggacggtgtccgggcccttcgaacggccgagggagggtcgccgacaggctcacccgccgnacggccggcaaggtcatcaccgacatacaccnntccgtcggggggcttcggntttccnntcttttgggggnnnggcggggcgagggnnnnagnccggcgggggaaacaacagagnnnnccggnggccggtcggctccccggggcccggnccaacgcccaacttccttcgctgaccaaccactaccttggtcaacctctttccccggggcccgaaggacagncgccatggggaacccgcgcgcgagcannatggggggntaaccccccggtccgcggcgcccnnnnaccccggaggatctacgaccctcctgggaggcggggagaaagcggcggcccagggttcgcggggattcgaagcttattcgccttccgagaactttcacctcttttccccccgtatatggaagggcgcttcggctttcc

SEQ ID NO: 25629 - protein, 31 aa, Zea mays
  misc_feature: Ceres CLONE 1397626-F
  misc_feature (19)..(19): Xaa is any aa, unknown, or other
MSTVVMGGGIFECHKCYKXDQEGSSARSKTR

SEQ ID NO: 25630 - DNA, 727 bp, Zea mays
  misc_feature: Ceres CLONE 1397630-F
  misc_feature: Encodes the peptide sequence at SEQ ID NO. 25631
  misc_feature (719)..(719): n is a, c, t, g, unknown, or other
tcaccgcggtggcggccgctctagaactagtggatcccccgggctgcaggaattcgcacgagaccattacctagaacatcctaatcgaaaaatccaatccccgggccaccactacctgcctgcccgtgcccacgcttcttctcttctcctccccaagccccagccccagccccagctaccgcgccccctcctgtctgttccaccagcgtcggcctagctacctgcccgtcccctctccgagtacggtcggaagcctcagctgaaggatctggcctgggcgccctccggacgacgggacaggttctgtttggtcttcataaagtagagcactagctagaagacatattcacacgcatcagctatcaaattgcaagcttagaattgacctcaaagttgggacatgcttgtcttaccagaagcaactgatagcttggagttgtagtccgtccggactgtctgctggaccagtatggctgacactccaacttcccgcatggtgcacccctttggcgacgtcccaaggcagactcccaagcaattcctgtattctggtaacccgcagcacctctgccatccgtaccagtcagctccggatgcccatgtcgggccgcagcgcccgtacaccgtgaggtctcagtctcactcgccaaataatgctggttctcaagacatgagactcacagcagtacacgctggagtcctcggcgggcttcggttgntcaaggca

SEQ ID NO: 25631 - protein, 86 aa, Zea mays
  misc_feature: Ceres CLONE 1397630-F
  misc_feature (84)..(84): Xaa is any aa, unknown, or other
MADTPTSRMVHPFGDVPRQTPKQFLYSGNPQHLCHPYQSAPDAHVGPQRPYTVRSQSHSPNNAGSQDMRLTAVHAGVLGGLRLXKA

SEQ ID NO: 25632 - DNA, 717 bp, Zea mays
  misc_feature: Ceres CLONE 1397632-F
  misc_feature: Encodes the peptide sequence at SEQ ID NO. 25633
  misc_feature (665)..(665): n is a, c, t, g, unknown, or other
  misc_feature (666)..(666): n is a, c, t, g, unknown, or other
  misc_feature (670)..(670): n is a, c, t, g, unknown, or other
  misc_feature (678)..(678): n is a, c, t, g, unknown, or other
aaagctggagctccccgcggtggcggccgctctagaactagtggatcccccgggctgcaggaattcgcacgagaccattacctagaacatcctaatcgaaaacagcatcgccgccccccctctccgcctcaaggctctcctctcggaggtctgataggcaacccaataatggcagaagtcctatcaggatctcatgaacaccgtctaagctctgccttagatggacactacgacgagaagaggaaatccaatgtggaatacacagaggacgagaagaaagccgtgatcgcggctctgaaaaagaaggctttgagcgcctcacagaagtttaggcattccatgaagagggggaggaagagcagcaaggtgatgtccatctcgattctggatgagcgtgaacctgaggaggtgcaggctgtggatgccttccgccagcttcttgtacttgaagagctgctaccatcgcagcatgatgactaccacatggatgctaagatttctcaaaggcaagaaagtttggatatcgagaaggcaaaggcaaatgtggtctgatatgctgaggggaagaaaaaaggaggatttcggtggcagataccatttctcgagggaattccgaattcgaagaaagcctgattaagggtggggcagaatggctaccctcaggnntaancccatggngttttagaaaaagggaaaggcagggccttgtcttacttt

SEQ ID NO: 25633 - protein, 127 aa, Zea mays
  misc_feature: Ceres CLONE 1397632-F
MAEVLSGSHEHRLSSALDGHYDEKRKSNVEYTEDEKKAVIAALKKKALSASQKFRHSMKRGRKSSKVMSISILDEREPEEVQAVDAFRQLLVLEELLPSQHDDYHMDAKISQRQESLDIEKAKANVV

SEQ ID NO: 25634 - DNA, 726 bp, Zea mays
  misc_feature: Ceres CLONE 1397636-F
  misc_feature: Encodes the peptide sequence at SEQ ID NO. 25635
  misc_feature (626)..(626): n is a, c, t, g, unknown, or other
aaagctggagctccccgcggtggcggccgctctagaactagtggatcccccgggctgcaggaattcgcacgagaccattacctagaacatcctaatcaaaaggtggttgacggccgcttacccgcaccggcgccatgcgcgcgcgcggctaggtggtcgaggtcaagccaaacgctgcccaccgcctctgcctctgcctcgcatatatcctcgcgcacgttctttgctcgtctcgcactcgcttccttcgacgactcatcgccgatcacaccaggctagctagcccacccacagtcgtagggccaggaccgatcggaggagctcggtttttcgaccaggaccgccgccgccacacccgaagaagccgacgatgcagacgacgacgtcctcggcggcggcgtcgccgcgcccgcgcgcgcgggcgccgcagtccgtggtggccgagctggagggcgcgctgctccggagcgcggacacgttcccgtacttcatgctcgtggcgttcgaggcgtccgggctgccgcgcttcgcgctgctgctggcgctgtggccgctgctgcggctgctggaggtggcgggccggcgcggcctggcgctgcgcgccgccgcgttcgtggccaccgcgntcgtgccgcgcgccgaggtggaggcagtgtcgcgcgccgtgctgcccaagtcatgcccgacgacgtcgtccccgccgcgtggggcggcttcgggagctgc

SEQ ID NO: 25635 - protein, 118 aa, Zea mays
  misc_feature: Ceres CLONE 1397636-F
  misc_feature: SWISSPROT Homolog: EC 2.3.1.15 Glycerol-3-phosphate O-acyltransferase
  misc_feature (86)..(86): Xaa is any aa, unknown, or other
MQTTTSSAAASPRPRARAPQSVVAELEGALLRSADTFPYFMLVAFEASGLPRFALLLALWPLLRLLEVAGRRGLALRAAAFVATAXVPRAEVEAVSRAVLPKSCPTTSSPPRGAASGA

SEQ ID NO: 25636 - DNA, 565 bp, Zea mays
  misc_feature: Ceres CLONE 1397639-F
  misc_feature (344)..(344): n is a, c, t, g, unknown, or other
  misc_feature (423)..(423): n is a, c, t, g, unknown, or other
tggagctccccgcggtggcggccgctctagaactagtggatcccccgggctgcaggaattcgcacgagaccattacctagaacatcctaatcgaaaaaaggcttcgttctgctctccggctctcccacatccaccccgtctcatccccaatccgaccacctcatccctcgcctcctggccctacccctcgcgtcaccgggggggcatgagccggtgactgctcacgcggactcgtctgtctgcgcacgcgcgcgtagtcgcgagtgacattgcgtcgtccgcgatcgcccgtgatgacatgactgcgggacggggtctacggtgatactgcacgggtctgcggntctgacactacatcagaccgcgagtgtggacagctgcatatgacagatctctccccgtcgtcgggactacgccacaagnaagacgactccagatgacggggaatagttgaggaaatcagcaggcagggtccacgcctcacaccaaaggtgctatgggaagggggcctgcagtggaaatttctcgccctgggattggagcgggaaataagttcggagcaagg

SEQ ID NO: 25637 - DNA, 738 bp, Zea mays
  misc_feature: Ceres CLONE 1397644-F
  misc_feature: Encodes the peptide sequence at SEQ ID NO. 25638
  misc_feature (572)..(572): n is a, c, t, g, unknown, or other
  misc_feature (573)..(573): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
tccccgcggtggcggccgctctagaactagtggatcccccgggctgcaggaattcgcacgagaccattacctagaacatcctaatcgaaaacacataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcatcgtgggcggcggcacggccgggtgcccgctggccgccacgctgtcggagcgcttccgcgtgctgctgctggagcgcggcgcctcgccctacgacgacgaccgcatcggggacatggcccgcttcgcggacacgctgtcggacacctccccgggctcgcccgcgcagcgcttcgtgtcggaggacggcgtcatcaactcgcgcccgcgggtgctgggcggcggcagctgcatcaacgccggcttctacacgcgggccagcgacgactacgtgcggnngcgtcgggtgggacctgggcgccgccggggcggcgtaccggtgggtggaggaccgtggtggcgttcagccggagtggggnnnccttggcaggcccgcgctgcagggcggcctgctcccaggccggggtcgcggcggacaacggcttcacgttcgaacacttcgag

SEQ ID NO: 25638 - protein, 199 aa, Zea mays
  misc_feature: Ceres CLONE 1397644-F
  misc_feature: SWISSPROT Homolog: EC 4.1.2.10 Mandelonitrile lyase
  misc_feature (145)..(145): Xaa is any aa, unknown, or other
  misc_feature (172)..(172): Xaa is any aa, unknown, or other
MSGRSRHFTMSTLLATSFFFVLLCSSLQVRGVNYTFVKDAALAPSVSYYDYIIVGGGTAGCPLAATLSERFRVLLLERGASPYDDDRIGDMARFADTLSDTSPGSPAQRFVSEDGVINSRPRVLGGGSCINAGFYTRASDDYVRXRRVGPGRRRGGVPVGGGPWWRSAGVGXPWQARAAGRPAPRPGSRRTTASRSNTS

SEQ ID NO: 25639 - DNA, 714 bp, Zea mays
  misc_feature: Ceres CLONE 1397646-F
  misc_feature: Encodes the peptide sequence at SEQ ID NO. 25640
  misc_feature (558)..(558): n is a, c, t, g, unknown, or other
  misc_feature (559)..(559): n is a, c, t, g, unknown, or other
  misc_feature (588)..(588): n is a, c, t, g, unknown, or other
  misc_feature (606)..(606): n is a, c, t, g, unknown, or other
  misc_feature (677)..(677): n is a, c, t, g, unknown, or other
  misc_feature (714)..(714): n is a, c, t, g, unknown, or other
tccccgcggtggcggccgctctagaactagtggatcccccgggctgcaggaattcgcacgagaccattacctagaacatcctaatcgaaaaacacaatacgcacacttcgcaaagcgtcttcctccgaccccatcgcctctgtggcttcctggctgtctgactgcgtctgcctggtcgtacgcgagcgcgtgcgtcccttcaccgtcacgagcggcgcacaccgtcaccgccacgctccgtcgccttccagaaaatctaaaccccagcggagccggccacggccagtcagccctcacacggactccgacgcgctgcccgctcgcctgccaaacccccaccccctcgccggcgatgctgccgcgtcgctttagcaaccacccgggctcctcctcacccctcccgttcctcgtcgtctgcggcctgctcctcgctgcggccgtagcattttccccggccgctgccgccgaggccgctggccgcggcggcggcggcggcggcgctgggcacgagggccgcgcggggaagccggaggtcgaggcggaggcggaggcgcgcgnngatggggtggccgtggcggaggccggcgncgaggtgatggctcaggncaatgccacggaggccaaggagggcagcctcgccgacatgatcgaccgcgcgctgggagagggagtcccgnagtccgagagcgagcagggcggcggagagaccgatcn

SEQ ID NO: 25640 - protein, 120 aa, Zea mays
  misc_feature: Ceres CLONE 1397646-F
  misc_feature (69)..(69): Xaa is any aa, unknown, or other
  misc_feature (79)..(79): Xaa is any aa, unknown, or other
  misc_feature (85)..(85): Xaa is any aa, unknown, or other
  misc_feature (109)..(109): Xaa is any aa, unknown, or other
MLPRRFSNHPGSSSPLPFLVVCGLLLAAAVAFSPAAAAEAAGRGGGGGGAGHEGRAGKPEVEAEAEARXDGVAVAEAGXEVMAQXNATEAKEGSLADMIDRALGEGVPXSESEQGGGETD

SEQ ID NO: 25641 - DNA, 669 bp, Zea mays
  misc_feature: Ceres CLONE 1397647-F
  misc_feature: Pfam Name: TENA_THI-4 Pfam Description: TENA/THI-4/PQQC family
  misc_feature (404)..(404): n is a, c, t, g, unknown, or other
  misc_feature (412)..(412): n is a, c, t, g, unknown, or other
  misc_feature (485)..(485): n is a, c, t, g, unknown, or other
  misc_feature (569)..(569): n is a, c, t, g, unknown, or other
tggcggccgctctagaactagtggatcccccgggctgcaggaattcgcacgagaccattacctagaacatcctaatcgaaaattctgcccgcttggagtccccgtcttcgtcgtcttgtagtagcactgagtgcgggagtactggccggccggcggcgaggctcctccactttctctgcacccatacatacgtatatgcttgttctccgccgtctccgcctccgcctcccactgccacgccctcttctcgtctcctccttctcctccacctccccctcctcctcaccctcgacctctagctcctcctcctgttggtcgtcgacaggcgaaagtagaagggccatggcgtcatctccttctcccgatttcggccgcggcgttttgccgaggggctccgcggctcngccgcttnctggatcgctgcctccacgcgcgaggccgccttcgccgcatacacgcccttcctcctctccctcgccgccggnaactgcggcctcaacgtgtttcgccactacatcgcgcaggacgcgcacttccttcacgccttcgctcgcgcgtacgaaaatggncgaggactgccgctgatgatgacgacgacatggccaccatagcccgccctcaggaaggccatcctcccagagctcaactccactcctccggtctgagggg

SEQ ID NO: 25642 - DNA, 698 bp, Zea mays
  misc_feature: Ceres CLONE 1397648-F
  misc_feature: Encodes the peptide sequence at SEQ ID NO. 25643
  misc_feature (385)..(385): n is a, c, t, g, unknown, or other
  misc_feature (425)..(425): n is a, c, t, g, unknown, or other
  misc_feature (433)..(433): n is a, c, t, g, unknown, or other
  misc_feature (437)..(437): n is a, c, t, g, unknown, or other
  misc_feature (520)..(520): n is a, c, t, g, unknown, or other
  misc_feature (542)..(542): n is a, c, t, g, unknown, or other
  misc_feature (695)..(695): n is a, c, t, g, unknown, or other
agagctggagctccccgcggtggcggccgctctagaactagtggatcccccgggctgcaggaattcgcacgagaccattacctagaacatcctaatcgaaaaatcgaccggacctgagcgctctcgttctctctactcctccgttctctctcacgcgagcagtgcatccttgagccaccgccgccgtgaggagctccgcccgtccgccgtcatccgtcaaatcaggtggccatttggtacaggcgtcggactcccaggaggatgaccggtggcaagaggttcggcggcgggcgggtgccgacggggaccccgtccctcgcgtggtcgtccgtcgtcatcgtcgcctccctcctcgttggcgcctccatcgtccacaacatctacnagcctgacatgaccattccacctggtggagggtgccgccnggcggcgncggncaagaaagctgagctacgaatggctggacactgcatgcaagagaggaggctgggcatgggagtagtgagggaccggccatcancacctttttttttttgttctanaacaaaacggtattatggtggtcttttctggtttgctaccaaaggggggaggctgcataaaatttgcttccttaggggccactgggcccgcgtaaccctggcaaaggaccccgacctcgttttttccagaggctaagagcccctacctccccnaag

SEQ ID NO: 25643 - protein, 138 aa, Zea mays
  misc_feature: Ceres CLONE 1397648-F
  misc_feature (42)..(42): Xaa is any aa, unknown, or other
  misc_feature (55)..(55): Xaa is any aa, unknown, or other
  misc_feature (58)..(58): Xaa is any aa, unknown, or other
  misc_feature (59)..(59): Xaa is any aa, unknown, or other
  misc_feature (87)..(87): Xaa is any aa, unknown, or other
  misc_feature (94)..(94): Xaa is any aa, unknown, or other
MTGGKRFGGGRVPTGTPSLAWSSVVIVASLLVGASIVHNIYXPDMTIPPGGGCRXAAXXKKAELRMAGHCMQERRLGMGVVRDRPSXPFFFCSXTKRYYGGLFWFATKGGRLHKICFLRGHWARVTLAKDPDLVFSRG

SEQ ID NO: 25644 - DNA, 677 bp, Zea mays
  misc_feature: Ceres CLONE 1397649-F
  misc_feature: Encodes the peptide sequence at SEQ ID NO. 25645
  misc_feature (459)..(459): n is a, c, t, g, unknown, or other
gctctagaactagtggatcccccgggctgcaggaattcgcacgagaccattacctagaacatcctaatcgaaaaacccctgttcctctgcgatttgggctcgtcctgtgtccttcctgttgctcaaaagctcgctcattcgatgtccctgtctgaaaggcgacaaatcccactggaattcggagcacagagctttgaatccaggggccaaaactttttgctcatctcccttgcggaaaagcgcctcctctgcgtctgaaagtcggatcttttttcacagattcgatttgaagttcccgagcagctcgaggaccgcggtgtcggtaagacttgctttgaagatcttgatcaccacaagagatttgctgaatttccggtcactgtactttttccactggacatgtcctttcgcagcatagtccgtgatgttagggaaagctttggtagcttatcaagaggnagccttgaggccaggattttctggtttggcctggtctgtctaaatctggtgggaatcggtgagtgacctgcgcgacagaactggtaatagttgacaaagccagggggggggttgggcctccccccctgaatgggttccgagatggaaaggaaaagggcttggagggaagggggaaagcaactgggccaccccgggaaaaaaggtgtgtgccccggggc

SEQ ID NO: 25645 - protein, 41 aa, Zea mays
  misc_feature: Ceres CLONE 1397649-F
MSFRSIVRDVRESFGSLSRGSLEARIFWFGLVCLNLVGIGE

SEQ ID NO: 25646 - DNA, 758 bp, Zea mays
  misc_feature: Ceres CLONE 1397651-F
  misc_feature (261)..(261): n is a, c, t, g, unknown, or other
  misc_feature (294)..(294): n is a, c, t, g, unknown, or other
  misc_feature (352)..(352): n is a, c, t, g, unknown, or other
  misc_feature (369)..(369): n is a, c, t, g, unknown, or other
  misc_feature (610)..(610): n is a, c, t, g, unknown, or other
  misc_feature (719)..(719): n is a, c, t, g, unknown, or other
  misc_feature (720)..(720): n is a, c, t, g, unknown, or other
ggagctccccgcggtggcggccgctctagaactagtggatcccccgggctgcaggaattcgcacgagaccattacctagaacatcctaatcgaaaacccccacagaaccgtctccccagcccggcgcctcacggtcgcaatttattgcttgcgcaccgcctcgccgctttggcgtggggcgtttgcctgtgtggcgctgggcatgtgccgtgcccgtggcttgcttcgtcgtgctcactagtcacgagagagggaggaggntctgcttctgctggcgcttcttcttcctctggntgctccccggaagataagcaagggggcgggaacagctgactacctaaaaggcttgggnatggaccccggcggggnaaatttggccgtaagatttacccgggccaaaagagagggggaaaattgggaaaaaaacgcccccccggggaaccccccaaagttcccccccgggccctccggggggtttttccctgggggacccgggggcaattttcccccgcggggagggggggcccctcataattttgaggagccccccgcccctctccccaaaaaggggggtggggggggaaaaaaatcttcttgggggggggtgggncccccccccccaaaatcctccaacgtttccggggaggattaaatttttggggcgcgctccttccgccgcaggagagagcgaaccctccctccttcacaaaaaaagaggnngtgtctttttctcccgcgggagggggcgtgtgtgcgcg

SEQ ID NO: 25647 - DNA, 746 bp, Zea mays
  misc_feature: Ceres CLONE 1397652-F
  misc_feature (670)..(670): n is a, c, t, g, unknown, or other
tccccgcggtggcggccgctctagaactagtggatcccccgggctgcaggaattcgcacgagaccattacctagaacatcctaatcgaaaagagcagcagaccacgaccagcacgcccacttgcctgcgattactttgcgccagagggcagaggccttggccctgccatcgttgttcttatccccccttcctctttctttctcctccctcttgcggcttctctctggactcgcccctccctccgtctcgtctcccagggcatggcaaagctggaacacccgtgaatatagcaagtgggagataaacaggaagagctagggtgaatactaaatacaagtagcagtagaaggaaaagagtcagtccgcccgtgactacgagtgaatttgttgggtgtggagtttgttgaggtcacgatgatgggaggcggtctgttggtggatcagagcgtggtgttccctgtcgtccacaacttcgtggatctcctgcagcagaacggcgactagaacctgggcttcgggtctctgatgccgcagacgtcctctggcgaccagtgcgtgatgggggagggcgatctcgtggacccgcctccggatagcttcccggacgccggctaggacgacagcgacgatgacgtcgaggacatccaggagctggagcggcgcatggtgncgcgactgcatgtagctgaaagcgctccaggaactgcagcagaacaggcggaagggactcttggctagcggtgggg

SEQ ID NO: 25648 - DNA, 712 bp, Zea mays
  misc_feature: Ceres CLONE 1397653-F
  misc_feature: Encodes the peptide sequence at SEQ ID NO. 25649
aaagctggagctccccgcggtggcggccgctctagaactagtggatcccccgggctgcaggaattcgcacgagaccattacctagaacatcctaatcgaaaagctgaagccactagccggctgcctgctctacttcctccgaaccgaacgaggtgcatcgtgaggaagcagcagcagggggggcagtggccgggcgggatgacggggagggaggccgtggcggcggcggaggcggagctggatcaggactcggcggcggcggcggcgcccgtgctgctgagcccgctcagcgagacgctgtggcgcgacagggcggcggcggcggcgggcggggtcctcgtcggggacgtgtcggcgcgcctggcgtggcgcgacctcaccgtgaccgtcgcgctcggctccggcgacacgcaggccgtgctgcagggcctcacggggcacgccgagcccggcaccatcaccgcgctcatggagccgcccggctccggcaagtccactctgctcgaaacgttcttcgcccgcctcgccgtcgacggccttatctccggaaccccccccctcaacgggcgccgcgcgcaacctctttccctgccgccgttgtcctccggcgtccgccgcgcgcccccctcgactcaacacgatccagtgtggcccccccccgatcttaattcccccccccgttctcgggcgtccccgggcgccgtgcgcgaat

SEQ ID NO: 25649 - protein, 171 aa, Zea mays
  misc_feature: Ceres CLONE 1397653-F
  misc_feature: SWISSPROT Homolog: EC 3.6.3.27 Phosphate-transporting ATPase
MTGREAVAAAEAELDQDSAAAAAPVLLSPLSETLWRDRAAAAAGGVLVGDVSARLAWRDLTVTVALGSGDTQAVLQGLTGHAEPGTITALMEPPGSGKSTLLETFFARLAVDGLISGTPPLNGRRAQPLSLPPLSSGVRRAPPSTQHDPVWPPPDLNSPPRSRASPGAVRE

SEQ ID NO: 25650 - DNA, 761 bp, Zea mays
  misc_feature: Ceres CLONE 1397654-F
  misc_feature: Encodes the peptide sequence at SEQ ID NO. 25651
  misc_feature (543)..(543): n is a, c, t, g, unknown, or other
  misc_feature (580)..(580): n is a, c, t, g, unknown, or other
  misc_feature (757)..(757): n is a, c, t, g, unknown, or other
aaagctggagctccccgcggtggcggccgctctagaactagtggatcccccgggctgcaggaattcgcacgagaccattacctagaacatcctaatcgaaaagtcggaagctcccttcatttctttcacctccgattcgattccttgtcccctcttgatccgagccgccaccaaaccctaactatctaaaacccccgtctcgctgtccgatggccgccgcctcgccgccgccctccccaccccacgcaaagcgccccaagatgtcctcctcctccgacccggaagccgatgctgagcccacctcggcctccgccgccgttgagggcgccgatcctgcgcagcgtcgtcccaggtacaagcgccgcaaggtcgccatccttctcgggtactgcggcgcggggtatcagggcatgcagaagaatccgggcgcgcgcaccatcgagggggacctcgaggaggcgctctaccaggcgggcgccgtgcccgaggccgaccggtccgcgccgcgccgttacgattgggcacgtgctgcgcgcaccgacnagggcgtcagcgccgcggcggcagggtggtgtccggncgcttctacgtcgacccgccgggcttcatcgatcgcttgaacgcgcagctcgcgccgcagatccgcgcctacggctacgtgcgcgttacaactcatttcaacgcgaaaagtctgcgaaacggcggaggtacctgtatctggctcccgtatttgctcttgaccccagcgacacccggnacgg

SEQ ID NO: 25651 - protein, 136 aa, Zea mays
  misc_feature: Ceres CLONE 1397654-F
  misc_feature: SWISSPROT Homolog: EC 5.4.99.12 tRNA-pseudouridine synthase I
  misc_feature (112)..(112): Xaa is any aa, unknown, or other
  misc_feature (124)..(124): Xaa is any aa, unknown, or other
MAAASPPPSPPHAKRPKMSSSSDPEADAEPTSASAAVEGADPAQRRPRYKRRKVAILLGYCGAGYQGMQKNPGARTIEGDLEEALYQAGAVPEADRSAPRRYDWARAARTDXGVSAAAAGWCPXASTSTRRASSIA

SEQ ID NO: 25652 - DNA, 736 bp, Zea mays
  misc_feature: Ceres CLONE 1397655-F
  misc_feature: Encodes the peptide sequence at SEQ ID NO. 25653
  misc_feature (685)..(685): n is a, c, t, g, unknown, or other
  misc_feature (686)..(686): n is a, c, t, g, unknown, or other
ggagctccccgcggtggcggccgctctagaactagtggatcccccgggctgcaggaattcgcacgagaccattacctagaacatcctaatcgaaaagtccctccactcctcccgtcgagcacttggcactgccaatggcggcagccgcccacaccccttcgatgcgcgcaagccgcctcctttcctcctgagatcgacgcacctcctcctctcgtactccattcccgctccaagttcgtttcttcggcaccgagccatcgcacggccgcccccgcatctcgtcctgctctcaggtccttggcctccgccgttcttcgacaggggcgcgccccggtgcccactccgcgaaatccgagtcccttgtgcagctccgtagggtggaagagatccatcaggcggtgagcggtaggaggcgcccgtacaactgaggggacgggcaatggcggccgtggcaggcccactctgcacgtggctcgtcgccgcgtgcttgtctgcggcttgcgacgcagaagagtacaagcagaagcattgctgccccggcggaagcggcgcttgggggcggcgtcatgctcggcctgcgccgccgcctcggcgcgcggcgtcgcggcttggcgcgctctggatgggctatggctgttgcctttacagctgaaagaagtgtcattgaaaagagaacccgatacannacaaggggaggtgggtgcactgggcatgggtgtagtgacacattgggcac

SEQ ID NO: 25653 - protein, 70 aa, Zea mays
  misc_feature: Ceres CLONE 1397655-F
MAAVAGPLCTWLVAACLSAACDAEEYKQKHCCPGGSGAWGRRHARPAPPPRRAASRLGALWMGYGCCLYS

SEQ ID NO: 25654 - DNA, 715 bp, Zea mays
  misc_feature: Ceres CLONE 1397656-F
  misc_feature: Encodes the peptide sequence at SEQ ID NO. 25655
  misc_feature (531)..(531): n is a, c, t, g, unknown, or other
aaagctggagctccccgcggtggcggccgctctacaactagtggatcccccgggctgcaggaattcgcacgagaccattacctagaacatcctaatcgaaaagatccgatggcccgcgccgccgctcgcctcctccccatcttcctcccatggcggcgtcctcccccgccctgcctcctccgccggggcttcctaaaccctagcagccccagaacctccgcgcgcgtcgacaccctcgttctccctggagacgagcgcttgcccttcccctcgcccccacgcctcccgaaccagctgcgtcctgactacgggagtggcggcggaggcggcgctccctcgaccatcgcggccatcgtcacctcactcggcggaggccctgcagcggtggggatcgtgcggatctccggccccgatgccgtcgccgtcgccgaccgcgttttccgcccagccgggaccaggagggcgtcgacgccgtggcaaccgcgcagccactttgttgagtacggactcgcgctcgacgcggacggcagngttaattgacgaggctttggggggtgccaatgctcctccccgaggtcctacacgccaaaaggaaggtgcggcactttcagggccatggcaaacgatcccctggttgggcgcggggggaatcagcgtctgcgcttgcaacgttggggctcataccttgcttgatacctgggcgagggcttattta

SEQ ID NO: 25655 - protein, 143 aa, Zea mays
  misc_feature: Ceres CLONE 1397656-F
  misc_feature (141)..(141): Xaa is any aa, unknown, or other
MARAAARLLPIFLPWRRPPPPCLLRRGFLNPSSPRTSARVDTLVLPGDERLPFPSPPRLPNQLRPDYGSGGGGGAPSTIAAIVTSLGGGPAAVGIVRISGPDAVAVADRVFRPAGTRRASTPWQPRSHFVEYGLALDADGXVN

SEQ ID NO: 25656 - DNA, 474 bp, Zea mays
  misc_feature: Ceres CLONE 1397658-F
  misc_feature (440)..(440): n is a, c, t, g, unknown, or other
  misc_feature (441)..(441): n is a, c, t, g, unknown, or other
  misc_feature (443)..(443): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
ggagctccccgcggtggcggccgctctagaactagtggatcccccgggctgcaggaattcgcacgagacattacctagaacatcctaatccaaaaacaccaacccgttctgcctccgcttcgatcatggggtggtcgcgctttcgtcgccgccatcaacggtgtcgctatctcctccctatccggcgtccgcgatggtcgccacccctcctccccccacgcgtggagtcgcatgtccctccctccctcgtcggctcgtccctccgcctttcgtggggggctgaaaaaggtcaagagccccaacccccaggggggcattcgcccacttcctggaaccggacccccgggccccccaatggccgggggggggcccaaaaccaaaccccttatttgcccctaaaaaggaaaattttttaaaaaacccccggggggggggggggnngnccccnnnncctccggggggggttttataaaa

SEQ ID NO: 25657 - DNA, 674 bp, Zea mays
  misc_feature: Ceres CLONE 1397660-F
  misc_feature: Encodes the peptide sequence at SEQ ID NO. 25658
  misc_feature (438)..(438): n is a, c, t, g, unknown, or other
  misc_feature (493)..(493): n is a, c, t, g, unknown, or other
  misc_feature (578)..(578): n is a, c, t, g, unknown, or other
  misc_feature (579)..(579): n is a, c, t, g, unknown, or other
  misc_feature (589)..(589): n is a, c, t, g, unknown, or other
  misc_feature (627)..(627): n is a, c, t, g, unknown, or other
  misc_feature (628)..(628): n is a, c, t, g, unknown, or other
  misc_feature (644)..(644): n is a, c, t, g, unknown, or other
  misc_feature (657)..(657): n is a, c, t, g, unknown, or other
tggagctccccgcggtggcggccgctctagaactagtggatcccccgggctgcaggaattcgcacgagaccattacctagaacatcctaatcgaaaagttccctccccgagtcgatatctcaccgtcgtgcgagtaaaacaaagcctcgccgccacggcgccacgcgagcaaagacctagcgcgagcaagcaagggaggcagagaccttagtgcgtcgcgcaacgcggctcggcccgacggcatggagagcctcgtcctcgcctcctcctgctccccgtccccacggctgccgctactctcccccttcgcccgcttccgccggctgcccggctccatgccacaggcgccggcgtccaccagcggtgccacgcggaaaggtcccaggaggcacatgcttcttcgtcgccgccgccacccgcggccctttccggatcagnaacgtttttcaggattgagagcaaaagcttttgcagcatgtcatcttcgactggncatgagaatatgtctactggaactggcaccctgcctccccatgctccccatcatcatacattggttcacctgtttttctgattgnnagttgtgtancattgtctgtggcgtttacccacggtttcttcatgctnnaagaatatgccatggnacaagcatttaangtcatgatgaccccagc

SEQ ID NO: 25658 - protein, 137 aa, Zea mays
  misc_feature: Ceres CLONE 1397660-F
  misc_feature (66)..(66): Xaa is any aa, unknown, or other
  misc_feature (84)..(84): Xaa is any aa, unknown, or other
  misc_feature (112)..(112): Xaa is any aa, unknown, or other
  misc_feature (113)..(113): Xaa is any aa, unknown, or other
  misc_feature (116)..(116): Xaa is any aa, unknown, or other
  misc_feature (129)..(129): Xaa is any aa, unknown, or other
MESLVLASSCSPSPRLPLLSPFARFRRLPGSMPQAPASTSGATRKGPRRHMLLRRRRHPRPFPDQXRFSGLRAKAFAACHLRLXMRICLLELAPCLPMLPIIIHWFTCFSDXXLCXIVCGVYPRFLHAXRICHGTSI

SEQ ID NO: 25659 - DNA, 683 bp, Zea mays
  misc_feature: Ceres CLONE 1397663-F
  misc_feature: Encodes the peptide sequence at SEQ ID NO. 25660
  misc_feature (446)..(446): n is a, c, t, g, unknown, or other
  misc_feature (543)..(543): n is a, c, t, g, unknown, or other
tccccgcggtggcggccgctctagaactagtggatcccccgggctgcaggaattcgcacgagaccattacctagaacatcctaatcgaaaaagccgccacctcaccccccccatcggccgcctgcgtcccaccacccgctcctgctgccgggcctgccgcccgttgctctcgccactgaagccctcgccgccgcctccgcctccgcccgcttgcttgccctcctgccggctgcctcccggatgagaagcggcgcaacctgggcagcggaagcgtggtcggcctgagccttcgccggggtttctgccgagaaggatcctggagattaagcgcatgggttccttggaggcccggtacaggccggccggggcagctgaggacacagctaagagaaggacccaaaaaagcaaaagtttcaaagaggttgaaaaatttgatgtttttggcntggagaaaagtcctggttgcaagttccgatcgatgcaacttttctcttcgctatcatgtctgctgcatttctaacaatcctatacacaccatctgtngtatgaacatcagttgcagtcaagctctcggttgtcaatgggtgataggggaaaaaaaaagaggagttctgatcccccgatatgtatcttctgctacattcaagggggaagatgggaatataaaagtatccaaaatctgg

SEQ ID NO: 25660 - protein, 62 aa, Zea mays
  misc_feature: Ceres CLONE 1397663-F
  misc_feature (39)..(39): Xaa is any aa, unknown, or other
MGSLEARYRPAGAAEDTAKRRTQKSKSFKEVEKFDVFGXEKSPGCKFRSMQLFSSLSCLLHF

SEQ ID NO: 25661 - DNA, 710 bp, Zea mays
  misc_feature: Ceres CLONE 1397668-F
  misc_feature: Encodes the peptide sequence at SEQ ID NO. 25662
  misc_feature (512)..(512): n is a, c, t, g, unknown, or other
  misc_feature (544)..(544): n is a, c, t, g, unknown, or other
  misc_feature (695)..(695): n is a, c, t, g, unknown, or other
agagctggagctccccgcggtggcggccgctctagaactagtggatcccccgggctgcaggaattcgcacgagaccattacctagaacatcctaatcgaaaaattatcgatcccacgcccaggccatgcagacgaggcgcaggacgtcgctgctctggcccgccgtcccccagttcctgaccctgagcgtcaccgagcatctcgaaccggaacgatactataaagtcctacattgtgcatctggcatcacatgacatatggccgcgatgagaagttggaggagcatgatcgcgcaacccagtctcaccaccacctcctggcatcgatcctcggcggcgacgacgaccaccaccatgagacggcgcggcagtccatcttctactcctacaccaagagcagcatcaatggcttcgcggcgcacctggaggagtcggtcgcgcagcagatcgcggagcaccctgaggtggtggcggtgctggagagcaagatgctcaagctgcacaccacgcggncctgggacttcatggacctggagcgcgacggncacgccttctctggctccatctggaaccacgctaggtttcggaaggaggttctcgccgccagtttcgacggctggagtgggcgccaggtccctaaattataatcacaaggcgcccccaggacctaaatcgcgccgaaggttccctatcttnacgccggacaggcct

SEQ ID NO: 25662 - protein, 131 aa, Zea mays
  misc_feature: Ceres CLONE 1397668-F
  misc_feature (17)..(84): Pfam Name: Subtilisin_N Pfam Description: Subtilisin N-terminal Region
  misc_feature: SWISSPROT Homolog: EC 3.4.21.25 Cucumisin
  misc_feature (88)..(88): Xaa is any aa, unknown, or other
MTYGRDEKLEEHDRATQSHHHLLASILGGDDDHHHETARQSIFYSYTKSSINGFAAHLEESVAQQIAEHPEVVAVLESKMLKLHTTRXWDFMDLERDGHAFSGSIWNHARFRKEVLAASFDGWSGRQVPKL

SEQ ID NO: 25663 - DNA, 665 bp, Zea mays
  misc_feature: Ceres CLONE 1397669-F
  misc_feature: Encodes the peptide sequence at SEQ ID NO. 25664
  misc_feature (569)..(569): n is a, c, t, g, unknown, or other
  misc_feature (583)..(583): n is a, c, t, g, unknown, or other
  misc_feature (590)..(590): n is a, c, t, g, unknown, or other
cgcggtggcggccgctctagaactagtggatcccccgggctgcaggaattcgcacgagaccattacctagaacatcctaatcgaaaaaaaacgccccacagcgcaagcgagcagatcctcctccctttctgcttcctggcatcctctctgcctccccgcgccgatctcgagcacctggggagaccgcgagacgtgcgcctgatttttctcatcgcagcagccctcaagttccccacctcttttttcttgcagctttcaattaatctggttatttagctacatctttattttactttcattttacctttaatctgtttagttccattgcatcttctgcggttgcggttagtattgctgtttcttgctccttgtttcttgttcttttgcttctaaccatggacgcaggaacctactccatctcatcagagaagagccacacggcggcaagcggcgcggcccccctcttcaggaggccggcactcggccctacatgccgtcgctgagcacaggatcgcgcaacccgtcggccaagtgctacgggcgatagttcattccccggacgggtcggncgatgggatatggnacatggncgcactacctgctcacggagcccaggagggacagggaaggacgccgggtggcagcgtcccattccaaggaggggg

SEQ ID NO: 25664 - protein, 31 aa, Zea mays
  misc_feature: Ceres CLONE 1397669-F
  misc_feature (7)..(7): Xaa is any aa, unknown, or other
MGYGTWXHYLLTEPRRDREGRRVAASHSKEG

SEQ ID NO: 25665 - DNA, 730 bp, Zea mays
  misc_feature: Ceres CLONE 1397670-F
  misc_feature: Encodes the peptide sequence at SEQ ID NO. 25666
tccccgcggtggcggccgctctataactagtggatcccccgggctgcaggaattcgcacgagaccattacctagaacatcctaatcgaaaaaacactccagtccactacaatcatcgctgtaggagatggaggaggcggcggcggcggcggcggcggaggtgaggtatgggatagtcggggtggggatgatgggccgggagcacctccacaacctcgcccacctcgccacacaggtcgagcggggttgtgcttgcgctccggtggccaacatcgcctaatcctcgctcggccccgctgtcctcgccaagatgctagtgggcgttattggcgatggtaccatcactaatgatgcagccaccatacttaagatgttggaagttcttcctctcggcgacaagctccttgttgagttggctgagctcccagatcctgaggttggaaatgtaactacttccgttgtcatcatagccggcgggttactcaagagaggctttgctcttgccgcaaacttcatctctcctaacttctataatccagtggttccagtctctgtttgcctgaatgctgcaaaattcttccgccacagtcaccatctacggcttgctctcttggacctcagtcccttttccacttttccaaaactacagggcttccaaagtttttagtgcgcgtcgccattcctttcgcaccttggtcgtttggccgttccgcctctcttctctacattgg

SEQ ID NO: 25666 - protein, 50 aa, Zea mays
  misc_feature: Ceres CLONE 1397670-F
MEEAAAAAAAEVRYGIVGVGMMGREHLHNLAHLATQVERGCACAPVANIA

SEQ ID NO: 25667 - DNA, 697 bp, Zea mays
  misc_feature: Ceres CLONE 1397673-F
  misc_feature (72)..(72): n is a, c, t, g, unknown, or other
  misc_feature (73)..(73): n is a, c, t, g, unknown, or other
  misc_feature (107)..(107): n is a, c, t, g, unknown, or other
  misc_feature (272)..(272): n is a, c, t, g, unknown, or other
  misc_feature (293)..(293): n is a, c, t, g, unknown, or other
  misc_feature (314)..(314): n is a, c, t, g, unknown, or other
  misc_feature (315)..(315): n is a, c, t, g, unknown, or other
  misc_feature (319)..(319): n is a, c, t, g, unknown, or other
  misc_feature (632)..(632): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (640)..(640): n is a, c, t, g, unknown, or other
cgcggtggcggccgctctagaatagtggatcccccgggctgcaggaattcgcacgagaccattacctaagannacatcctaatcgaaaaatgtcccaaagcaaagcnaaagcttcaaagcatctctgcttggattttagcgagcggcaacgacgagcgacccaatggggttcgtgctggtggtctctctgcccttcatcttcctctcatcctcctcggcttcggctgctacttccctcggcagcacaggggccgggaggagatgcggaccgncgtcggcgcgcagatctacgncacgccgctgccgccgcccgnngtcntcggagcctccctcgccggcggctggacccgtcccacgcaagaaacaatggtccgagggttgggggactggaaattcaaaagtctccccacccatcattttcaaaaaaaaatttaaaggggctgggggggagaaggtggattttaatttttttctttttaattcccccggggttgtttgagaggggaaatttggaaaaacaatgtgggtttggggggggggtggggggaacaattgccccccctcctttttttttctttgaaaaaaaaaaaaaacagggggtgaaaaaaaaagggtgtgggggggggaaaaangnnnnncncacaaataacaccccggagagaaaaaaaaagggaatatttgtccgccccgcccggcg

SEQ ID NO: 25668 - DNA, 682 bp, Zea mays
  misc_feature: Ceres CLONE 1397674-F
  misc_feature: Encodes the peptide sequence at SEQ ID NO. 25669
  misc_feature (518)..(518): n is a, c, t, g, unknown, or other
  misc_feature (519)..(519): n is a, c, t, g, unknown, or other
  misc_feature (543)..(543): n is a, c, t, g, unknown, or other
  misc_feature (572)..(572): n is a, c, t, g, unknown, or other
tccccgcggtggcggccgctctagaactagtggatcccccgggctgcaggaattcgcacgagaccattacctagaacatcctaatcgaaaaccacaacaccagaatccgcgaatcacagacgcgtctatctcagcttgctgcactgcactaccctgccctgccatcatatcgtacgtgagcccggccgagcgagagcgagggagaggcatggctgctccgaagctcgcgacgctggcgctggccgtgctcctggcggcgaccgtggtggctcccccggccgcggtgcgcgcggcgatgtcgtgctccaccgtgtacagcacgctgatgccgtgcctgccgttcgtccagatgggcggggccatgccgccccagccgtgctgcggcggcatccgcagcctgctgcagcaggccaacaacacccccgaccgccgcaccatctgcggctgcctcaagaacgtcgccaacggcgccaaacgggagcggcacctacatcagccgcgccgccgcgctgcccagnnaagtgcggcgtcgccctggcgtancagatcagcaccaacgttactgcaccggnataataggggggatggagggccctggggcgcgtccggggcgaggaatgctgccatggcgcttggcggaaagtaataaaatatggctacgggtattagccttttattgggg

SEQ ID NO: 25669 - protein, 145 aa, Zea mays
  misc_feature: Ceres CLONE 1397674-F
  misc_feature (32)..(109): Pfam Name: Tryp_alpha_amyl Pfam Description: Protease inhibitor/seed storage/LTP family
  misc_feature (104)..(104): Xaa is any aa, unknown, or other
  misc_feature (112)..(112): Xaa is any aa, unknown, or other
  misc_feature (122)..(122): Xaa is any aa, unknown, or other
MAAPKLATLALAVLLAATVVAPPAAVRAAMSCSTVYSTLMPCLPFVQMGGAMPPQPCCGGIRSLLQQANNTPDRRTICGCLKNVANGAKRERHLHQPRRRAAQXSAASPWRXRSAPTLLHRXNRGDGGPWGASGARNAAMALGGK

SEQ ID NO: 25670 - DNA, 662 bp, Zea mays
  misc_feature: Ceres CLONE 1397675-F
  misc_feature: Encodes the peptide sequence at SEQ ID NO. 25671
  misc_feature (344)..(344): n is a, c, t, g, unknown, or other
  misc_feature (370)..(370): n is a, c, t, g, unknown, or other
tcagaactagtggatcccccgggctgcaggaattcgcacgagaccattacctagaacatcctaatcgaaaactctattagaatagccaggggcctcgctcctctccaccacgtactccactccatccatccatcatcgtctatccatgaagagcttgcaggaggagagggcggcgttggtgccgtcgccgtggccccagcaacagagaaaggacggcggcgagcatgatccggagcagctgatggatgaggatgacggtgacgatgaggaggatctgcaggatgagcagcacacaagaacaattaggacgtcgaccaagacggcggaagcatcgtcatcacggnagcggcgggtggccggcgtggtgganggcggcggcgggcgcagaagctgggcccacccagaaggtgttggcctgggtcatcgccggtctccctcgtgctggtcttggctcgtcgtcgtcgggcggcggcggcaacaccagtccgtcgtcgctggatccacctcgataatggcatcgtcgtttctgctaggcagcggtgggcggcggcggcttgaagcagcatcaatgggctcctcaccacgtcccttcacccgtaggggacctcgtgccatacccttcagctgcggcggtaacggctcgtcatggtcccgttgtcaag

SEQ ID NO: 25671 - protein, 172 aa, Zea mays
  misc_feature: Ceres CLONE 1397675-F
  misc_feature (67)..(67): Xaa is any aa, unknown, or other
  misc_feature (75)..(75): Xaa is any aa, unknown, or other
MKSLQEERAALVPSPWPQQQRKDGGEHDPEQLMDEDDGDDEEDLQDEQHTRTIRTSTKTAEASSSRXRRVAGVVXGGGGRRSWAHPEGVGLGHRRSPSCWSWLVVVGRRRQHQSVVAGSTSIMASSFLLGSGGRRRLEAASMGSSPRPFTRRGPRAIPFSCGGNGSSWSRCQ

SEQ ID NO: 25672 - DNA, 669 bp, Zea mays
  misc_feature: Ceres CLONE 1397676-F
  misc_feature (364)..(364): n is a, c, t, g, unknown, or other
  misc_feature (368)..(368): n is a, c, t, g, unknown, or other
  misc_feature (445)..(445): n is a, c, t, g, unknown, or other
aaagctggagctccccgcggtggcggccgctctagaactagtggatcccccgggctgcaggaattcgcacgagaccattacctagaacatcctaatcgaaaaagtagccagagtgtgagctgacggcggacgtgctcgcctctcctctcctcacatttccggctcccctctccgcattccatggcaccgcattaccggtatttttagccgccggaggagacgggttgcgtagagagaggggaaaccagagctcctgactgttcctctctccctcctcacgggcgggctccgtctgttccgtccatccaccgccccggtcgtctcccgggcagatccctctccctgcaggtttctttgcgagtgnccgnagaagatgatgggcgggtccttctccaggtcctcctgctggcttttggctatgcctatcctgcctatgaatgctacnagaccgttgaactgacaaaccacagattgagagctcatattttggtgtcagtatgggatttttagtgccctgttgacagttttggagagattttggagattttaaatatcatggctaccgtttactaaaaggcaaaggggttgttctttgataattggggcaccctaaaacaaggggaacacgtatgtttatggaattttctttaacccaaaatttttccaaga

SEQ ID NO: 25673 - DNA, 617 bp, Zea mays
  misc_feature: Ceres CLONE 1397677-F
  misc_feature (196)..(196): n is a, c, t, g, unknown, or other
  misc_feature (204)..(204): n is a, c, t, g, unknown, or other
  misc_feature (211)..(211): n is a, c, t, g, unknown, or other
  misc_feature (584)..(584): n is a, c, t, g, unknown, or other
aaagctggagctccccgcggtggcggccgctctagaactagtggatcccccgggctgcaggaattcgcacgagaccattacctaaacatcctaatcaaaaaaaacaagtcgagagaagcgggccgtacgccaccacggcaacggagaagaggactttcagctgcggcggctggccggcgcggcgacggggatgggnggatgggncgcacanggcggcgccaacccgtccggcgtgggctggcagcagtacgaactgattttgggccaagatttggggaagggggacccaatggggcctccgggtttttcctcggggggggcctttaagccccccccccccccgggaactttgggtgggaagggggccccccccctttttgttttaaaaaaaaaaaattataaacccccccaaggggggggggggggggggaggtcccccccccccccctatataaaaaaaaaaaatttttttttccccgggggggagccccccccccccaagaggggggggggccccccccctcgggggggggggaaccccccccccgccggggggggggcgcccccccccccccccccttttnaaaaaagggggcccccttccccttttttttttt

SEQ ID NO: 25674 - DNA, 607 bp, Zea mays
  misc_feature: Ceres CLONE 1397679-F
  misc_feature: Encodes the peptide sequence at SEQ ID NO. 25675
aaagctggagctcaccgcggtggcggccgctctagaactagtggatcccccgggctgcaggaattcgcacgagaccattacctagaacatcctaatcgaaaaccagctttgctttgtagttgtagcgctagcagcttaattggtctctgagctgaggtgcactactagctagctagtcgtgcaggaagaggaaggaatataatggctgagcgggaggtcgtcgaaggcgggacgacgacgggaggcgggctgtggcggaggtatgcgccgcacgtccagatggtgctggcgcagctgtgctacacgctcatgtacttcatcaccgaggccgccttcaaccaggggctcacccctacgtctacatcacctaccggcatcttctccggcgcgtcctcatcgggccctttccaatccacctggagaagggttgaggccaaaaggaccccctgggggcgcggaaaattccggccccccctctccgggggggcttactccgaaaatggacttcgggagccggaaaacccccccccccaagtgtgggcacccccgggggggaaaacccccccccccccaaaaagcgtcccccatcccccccgcggcctcaaaa

SEQ ID NO: 25675 - protein, 135 aa, Zea mays
  misc_feature: Ceres CLONE 1397679-F
MAEREVVEGGTTTGGGLWRRYAPHVQMVLAQLCYTLMYFITEAAFNQGLTPTSTSPTGIFSGASSSGPFQSTWRRVEAKRTPWGRGKFRPPLSGGAYSENGLREPENPPPQVWAPPGGKTPPPPKSVPHPPRGLK

SEQ ID NO: 25676 - DNA, 717 bp, Zea mays
  misc_feature: Ceres CLONE 1397682-F
  misc_feature: Encodes the peptide sequence at SEQ ID NO. 25677
cgcggtggcggccgctctagaactagtggatcccccgggctgcaggaattcgcacgagaccattacctagaacatcctaatcgaaaactctctccgcccccctcgctagcctcgcggagccgccgcacccagcgaccctcccgaagtctaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgcctacgcctccgccgccgcggcccaggcggcgcccgccaccccgccgccagccaccgggaagaccggcggcggcaagatcaccgacgagttcaccggcgccggcgccatcggccaggtgtgccaggtgatcggcgccgtcgtccacgtgcgctacgatgagggcctcccgcccatcctcacggcgctcgaggtgctcgacaacgacctccgcctcgtgctcgaggtgggcaagcaccttggcgagaacatggtgcggcccattcgctatggacggcacggagggggccggtccgcgggcaaggggggcccttcaacactggcttcccccatccccggggccggttgggaaggcctaccctttggaaggaacaattaatggttatccgcggggaccccattggatagaaaag

SEQ ID NO: 25677 - protein, 170 aa, Zea mays
  misc_feature: Ceres CLONE 1397682-F
  misc_feature: SWISSPROT Homolog: EC 3.6.3.14 H(+)-transporting two-sector ATPase
MASRRVVSSLLRSASRLRAASPAAPRPRGAPHRPSPAGYLFNRAAAYASAAAAQAAPATPPPATGKTGGGKITDEFTGAGAIGQVCQVIGAVVHVRYDEGLPPILTALEVLDNDLRLVLEVGKHLGENMVRPIRYGRHGGGRSAGKGGPSTLASPIPGAGWEGLPFGRNN

SEQ ID NO: 25678 - DNA, 706 bp, Zea mays
  misc_feature: Ceres CLONE 1397683-F
  misc_feature (288)..(288): n is a, c, t, g, unknown, or other
gctctagaactagtggatcccccgggctgcaggaattcgcacgagaccattacctagaacatcctaatcgaaaagtgttcttgtgcggccggtgctcccggtgctccccatcacaccaccaaacggaccaggcgaggcgtcctccaggccctagctctgtggtgtgcgcctctgcgatactgcgactgcgtggcgccggtgcccgtcccatcggccgccgaactgtgcgccccggttgcccactaggccactactgcagtctgcactctgcagataccacagaagaanggcggaaagccgatggccgcccgtggaaagccccgccctccggttccgccccgaaagccgcctttaggtgggggaactccccctccgcccctcctccggtgggggtttcgggtccttccccccccccggtgtccagggttggggggggctttttcccggtccacaaaggcatggggaagcccggggcccttttttttcggctcctaaaaaggcccaggttttttaacaacactggggaccacggggggggccttttctttttttaaggggactatttttttttttgttgcaaaaaaaaaaaaagggagggcgcgctctttcccctacacaaaagaactgaggggctgttttgcggggaacgaaaagaggtggaaaaaaaaaagcaccccgttgtgttaaaaactcccctccttcgtgg

SEQ ID NO: 25679 - DNA, 692 bp, Zea mays
  misc_feature: Ceres CLONE 1397685-F
  misc_feature: Translation starting site: 219
  misc_feature: SWISSPROT Homolog: EC 1.1.1.40 Malate dehydrogenase (oxaloacetate-decarboxylating) (NADP(+))
  misc_feature (304)..(304): n is a, c, t, g, unknown, or other
  misc_feature (305)..(305): n is a, c, t, g, unknown, or other
  misc_feature (354)..(354): n is a, c, t, g, unknown, or other
  misc_feature (355)..(355): n is a, c, t, g, unknown, or other
  misc_feature (559)..(559): n is a, c, t, g, unknown, or other
  misc_feature (570)..(570): n is a, c, t, g, unknown, or other
  misc_feature (597)..(597): n is a, c, t, g, unknown, or other
  misc_feature (677)..(677): n is a, c, t, g, unknown, or other
  misc_feature (678)..(678): n is a, c, t, g, unknown, or other
tccccgcggtggcggccgctctagaactagtggatcccccgggctgcaggaattcgcacgagaccattacctagaacatcctaatcgaaaaacatccgtcttcctcctgtaaccagatctgaacccgcggcgacagaaacaaacgctcgctcgctcgttcgttgtccgttcattgtcttcgccggcgccgagggaccctgagagggcaggcgggcgagatggcgggcggcggcgttgaggacgtgtacggcgaggaccgcgctaccgaggagcagctgatcacgccgtgggccttctccgtcgnncagcggctacaccctgctgcgcgacccgcggcacaacaagggcctggcnncttctcggaggcggagcgcgacgcgcacttacctccggggcctgctgccgccggcgctgggcgtcgcaggagcttgcagggagaagaagctcatgcagaacctgccgccggtacgagcagccgctgcaccgctacttccgccatgatgggacctgcaggagcgcaacggagaggctcttctacaagctctcatcgaaaaacgtncgagagtgggnctccccgtcgctaccggcccaccgggncgggagggtaatggccaaaaagtacggagcatctacgccgccccccccaaaggggctgacatcagcttcaggaacaagannaaatacccctcctg

SEQ ID NO: 25680 - DNA, 659 bp, Zea mays
  misc_feature: Ceres CLONE 1397686-F
  misc_feature: Translation starting site: 341
  misc_feature (440)..(440): n is a, c, t, g, unknown, or other
  misc_feature (472)..(472): n is a, c, t, g, unknown, or other
  misc_feature (474)..(474): n is a, c, t, g, unknown, or other
  misc_feature (483)..(483): n is a, c, t, g, unknown, or other
  misc_feature (484)..(484): n is a, c, t, g, unknown, or other
  misc_feature (497)..(497): n is a, c, t, g, unknown, or other
  misc_feature (522)..(522): n is a, c, t, g, unknown, or other
  misc_feature (523)..(523): n is a, c, t, g, unknown, or other
  misc_feature (594)..(594): n is a, c, t, g, unknown, or other
  misc_feature (599)..(599): n is a, c, t, g, unknown, or other
  misc_feature (601)..(601): n is a, c, t, g, unknown, or other
  misc_feature (602)..(602): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (624)..(624): n is a, c, t, g, unknown, or other
cgcggtggcggccgctctagaactagtggatcccccgggctgcaggaattcgcacgagaccattacctagaacatcctaatcgaaaaacacacaaacacatcagcattcagcaatagctaatcgagcatcgtcgccttagctcctctcctctcctcttctctccgtcgtcgtggaacttctctccgccggctgccatataaaggaggaagaagagaacagcaacgctagctagccggccggcctccgtcgtcgccggcgtcgtcgactagctagctaactctcgatctccagttcctgcccccgccccacgcccggccgtcgtcgatcgtcagcaatataatggcaggaggcctcttctccatggctcacccggccgtcaccctctccggcatcgcaggaaacatcatctcctttcctggtgttccttggcacaagtggncgacgtccctgcaggtgtacccggaagaagcngnacgggcggnnttcagctcggtgnccggtacggtgtggcgtctttcagnntcgggggggtgggggatcttctacgcggttggtggagacccaactcgaagggcgctgctggacatcaacgncctcngnnttggggnnnnggggaaggcggncctaactagtccttctaccttgcggaacgggcccc

SEQ ID NO: 25681 - DNA, 680 bp, Zea mays
  misc_feature: Ceres CLONE 1397688-F
  misc_feature: Encodes the peptide sequence at SEQ ID NO. 25682
  misc_feature (474)..(474): n is a, c, t, g, unknown, or other
  misc_feature (524)..(524): n is a, c, t, g, unknown, or other
  misc_feature (562)..(562): n is a, c, t, g, unknown, or other
  misc_feature (568)..(568): n is a, c, t, g, unknown, or other
  misc_feature (625)..(625): n is a, c, t, g, unknown, or other
  misc_feature (642)..(642): n is a, c, t, g, unknown, or other
tccccgcggtggcggccgctctagaactagtggatcccccgggctgcaggaattcgcacgagaccattacctagaacatcctaatcgaaaaactccgccagatcccatccctctcgcccaccgcgcgggtatcggagtcggagcatggcgtctgcagtggtggtggacgccggcgacgcgccggagcccacggttcgtaacctcctggaccaggagtccctcaagtgggtcttcgtcggcgggaagggcggcgtcggcaagactacctgcagctccatcctctccgtcctcctcgccggggtccgcccgtccgtgctcgtcatctccaccgaccccgcgcacaacctcagcgacgccttccagcagcgcttcaccaagttccccactctcggtccgcggattcaccaacctcttacgccatggaaattgacccaaaggtagaaaaatgatgatttatccaatgaaggaaatggnaaggattccttgtcagaactgacaaatgcgattccgggagtaatgaaagnctttatgagtttttgctgaaatgctaaaattagtcccnacaggnttaccccccgggggggggtggtttttgatactgctcctacggcatacccttacgggnttgcttcagttccagancccttaaaaggaagggtcttgagaaaaatggatggagt

SEQ ID NO: 25682 - protein, 98 aa, Zea mays
  misc_feature: Ceres CLONE 1397688-F
  misc_feature: SWISSPROT Homolog: EC 3.6.3.16 Arsenite-transporting ATPase
MASAVVVDAGDAPEPTVRNLLDQESLKWVFVGGKGGVGKTTCSSILSVLLAGVRPSVLVISTDPAHNLSDAFQQRFTKFPTLGPRIHQPLTPWKLTQR

SEQ ID NO: 25683 - DNA, 677 bp, Zea mays
  misc_feature: Ceres CLONE 1397691-F
  misc_feature: Encodes the peptide sequence at SEQ ID NO. 25684
  misc_feature (488)..(488): n is a, c, t, g, unknown, or other
  misc_feature (529)..(529): n is a, c, t, g, unknown, or other
  misc_feature (532)..(532): n is a, c, t, g, unknown, or other
  misc_feature (535)..(535): n is a, c, t, g, unknown, or other
  misc_feature (537)..(537): n is a, c, t, g, unknown, or other
  misc_feature (542)..(542): n is a, c, t, g, unknown, or other
  misc_feature (543)..(543): n is a, c, t, g, unknown, or other
  misc_feature (547)..(547): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
gctctataactagtggatcccccgggctgcaggaattcgcacgagaccattacctagaacatcctaatcgaaaaatccctcctcctaactccaaactacccactggttcgactcgcgttcgcatcgcaagcagcagcgttccatcgaggcaatggcggtgatggccgaagtagtgtcgaccaccggcgcggcgctccggagcccggcctcgcagcagccggcggcggcgggcgcggcgaagggcaccgacgctgagaagctccagttcatcgaggacatgacctccaacgtggacgccgtgcaggagcgcgtgctgggggagatcctcgcccgcaacgcggacaccgagtacctcgccggcaggtgcggcctcgccggcgctacggaccgcgccaccttccgcgccaaggtgccgatggcgacgtacgaggacctgcagccgtacatccggcgcatcgccgacggcgaccgctcgcccatcctgtcgnggcacccggtctccgagctcctcaccagctccggaacgggnggnggngnggggnnggtnttggnnntgtcggggaggcggctcacccgccgcgcggtgctgtatgctctcagaaggcccgtcatggacttgtccgcgcccgtgacggagccgagcccgcttctcgttctcttggacgccccacccttaa

SEQ ID NO: 25684 - protein, 175 aa, Zea mays
  misc_feature: Ceres CLONE 1397691-F
  misc_feature (113)..(113): Xaa is any aa, unknown, or other
  misc_feature (129)..(129): Xaa is any aa, unknown, or other
  misc_feature (131)..(131): Xaa is any aa, unknown, or other
  misc_feature (134)..(134): Xaa is any aa, unknown, or other
  misc_feature (135)..(135): Xaa is any aa, unknown, or other
MAVMAEVVSTTGAALRSPASQQPAAAGAAKGTDAEKLQFIEDMTSNVDAVQERVLGEILARNADTEYLAGRCGLAGATDRATFRAKVPMATYEDLQPYIRRIADGDRSPILSXHPVSELLTSSGTGGGXGXVLXXSGRRLTRRAVLYALRRPVMDLSAPVTEPSPLLVLLDAPPL

SEQ ID NO: 25685 - DNA, 763 bp, Zea mays
  misc_feature: Ceres CLONE 1397692-F
  misc_feature: Translation starting site: 209
  misc_feature (1)..(1): n is a, c, t, g, unknown, or other
  misc_feature (11)..(11): n is a, c, t, g, unknown, or other
  misc_feature (19)..(19): n is a, c, t, g, unknown, or other
  misc_feature (21)..(21): n is a, c, t, g, unknown, or other
ncctccctttnccccctcncncccctccctcccccctttgtgttttttttaaaactggggctccccgcggtggcggccgctctagaactagtggatcccccgggctgcaggaattcgcacgagaccattacctagaacatcctaatcaaaaacatgccacattgccaccaagccacagttccacctttcgattcatgcacgctcagtcatgggcgccctccggagtttagccatctcctacccggagttcctcgtggccgggctgtgcttcgtctccctctcggccctgcgccacgcgatgcgtgagcggcggcaacgcgcccccctgagctggcctgtggtgggcatgctcccgttcgtgctcgcgaacctcgggcgcctctacgacgccatcaccgacgccctccacgggtccgggtgcacgctcaatgttccgcgggccgtggctcgcccgcgcggacttcctgctgacgtgcgacccggcggccgtccagcactgcctggcgtccaaccacgagggctacgacaggggccgagacttttgcggagatgttcgacctccctggcgacgggcctgctggattgcgacgcccccccgtccatggacccgcccagcggtcacgtcaccccccaaccactcttccctcaacccccgccgctctcgctgtctccgcagagcaagcgcgaaggaaccgccatcaaccacaccggcctgaccggggagtgtccatcgaattggctaaacccaagaccctctccccag

SEQ ID NO: 25686 - DNA, 661 bp, Zea mays
  misc_feature: Ceres CLONE 1397695-F
  misc_feature: Encodes the peptide sequence at SEQ ID NO. 25687
  misc_feature (362)..(362): n is a, c, t, g, unknown, or other
  misc_feature (422)..(422): n is a, c, t, g, unknown, or other
  misc_feature (435)..(435): n is a, c, t, g, unknown, or other
  misc_feature (440)..(440): n is a, c, t, g, unknown, or other
cgcggtggcggccgctctagaactagtggatcccccgggctgcaggaattcgcacgagaccattacctagaacatcctaatcgaaaaacagactacagagcgtagagcgagtgggtatcggacacttctctggcaattgcagattatctccgaatctgtatgaactgactgccgcggtctattccgtctgaagaccctcctcctacctaattatttttctctgtcgtgacgtgaaatcccagcgcgcagcttcttgatccgttccggctgatcccgtggaccggacttggggttgggggaggccctctgtctccatggatgaggcagcagggctgctgttgcaagaagagggtggaggtggngaccaagaagctctcctccttccacttccacaggatgttggcctttacacaggtgatggnatctgtgatgtcnaaggncgcccctgcgtaaagggcactacagggcaattggaaagcatgcttttcatcctagggaaatgatgggtggtgaagggctgccctactacggaattgcaaaaaacctaggtatttatttgaaagtgaagcttcatcctagcaccctcgaggttgcagacatgttaccacttggaaagggaatgctactccttcccccttgtggagggattttacagactccg

SEQ ID NO: 25687 - protein, 62 aa, Zea mays
  misc_feature: Ceres CLONE 1397695-F
  misc_feature (41)..(41): Xaa is any aa, unknown, or other
MDEAAGLLLQEEGGGGDQEALLLPLPQDVGLYTGDGICDVXGRPCVKGTTGQLESMLFILGK

SEQ ID NO: 25688 - DNA, 711 bp, Zea mays
  misc_feature: Ceres CLONE 1397696-F
  misc_feature: Encodes the peptide sequence at SEQ ID NO. 25689
  misc_feature (406)..(406): n is a, c, t, g, unknown, or other
  misc_feature (407)..(407): n is a, c, t, g, unknown, or other
  misc_feature (603)..(603): n is a, c, t, g, unknown, or other
  misc_feature (667)..(667): n is a, c, t, g, unknown, or other
  misc_feature (674)..(674): n is a, c, t, g, unknown, or other
  misc_feature (679)..(679): n is a, c, t, g, unknown, or other
  misc_feature (681)..(681): n is a, c, t, g, unknown, or other
  misc_feature (684)..(684): n is a, c, t, g, unknown, or other
  misc_feature (693)..(693): n is a, c, t, g, unknown, or other
  misc_feature (695)..(695): n is a, c, t, g, unknown, or other
aaagctggagctccccgcggtggcggccgctctagaactagtggatcccccgggctgcaggaattcgcacgagaccattacctagaactcctaatcgaaaaaaatccaagtaaggaaatccccgatgatctcctgcgcgtcgcagcgccagccactcgattagtggagtccaccaaccaagcacgcgtccctccccgtcccagatcccatcccgcggcagccggtcagtccgatccatctccagtacccagcccgtcacccgccttccccgttcgctctcgtcggcgcgcgatggagggtctcatcaaggggttggtccacgtggccatcgacgccgtggaggacgccgtgagggagagggaccacggccgcgccgacgacgacgaggtgccgaggaggagggcgnnccaaagctccgatccagatgacgacggggaggaggaacgcgacgaacgatcgcggtcgacgtgggccgaggtcgtctccgagcagaagggcagcgatccggacgaacgccgggaacatcggaggtcgggggcgggaccatccccatggaagggaggatggacagggtttgaaaaagggcccatggtcggaacccancagaaggcccccgaaggcgggaaaaaacaggggtagggggaggaaaaggtggaatgggaatggnacaccgngggcntntcncacaacccngnccccaagggaatcggc

SEQ ID NO: 25689 - protein, 115 aa, Zea mays
  misc_feature: Ceres CLONE 1397696-F
  misc_feature (39)..(39): Xaa is any aa, unknown, or other
  misc_feature (104)..(104): Xaa is any aa, unknown, or other
MEGLIKGLVHVAIDAVEDAVRERDHGRADDDEVPRRRAXQSSDPDDDGEEERDERSRSTWAEVVSEQKGSDPDERREHRRSGAGPSPWKGGWTGFEKGPMVGTXQKAPEGGKKQG

SEQ ID NO: 25690 - DNA, 686 bp, Zea mays
  misc_feature: Ceres CLONE 1397699-F
  misc_feature (325)..(325): n is a, c, t, g, unknown, or other
  misc_feature (516)..(516): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
ggagctccccgcggtggcggccgctctagaactagtggatcccccgggctgcaggaattcgcacgagaccattacctagaacatcctaatcgaaaacactaaacgcagatttcctcggttccttgtacgttcagggccggacgacggggacagacagcggtgtcgcgggggcacctgcttcccaacgccgtccgcacctgctgccctgtcgtccgccctccttcccttctcctcccctccaactgtttcctcaacctcccgacccaaccacggccgtgcccgccaaggcgccaaccgcacagcagcagctggggtgctgacgtgnctgtggggtgggttctgttgtccatggcgcggaagcatcagcatgttgccatatttaccacagcgtgcttggccgtggatgactggggactgcggtaaacccactgggtttcggctgcataccttgccagggctggaaaaattgggagggtcacgctggtggtgccttggctgtccaaggggggatcaggnagctcgttatcaaannnagaagggagggttcagtttgccggcagagaggaaactatggggggggcgttgctttgaggacgggactgggttgtttgccgaagtttgacataaagtctattccggggaaagtttcactggaaaaaagagtattctacctgtgggagactcag

SEQ ID NO: 25691 - DNA, 747 bp, Zea mays
  misc_feature: Ceres CLONE 1397703-F
  misc_feature: Encodes the peptide sequence at SEQ ID NO. 25692
  misc_feature (410)..(410): n is a, c, t, g, unknown, or other
  misc_feature (411)..(411): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (475)..(475): n is a, c, t, g, unknown, or other
  misc_feature (476)..(476): n is a, c, t, g, unknown, or other
  misc_feature (490)..(490): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (656)..(656): n is a, c, t, g, unknown, or other
aagctggagctccctgcgggggcggccgctcattcggcatggatcccccgggctgcattatctgcacccggcattacctagaacatcctaatcaaaaaaccggagagatctggtcagccaatccatcggtccttcccgtgaaccacaaacctaacgcggagcggcgcgggccggccgccgggcgaggtgcgcgtagctgccgtcgattgtcgccggatccatccaccatgggcggtggcaacggccagaagtccaagatggcccgcgagcgcaacttggagaagaacaagggggccaaggggagccagctcgatattaacaagaaggccatgagcatccagtgcaaagtgtgtatgtaaaccctcatgtgtacggcgagtgaagtgaagtgccgggatgcacgccgaggnncnnnnnnnnnaaataactcccttctcccgccggtgcnnntttnnnnnnnnnnnnncnnnncccnntttttccccccccncccccccccccccaattccccgtttcccnnnttttctcaacttggttttttccccccatttttcccccccccttccccttccccctttcccctccccaattttcttttcccccattttccttttcccaattccccctcccctttccccaacccgcccatttccccnccctttttcctccccattccgtttccccccctttcctccccccctccccgggcccctcccggttcccccccccccgccccggttccccccc

SEQ ID NO: 25692 - protein, 43 aa, Zea mays
  misc_feature: Ceres CLONE 1397703-F
  misc_feature (4)..(44): Pfam Name: DUF1909 Pfam Description: Domain of unknown function (DUF1909)
MGGGNGQKSKMARERNLEKNKGAKGSQLDINKKAMSIQCKVCM

SEQ ID NO: 25693 - DNA, 687 bp, Zea mays
  misc_feature: Ceres CLONE 1397705-F
  misc_feature (301)..(301): n is a, c, t, g, unknown, or other
  misc_feature (313)..(313): n is a, c, t, g, unknown, or other
  misc_feature (323)..(323): n is a, c, t, g, unknown, or other
  misc_feature (392)..(392): n is a, c, t, g, unknown, or other
  misc_feature (399)..(399): n is a, c, t, g, unknown, or other
  misc_feature (400)..(400): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
caaagctggagctccccgcggtggcggccgctctagaactagtggatcccccgggctgcaggaattcgcacgagaccattacctagaacatcctaatcgaaaaatagtttattaagtcgtatctcagttgaacaaaaagaaaaacacatcccattttttctttttccaatcaactcttcctgtttcctccaggcacagaagaactcgaagcacaattgatgtcctggttcctaaagcacccacagggggcgttatactccgtcagtttcagctgtagtacaaaaaaaaaataattcatcanagcttctctacnattctagaanacttatgcagtatcaccaactttagcacgtttcgatttttcaaagctaactgcactaatcactaatatnctaatannataactgataaaacatagaaaaccattccagggattcttactccaaaggaaggggggtccgggggatttaaaaaccttctttgggaaaaattttttttcttttcaggaggggcggtttaagaaaaaaaagccaaaccccccggggggggggaatttttttccacaaacaaaaaaatatttctttttcctttttttataaannnccatatttggggggggggagaacctttttaaaaaacaccccttttttttttttttnnntgtttgtggggggggggaaaaaacac

SEQ ID NO: 25694 - DNA, 755 bp, Zea mays
  misc_feature: Ceres CLONE 1397706-F
  misc_feature: Encodes the peptide sequence at SEQ ID NO. 25695
  misc_feature (474)..(474): n is a, c, t, g, unknown, or other
  misc_feature (571)..(571): n is a, c, t, g, unknown, or other
  misc_feature (580)..(580): n is a, c, t, g, unknown, or other
aagctggagctccccgcggtggcggccgctctagaactagtggatcccccgggctgcaggaattcgcacgagaccattacctagaacatcctaatcgaaaaaatctgaagcaaaatgtaccgggaatgttgaagagcgggactcttaagcagtagtgagatgcggcggtggtggtcgccggcgttggcggctgtggagccgcggtccgtgcagctcctgctcctgggcgtcgctctcgtcgcagcttctttctacgccggcaccctcttcggctcctccgcgtcccctgcgctcgtactgcccccttcgcgcccccgatcgcccgattccttcagggccaaagatattccagtgtttaccaacagagtttctcgtacgtaccgggcaaaatcagtgacagttccagatcacggagttgatgtgtgtcctttggaaatacatgagtatgtcccctgccatgatggagcctatatnagcagcttggagagcctggatacatctaggcatgaggatctttgaagtatttgtccctcatggggagaggcgttggttttgtttggtgccccctccnatgactacnagatacccataggatgggcaacaagccgagactacgtatggcggtagtatggcaaccattcccatctggtgaagtccaagggagaccgacctgggtgcatgaaaaggcaaactttgggggtttcccgggagggggacctcctttcaaacgtggggatcaaaatacctagaagggg

SEQ ID NO: 25695 - protein, 119 aa, Zea mays
  misc_feature: Ceres CLONE 1397706-F
  misc_feature (105)..(105): Xaa is any aa, unknown, or other
MRRWWSPALAAVEPRSVQLLLLGVALVAASFYAGTLFGSSASPALVLPPSRPRSPDSFRAKDIPVFTNRVSRTYRAKSVTVPDHGVDVCPLEIHEYVPCHDGAYXSSLESLDTSRHEDL

SEQ ID NO: 25696 - DNA, 710 bp, Zea mays
  misc_feature: Ceres CLONE 1397708-F
  misc_feature: Encodes the peptide sequence at SEQ ID NO. 25697
  misc_feature (639)..(639): n is a, c, t, g, unknown, or other
  misc_feature (710)..(710): n is a, c, t, g, unknown, or other
aaagctggagctccccgcggtggcggccgctctagaactagtggatcccccgggctgcaggaattcgcacgagaccattacctagaacatcctaatcgaaaagtctcttttccagttccagacctgaagaaactccgaccggtggcggcaggatctgtgccgcgatggcgacgtcgaacaccgctcggatggaggacggcggcggtgacctgcggagcaccatcaagaagtggaacatcatctaccctgtctacctcaactccaagaagacggtcgccgagggccgccgcatcgccgctgccaaggcctgcccggaccccacctgcatcgagatcgctgactgctgttcgcacctcaagatcccccacgccatcgagttggataaggcgtaccctcgggatttcttccgggtggggagggtcagggtgcagcttaagaaagatgacggctcccccgtcaatcctgctattaaaacaaagaagcagctgatgatccaagtagcagagctagttcccaagcatcacggaaggacaaagaagcaagagttcaatttgaggaaacctccatccttccactatgatttgcttctcttaggcttcctgacgttaatgtgtggccttattggtatccctccatcanatggtgtcattccacaatcaccatgcacacgaaagagtttggctactctcaagcatcagctgcttcgtaan

SEQ ID NO: 25697 - protein, 181 aa, Zea mays
  misc_feature: Ceres CLONE 1397708-F
  misc_feature (24)..(120): Pfam Name: SRP19 Pfam Description: SRP19 protein
  misc_feature (159)..(159): Xaa is any aa, unknown, or other
MATSNTARMEDGGGDLRSTIKKWNIIYPVYLNSKKTVAEGRRIAAAKACPDPTCIEIADCCSHLKIPHAIELDKAYPRDFFRVGRVRVQLKKDDGSPVNPAIKTKKQLMIQVAELVPKHHGRTKKQEFNLRKPPSFHYDLLLLGFLTLMCGLIGIPPSXGVIPQSPCTRKSLATLKHQLLR

SEQ ID NO: 25698 - DNA, 715 bp, Zea mays
  misc_feature: Ceres CLONE 1397710-F
  misc_feature: Encodes the peptide sequence at SEQ ID NO. 25699
  misc_feature (376)..(376): n is a, c, t, g, unknown, or other
  misc_feature (542)..(542): n is a, c, t, g, unknown, or other
gctctagaactagtggatcccccgggctgcaggaattcgcacgagaccattacctagaacatcctaatcgaaaactcctcttctccagcgtccgatccccgtttcccacgaatcccactctactcctccatctgcggcctcctccatgctcctgcccccttctctctcctccttgcttccccgcgcgcacgtttttacaagggtttcggcggaggcgaccggtcgccgacgatggcggacgacagcggcagccacgagggcggcggcggcggcggcgacgacgtccgggagcaggacatgttcttgcctattaccaacatcacccggatcatgaagaaggccgtcccggccaatgccaagatcactaaggacgctnaggagataatgcagtactgcgtctccgagttcatattctttgtgacgagcgaggcgagggagaaaagcaaaaagggagagcgtaagagaatcaacgtggacgatttgctctggtcagtggatacggcagaattcgagtacgtggagcttctcaagatttggctacnaaagtacagaagagacggggaaggcacgggtgtacacgacgtgatcagggtattaacctgtaacaccttatggagaaaacattgagcactttggcaggtagtacgcaatcagtttaagaaaactgcaaactgcaagctcttgggaaaactaaggttggttgctggggaaaaag

SEQ ID NO: 25699 - protein, 131 aa, Zea mays
  misc_feature: Ceres CLONE 1397710-F
  misc_feature (23)..(88): Pfam Name: CBFD_NFYB_HMF Pfam Description: Histone-like transcription factor (CBF/NF-Y) and archaeal histone
  misc_feature: SWISSPROT Homolog: EC 2.7.7.7 DNA-directed DNA polymerase
  misc_feature: The sequence is a functional homolog of SEQ ID NO 134 in the 10/225,068 US patent application
  misc_feature: The sequence is a functional homolog of SEQ ID NO 1398 in the 10/666,642 US patent application
  misc_feature: The sequence is a functional homolog of SEQ ID NO 14 in the 10/286,264 US patent application
  misc_feature: The sequence is a functional homolog of SEQ ID NO 290 in the 11/435,388 US patent application
  misc_feature: The sequence is a functional homolog of SEQ ID NO 292 in the 10/714,887 US patent application
  misc_feature: The sequence is a functional homolog of SEQ ID NO 306 in the 10/412,699 US patent application
  misc_feature: The sequence is a functional homolog of SEQ ID NO 4 in the 10/675,852 US patent application
  misc_feature: The sequence is a functional homolog of SEQ ID NO 708 in the 11/479,226 US patent application
  misc_feature: The sequence is a functional homolog of SEQ ID NO 90 in the 10/374,780 US patent application
  misc_feature: The sequence is a functional homolog of SEQ ID NO 22 in the 10/675,852 US patent application
  misc_feature: The sequence is a functional homolog of SEQ ID NO 106 in the 10/666,642 US patent application
  misc_feature: The sequence is a functional homolog of SEQ ID NO 1784 in the 10/412,699 US patent application
  misc_feature: The sequence is a functional homolog of SEQ ID NO 2010 in the 10/374,780 US patent application
  misc_feature: The sequence is a functional homolog of SEQ ID NO 292 in the 11/435,388 US patent application
  misc_feature: The sequence is a functional homolog of SEQ ID NO 294 in the 10/714,887 US patent application
  misc_feature: The sequence is a functional homolog of SEQ ID NO 6 in the 10/675,852 US patent application
  misc_feature: The sequence is a functional homolog of SEQ ID NO 719 in the 11/479,226 US patent application
  misc_feature: The sequence is a functional homolog of SEQ ID NO 2175 in the 10/666,642 US patent application
  misc_feature: The sequence is a functional homolog of SEQ ID NO 398 in the 11/435,388 US patent application
  misc_feature: The sequence is a functional homolog of SEQ ID NO 400 in the 10/714,887 US patent application
  misc_feature: The sequence is a functional homolog of SEQ ID NO 80 in the 10/675,852 US patent application
  misc_feature: The sequence is a functional homolog of SEQ ID NO 801 in the 10/374,780 US patent application
  misc_feature: The sequence is a functional homolog of SEQ ID NO 16 in the 10/675,852 US patent application
  misc_feature: The sequence is a functional homolog of SEQ ID NO 2179 in the 10/666,642 US patent application
  misc_feature: The sequence is a functional homolog of SEQ ID NO 402 in the 11/435,388 US patent application
  misc_feature: The sequence is a functional homolog of SEQ ID NO 404 in the 10/714,887 US patent application
  misc_feature: The sequence is a functional homolog of SEQ ID NO 797 in the 10/374,780 US patent application
  misc_feature: The sequence is a functional homolog of SEQ ID NO 82 in the 10/675,852 US patent application
  misc_feature: The sequence is a functional homolog of SEQ ID NO 18 in the 10/675,852 US patent application
  misc_feature: The sequence is a functional homolog of SEQ ID NO 2183 in the 10/666,642 US patent application
  misc_feature: The sequence is a functional homolog of SEQ ID NO 406 in the 11/435,388 US patent application
  misc_feature: The sequence is a functional homolog of SEQ ID NO 408 in the 10/714,887 US patent application
  misc_feature: The sequence is a functional homolog of SEQ ID NO 798 in the 10/374,780 US patent application
  misc_feature: The sequence is a functional homolog of SEQ ID NO 26 in the 10/675,852 US patent application
  misc_feature: The sequence is a functional homolog of SEQ ID NO 802 in the 10/374,780 US patent application
  misc_feature: The sequence is a functional homolog of SEQ ID NO 2171 in the 10/666,642 US patent application
  misc_feature: The sequence is a functional homolog of SEQ ID NO 2173 in the 10/666,642 US patent application
  misc_feature: The sequence is a functional homolog of SEQ ID NO 2185 in the 10/666,642 US patent application
  misc_feature: The sequence is a functional homolog of SEQ ID NO 24 in the 10/675,852 US patent application
  misc_feature: The sequence is a functional homolog of SEQ ID NO 394 in the 11/435,388 US patent application
  misc_feature: The sequence is a functional homolog of SEQ ID NO 396 in the 10/714,887 US patent application
  misc_feature: The sequence is a functional homolog of SEQ ID NO 396 in the 11/435,388 US patent application
  misc_feature: The sequence is a functional homolog of SEQ ID NO 398 in the 10/714,887 US patent application
  misc_feature: The sequence is a functional homolog of SEQ ID NO 408 in the 11/435,388 US patent application
  misc_feature: The sequence is a functional homolog of SEQ ID NO 410 in the 10/714,887 US patent application
  misc_feature: The sequence is a functional homolog of SEQ ID NO 84 in the 10/675,852 US patent application
  misc_feature: The sequence is a functional homolog of SEQ ID NO 20 in the 10/675,852 US patent application
  misc_feature: The sequence is a functional homolog of SEQ ID NO 2181 in the 10/666,642 US patent application
  misc_feature: The sequence is a functional homolog of SEQ ID NO 404 in the 11/435,388 US patent application
  misc_feature: The sequence is a functional homolog of SEQ ID NO 406 in the 10/714,887 US patent application
  misc_feature: The sequence is a functional homolog of SEQ ID NO 800 in the 10/374,780 US patent application
  misc_feature: The sequence is a functional homolog of SEQ ID NO 2187 in the 10/666,642 US patent application
  misc_feature: The sequence is a functional homolog of SEQ ID NO 410 in the 11/435,388 US patent application
  misc_feature: The sequence is a functional homolog of SEQ ID NO 412 in the 10/714,887 US patent application
  misc_feature: The sequence is a functional homolog of SEQ ID NO 86 in the 10/675,852 US patent application
  misc_feature: The sequence is a functional homolog of SEQ ID NO 14 in the 10/675,852 US patent application
  misc_feature: The sequence is a functional homolog of SEQ ID NO 310 in the 11/435,388 US patent application
  misc_feature: The sequence is a functional homolog of SEQ ID NO 312 in the 10/714,887 US patent application
  misc_feature: The sequence is a functional homolog of SEQ ID NO 72 in the 10/675,852 US patent application
  misc_feature: The sequence is a functional homolog of SEQ ID NO 803 in the 10/374,780 US patent application
  misc_feature: The sequence is a functional homolog of SEQ ID NO 2155 in the 10/666,642 US patent application
  misc_feature: The sequence is a functional homolog of SEQ ID NO 368 in the 11/435,388 US patent application
  misc_feature: The sequence is a functional homolog of SEQ ID NO 370 in the 10/714,887 US patent application
  misc_feature: The sequence is a functional homolog of SEQ ID NO 94 in the 10/675,852 US patent application
  misc_feature: The sequence is a functional homolog of SEQ ID NO 34 in the 10/675,852 US patent application
  misc_feature: The sequence is a functional homolog of SEQ ID NO 807 in the 10/374,780 US patent application
  misc_feature: The sequence is a functional homolog of SEQ ID NO 1165 in the 10/412,699 US patent application
  misc_feature: The sequence is a functional homolog of SEQ ID NO 30 in the 10/675,852 US patent application
  misc_feature: The sequence is a functional homolog of SEQ ID NO 781 in the 10/374,780 US patent application
  misc_feature: The sequence is a functional homolog of SEQ ID NO 808 in the 10/666,642 US patent application
  misc_feature: The sequence is a functional homolog of SEQ ID NO 2139 in the 10/666,642 US patent application
  misc_feature: The sequence is a functional homolog of SEQ ID NO 334 in the 11/435,388 US patent application
  misc_feature: The sequence is a functional homolog of SEQ ID NO 336 in the 10/714,887 US patent application
  misc_feature: The sequence is a functional homolog of SEQ ID NO 90 in the 10/675,852 US patent application
  misc_feature: The sequence is a functional homolog of SEQ ID NO 1166 in the 10/412,699 US patent application
  misc_feature: The sequence is a functional homolog of SEQ ID NO 31 in the 10/675,852 US patent application
  misc_feature: The sequence is a functional homolog of SEQ ID NO 782 in the 10/374,780 US patent application
  misc_feature: The sequence is a functional homolog of SEQ ID NO 809 in the 10/666,642 US patent application
  misc_feature: The sequence is a functional homolog of SEQ ID NO 2177 in the 10/666,642 US patent application
  misc_feature: The sequence is a functional homolog of SEQ ID NO 400 in the 11/435,388 US patent application
  misc_feature: The sequence is a functional homolog of SEQ ID NO 402 in the 10/714,887 US patent application
  misc_feature: The sequence is a functional homolog of SEQ ID NO 52 in the 10/675,852 US patent application
  misc_feature: The sequence is a functional homolog of SEQ ID NO 799 in the 10/374,780 US patent application
  misc_feature: The sequence is a functional homolog of SEQ ID NO 793 in the 10/374,780 US patent application
  misc_feature (49)..(49): Xaa is any aa, unknown, or other
  misc_feature (104)..(104): Xaa is any aa, unknown, or other
MADDSGSHEGGGGGGDDVREQDMFLPITNITRIMKKAVPANAKITKDAXEIMQYCVSEFIFFVTSEAREKSKKGERKRINVDDLLWSVDTAEFEYVELLKIWLXKYRRDGEGTGVHDVIRVLTCNTLWRKH

SEQ ID NO: 25700 - DNA, 711 bp, Zea mays
  misc_feature: Ceres CLONE 1397713-F
  misc_feature: Encodes the peptide sequence at SEQ ID NO. 25701
  misc_feature (529)..(529): n is a, c, t, g, unknown, or other
  misc_feature (530)..(530): n is a, c, t, g, unknown, or other
  misc_feature (557)..(557): n is a, c, t, g, unknown, or other
  misc_feature (560)..(560): n is a, c, t, g, unknown, or other
aaagctggagctccccgcggtggcggccgctctagaactagtggatcccccgggctgcaggaattcgcacgagaccattacctagaacatcctaatcgaaaactcttcgtctccttcgtcgtcctatcttataatcgcatttcgaaatccccaaacggaagcatcgccactcttccgaacctgaacaatcaccaccgttattaagaagatgatgcgctgcgctgcaacgggcggcgggtgcgtcgcttcgtgtagcggcgatcggagattgccggcggtcaacccctgcagcgtgcggatgccgacgggcaacgatgggtggtgcgccggcctgaggtcgcgggcggcggatctcgccggcctcgagatggcaacctgcgcggcgggcgtcggggggctcttccgcgcgagcccgcgctacgggcgcttgcaagccacggcggcagtggaccctgaagatattcattggagaaggttcaagttaaatcctcaggacatgttctgcatatggtggcgtttgcttgttggnngctattctgtttgggtaccatcttggnggnggccaatggcgcacttgaatatctcgccaaggatcttgggattgctgaaatgctgccttggaggggtggggggaaagcaatcctttggtgggggaacccaggtcttttacggggggtcttgtgcaaataatttgggcggaaaaaacatctt

SEQ ID NO: 25701 - protein, 167 aa, Zea mays
  misc_feature: Ceres CLONE 1397713-F
  misc_feature (108)..(108): Xaa is any aa, unknown, or other
  misc_feature (117)..(117): Xaa is any aa, unknown, or other
  misc_feature (118)..(118): Xaa is any aa, unknown, or other
MMRCAATGGGCVASCSGDRRLPAVNPCSVRMPTGNDGWCAGLRSRAADLAGLEMATCAAGVGGLFRASPRYGRLQATAAVDPEDIHWRRFKLNPQDMFCIWWRLLVGXYSVWVPSWXXPMAHLNISPRILGLLKCCLGGVGGKQSFGGGTQVFYGGSCANNLGGKNI

SEQ ID NO: 25702 - DNA, 713 bp, Zea mays
  misc_feature: Ceres CLONE 1397715-F
  misc_feature: Encodes the peptide sequence at SEQ ID NO. 25703
  misc_feature (534)..(534): n is a, c, t, g, unknown, or other
gctctagaactagtggatcccccgggctgcaggaattcgcacgagaccattacctagaacatcctaatcgaaaaaaaaaaaaaaaaaagcttctcgtgccggcttctcgtgccgttttttttttttttttttggaaaatccataggtgaatattgatacaggattcaatggttcacacaaagatcataggaacatacagtgaaaattatcagtgctaccgttcaggaaagcaaatgctaaatctgtttcttggatccgagaaggccggcacatgttcagatgatgatgaaaggtcattcatgaatagaacggaagtatataatgatattcaacttccacactgctttgtccagatcattaaattcagcgcctaccagcccgtcttttactctgcctcctcgccctccgccgcctcaaccgcgacacgggactcttcaagcgccgccgcgacgagcccgctcccgccgtccctgcctccgatctgactcctacacgcgccgaaacagccccattcgcaggaatcacccgtccggnattcactccctcctcaccgcccgacgtagcggctccccgggatgctgctgagtcagagcttgaaggcctgtcagagctggtcgacaaactatgttcagatgacaccaccagtcagctcgaagccacaatccagttcaggaaacttctttcagatgagaagaaactcactgtgataaaaa

SEQ ID NO: 25703 - protein, 43 aa, Zea mays
  misc_feature: Ceres CLONE 1397715-F
MLLSQSLKACQSWSTNYVQMTPPVSSKPQSSSGNFFQMRRNSL

SEQ ID NO: 25704 - DNA, 661 bp, Zea mays
  misc_feature: Ceres CLONE 1397716-F
  misc_feature: Encodes the peptide sequence at SEQ ID NO. 25705
aaagctggagctccccgcggtggcggccgctctacaactagtggatcccccgggctgcaggaattcgcacgagaccattacctagaacatcctaatttaaaaatgattcatcagcgaattttcccaccgctcagcagttacctcgttcccgttctcctcctcgcatccctctcgtccgccgccgccgcctggctcgcgccgccgacagtttctcggcccagatcgagacacgcccgccgtcctacaccaggtgccgaggccttcgccgatcaaagagatcccagacagcagattcgtccgtgccctgctcctcgaaccatggggacctctgcccaggaatcgcctctctggaagcgtatcgacgatgccgagtactatctagtcagtggatcatttgaccaggcggtgttgactgctttatccgtcgccaatggaatacacatggctttctttggagagcgctagcgaccaggatggactcctggaaaggtttgaatcggcctggaatggggcttggggaaggccttaaaagaaactccggggggcccctggggaaggttggccccccttaagaaagaggggtttgggctacagggcccatcagggggccgggtctaaaggtttttccttaaagggggggggtcaccctctccccgggggg

SEQ ID NO: 25705 - protein, 48 aa, Zea mays
  misc_feature: Ceres CLONE 1397716-F
MGTSAQESPLWKRIDDAEYYLVSGSFDQAVLTALSVANGIHMAFFGER

SEQ ID NO: 25706 - DNA, 899 bp, Zea mays
  misc_feature: Ceres CLONE 1397717-F
  misc_feature (13)..(13): n is a, c, t, g, unknown, or other
  misc_feature (36)..(36): n is a, c, t, g, unknown, or other
  misc_feature (43)..(43): n is a, c, t, g, unknown, or other
  misc_feature (44)..(44): n is a, c, t, g, unknown, or other
  misc_feature (498)..(498): n is a, c, t, g, unknown, or other
  misc_feature (899)..(899): n is a, c, t, g, unknown, or other
gccccccccccangccgcctcaaggccctcccttgnggttttnnttttaaacctggagctccccgcggtggcggccgctctatactagtggatcccccgggctgcaggggttcgcacgagaccattacctagaacatcctaatcgaaaaaaaaaaaaagttggtcctgctcccaccctccgtccgaccgtcctcgacctcccgtcccgccgcctcccacagacgcaaccctagtcccacccgccgtcctcccgccctcccgcttcccattttcagtcgccgagccgcggacagtggacgcactgcacagcggcatcgcaacttccagcgaggggccctgagctcctccattccacccttcctgtggcccgtcgtaaacccctgcgcgggcgaaggtggtggcgctacccatggatgcttgggttaacggcgggattcgggcccctgcgcgcaacccctcccgcccggggggcccaccgcccaccccccttacaggggncctccaccacccccccctgggaagccccaaactcccgggctcaccggaccacggaagcaccatgaaatgttcctactcgccacgccgatgcactgtcccaaatccaaggctctgtccttgtcccactcctcccccttaatggccaccccgagtctcccggggccttatcccggaccaatttcctatcccagacacttcccccgactccctcggggaaacccccggcaccaaccacccgcataacacccccatggccagcgaacgatacccaggcaatccacgctaaaggcgtaatatactaaccaaaaaccgtctcgcacagacaacctgaaacaaccctctgtcacggcggcgacctaatggcagccctcaccgacaagccgcatcgacacctgtcgggn

SEQ ID NO: 25707 - DNA, 735 bp, Zea mays
  misc_feature: Ceres CLONE 1397719-F
  misc_feature: Encodes the peptide sequence at SEQ ID NO. 25708
  misc_feature (645)..(645): n is a, c, t, g, unknown, or other
  misc_feature (668)..(668): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (707)..(707): n is a, c, t, g, unknown, or other
  misc_feature (708)..(708): n is a, c, t, g, unknown, or other
  misc_feature (735)..(735): n is a, c, t, g, unknown, or other
ggagctccccgcggtggcggccgctctagaactagtggatcccccgggctgcaggaattcgcacgagaccattacctagaacatcctaatcgaaaaagatccattgttcacgacctcaccctattcagatcccaagcggccacgcccaagcccaaaccctacccacccatctcaaccagcgatgatggcagcggagccctcgccgtcggttccctccaccgccgctgaagacatggaaaccctcgccctcgactcatcctcttcgtccgccgccgctacggcctccgcctccgaccccctccttcggccacctacctccccgaccgccgccgcgagcgacgaccccttcgtcatcgacgacttcctcgacgaggacgacttcaccgccccggcgcccagcgtcgccggcccgccgcccgccgggcttggcgatgcggcgtccccagtgttccccaagatcaccgtatccgatcccaagaagcacgccgagcctaagcggcggggtgctgccggtgtgatcccgggatccggcagctacttttcttactcatcaccacccgttttgcgggcgggggtggggaagtcagcgtgcggcgcgctcccgcgacgtgtgggccctcgcggacggcttggcgcagctcacgncggcttaatttgcccgggccggnccgacaagnnngccttcgagggggcaggtcttggcacgnncacactcggggagcaagcgtgcgctgn

SEQ ID NO: 25708 - protein, 184 aa, Zea mays
  misc_feature: Ceres CLONE 1397719-F
  misc_feature (155)..(155): Xaa is any aa, unknown, or other
  misc_feature (163)..(163): Xaa is any aa, unknown, or other
  misc_feature (166)..(166): Xaa is any aa, unknown, or other
  misc_feature (176)..(176): Xaa is any aa, unknown, or other
MMAAEPSPSVPSTAAEDMETLALDSSSSSAAATASASDPLLRPPTSPTAAASDDPFVIDDFLDEDDFTAPAPSVAGPPPAGLGDAASPVFPKITVSDPKKHAEPKRRGAAGVIPGSGSYFSYSSPPVLRAGVGKSACGALPRRVGPRGRLGAAHXGLICPGRXDKXAFEGAGLGTXTLGEQACA

SEQ ID NO: 25709 - DNA, 698 bp, Zea mays
  misc_feature: Ceres CLONE 1397722-F
  misc_feature: Encodes the peptide sequence at SEQ ID NO. 25710
aagctggagctccccgcggtggcggccgctttcgaactagtggatcccccgggctgcaggaattcgcacgagaccattacctagaacatcctaatcgaaaaatcgatcccagccccaggccatggcgacgaggtggaggaggtcgctgctctgggtcgccgtcgtccagttcctgaccctgtgcgtcgccgagcatctcgtagtggaagcatacaaaaagtcctacattgtgtatctgggatcacatgcatatggccgtgatgcgtcggcggaggagcatgctcgcgcaacccagtctcaccaccacctcctggcatcgatcctcggcggcgacgaccaccaccaccatgagacggcgcggcagtccatcttctactcctacaccaagagcagcatcaatggcttcgcggcgcacctggaggagtcggtcgcgcagcagatcgcggagcaccctgaggtggtggcggtgctggagagcaagatgctcaagctgcacaccacgcggtcctgggacttcatggacctggagcgcgacggtcacgtcctccctgcctccatctggaaccacgctaggttcggacaggacgccatcatcgccagtctcgacaggggcttgtgccccgaggccacggcttccagacgatggaggccaagtgccactccctgtaaggcttcggtctggaaccgcccccccgtgt

SEQ ID NO: 25710 - protein, 192 aa, Zea mays
  misc_feature: Ceres CLONE 1397722-F
  misc_feature (33)..(125): Pfam Name: Subtilisin_N Pfam Description: Subtilisin N-terminal Region
  misc_feature: SWISSPROT Homolog: EC 3.4.21.25 Cucumisin
MATRWRRSLLWVAVVQFLTLCVAEHLVVEAYKKSYIVYLGSHAYGRDASAEEHARATQSHHHLLASILGGDDHHHHETARQSIFYSYTKSSINGFAAHLEESVAQQIAEHPEVVAVLESKMLKLHTTRSWDFMDLERDGHVLPASIWNHARFGQDAIIASLDRGLCPEATASRRWRPSATPCKASVWNRPPV

SEQ ID NO: 25711 - DNA, 675 bp, Zea mays
  misc_feature: Ceres CLONE 1397728-F
  misc_feature: Encodes the peptide sequence at SEQ ID NO. 25712
ggagctccccgcggtggcggccgctctagaactagtggatcccccgggctgcaggaattcgcacgagaccattacctaaacatcctaatcgaaaaaccaacccttgtagtctcagtcaatctgtagattgagactacgatgagcctgtcaccgctcgactcctcctccccgccggccgcggctgcggctgctgctacggaggtgcccctcgccccgggcttccgcttccaccccaccgacgaggagctcgtctcctactacctccgccgccgcgtcctcggccgccgcctccgcgtcgacgccatcgccgagatcgacctctaccgcctcgagccctgggacctcccctccctctcccgcatccgcagccgcgacgcccagtggtacttcttcgcccgtctcgaccgcaaggtcgccggcgctggcgccgggggccggggcggtcccggcaacaggaccaaccgcgctacgccgagggggtactggaagaccacgggcaaggaccgcgaggtgcaccaccgcggcaagcccgtcggaatgaaaaagacgctcgtcttcacggtcgggagggcgcctaagggcgagaggaccaactgggccatgcacaaaaaacagccttctcgacggagacggatctccggggcctgggtggggtatgctcacgcctccccgagc

SEQ ID NO: 25712 - protein, 179 aa, Zea mays
  misc_feature: Ceres CLONE 1397728-F
  misc_feature (24)..(161): Pfam Name: NAM Pfam Description: No apical meristem (NAM) protein
MSLSPLDSSSPPAAAAAAATEVPLAPGFRFHPTDEELVSYYLRRRVLGRRLRVDAIAEIDLYRLEPWDLPSLSRIRSRDAQWYFFARLDRKVAGAGAGGRGGPGNRTNRATPRGYWKTTGKDREVHHRGKPVGMKKTLVFTVGRAPKGERTNWAMHKKQPSRRRRISGAWVGYAHASPS

SEQ ID NO: 25713 - DNA, 612 bp, Zea mays
  misc_feature: Ceres CLONE 1397729-F
  misc_feature: Encodes the peptide sequence at SEQ ID NO. 25714
gctcattacctagtggatcccccgggctgcaggaattcgcacgagaccattacctagaacatcctaatcgaaaaacagacagattaatcaacgcccgcacctcctatgggcacgaccggcgacgctccggctccggcgggggatccgcaggaccgccaccgtacccaccccccggcggcgaagcagcggacgacgcttgtgttcacgtacgggacgctgaagcgcggcttctccaaccaccgcctcctggaggagctcttcgcgagcggggacgcgtccctggtgggcccccgcgtggacgtccgcgccggatggcccctggtggtgccgggccccgtaacggggggggccccttccctggctgaaaccccccctgggggcccgcgcccccggggcaaaaacccatccccccaggcggtcgcgcccccacccccccctcatccacttaaaacacgcatctcccccaacataatagtacccaccgaccgttgggccgaacgcccgctctacccccctcccttaacttccacaagacccgccaccaacaagcttattgccccttctcagccccccctataccccctcgcggcccttaccaccaccccccatata

SEQ ID NO: 25714 - protein, 169 aa, Zea mays
  misc_feature: Ceres CLONE 1397729-F
MGTTGDAPAPAGDPQDRHRTHPPAAKQRTTLVFTYGTLKRGFSNHRLLEELFASGDASLVGPRVDVRAGWPLVVPGPVTGGAPSLAETPPGGPRPRGKNPSPQAVAPPPPPHPLKTRISPNIIVPTDRWAERPLYPPPLTSTRPATNKLIAPSQPPLYPLAALTTTPHI

SEQ ID NO: 25715 - DNA, 714 bp, Zea mays
  misc_feature: Ceres CLONE 1397731-F
  misc_feature: Encodes the peptide sequence at SEQ ID NO. 25716
  misc_feature (357)..(357): n is a, c, t, g, unknown, or other
  misc_feature (502)..(502): n is a, c, t, g, unknown, or other
  misc_feature (611)..(611): n is a, c, t, g, unknown, or other
  misc_feature (612)..(612): n is a, c, t, g, unknown, or other
aaagctggagctccccgcggtggcggccgctctagaactagtggatcccccgggctgcaggaattcgcacgagaccattacctagaacatcctaatcgaaaaatcccaagaagagccgccctacctattccttctcccagccgtcgagctgcccaacccagagcaccagcagccctcaccttcttcctctcggccggtccttcaaacgagcccgctcgtcttggagccgccgccggtctcgttctggacgaacgttcaaggagattgcatttgtggatgctctaatggagtcgaaaggtggcaagaagtctagtagtagtagtagtaatttcatgtacgaagctccccttggctacnagatcgaggacgttcgcccagccggaggaatcaagaagttccagactgctgcttattccaactgcgtccgccagccatcctgatatcgcctcacatgcaattcgcggtagagtaggattttaattcagttttcctcttgtgtcgntaggtttccgttggctctggctgccttcctctgcttctgagattccaacttgtcttgcccatctctccttttcctctctcatcctctctttcttgcacacgtctccaanntgggcgatgtcttcagcaggattcttgtgtctcttctcctgcctcccctatttggctttgagggctatgagaggcgcttcgagatcacgttctctgacgcgc

SEQ ID NO: 25716 - protein, 51 aa, Zea mays
  misc_feature: Ceres CLONE 1397731-F
  misc_feature (1)..(51): Pfam Name: AdoMetDC_leader Pfam Description: S-adenosyl-l-methionine decarboxylase leader peptide
  misc_feature (25)..(25): Xaa is any aa, unknown, or other
MESKGGKKSSSSSSNFMYEAPLGYXIEDVRPAGGIKKFQTAAYSNCVRQPS

SEQ ID NO: 25717 - DNA, 716 bp, Zea mays
  misc_feature: Ceres CLONE 1397735-F
  misc_feature: Encodes the peptide sequence at SEQ ID NO. 25718
  misc_feature (607)..(607): n is a, c, t, g, unknown, or other
  misc_feature (648)..(648): n is a, c, t, g, unknown, or other
aaagctggagctccccgcggtggcggccgctctagaactagtggatcccccgggctgcaggaattcgcacgagaccattacctagaacatcctaatcgaaaaattttttcatttcttccccccttctcgtcacgtccaaaggggggaaaacttctttctctctcttttttttccctcccccgcccgaatctgatgcttaaaccctcgccgggaggaggattccaatcccgacgcaccagcccgcgcccgccacctacagccgcgcccggatctccgccatggccgccgcgccgcaccaggcccagggccccgcagatagtgtgattccgctgcagtctgaacccgcacttgataataacccctccaagagtgcaaacgccagggaccagattctttctggtacggagaatgtgactacaggcaatgcacgcggcggcagctccttgaaatcgcaaaaaggcccgccagagaaggctagctctgttggaaaacctggagaacaaccttttccctaccagcaaaatgtgtatgcaccacagccacaaccactctatcctggaggctacatgaacccttcaggacaatgggaggaaatccccattatggnagggatggaggggctccattccgtatctcccggaatctacnatgacaaccaatccctcatgctatctcctggatatgcaaacacccccaaatgatgtatggagcatatt

SEQ ID NO: 25718 - protein, 140 aa, Zea mays
  misc_feature: Ceres CLONE 1397735-F
  misc_feature (110)..(110): Xaa is any aa, unknown, or other
  misc_feature (124)..(124): Xaa is any aa, unknown, or other
MAAAPHQAQGPADSVIPLQSEPALDNNPSKSANARDQILSGTENVTTGNARGGSSLKSQKGPPEKASSVGKPGEQPFPYQQNVYAPQPQPLYPGGYMNPSGQWEEIPIMXGMEGLHSVSPGIYXDNQSLMLSPGYANTPK

SEQ ID NO: 25719 - DNA, 713 bp, Zea mays
  misc_feature: Ceres CLONE 1397737-F
  misc_feature: Translation starting site: 288
  misc_feature (429)..(429): n is a, c, t, g, unknown, or other
  misc_feature (430)..(430): n is a, c, t, g, unknown, or other
  misc_feature (449)..(449): n is a, c, t, g, unknown, or other
  misc_feature (450)..(450): n is a, c, t, g, unknown, or other
  misc_feature (525)..(525): n is a, c, t, g, unknown, or other
aaagctggagctccccgcggtggcggccgctctagaactagtggatcccccgggctgcaggaattcgcacgagaccattacctagaacatcctaatcaaaagtttatacgttcagggctactattgaagcagactccacccggcgcgtcctcgtctcgtctcgtctcgcacgcacccctcactttccttgtcaatcgactcgcgatcgaatccgccccgagtcgattccgccgcggaccgcccggttcacttcccttttctcccgagatctcgactctcgagcaagtatgggtgaggcgaaggacaacgaggtgtacgaggaggacctagtcgactatgaggaggaggtggagaatgtcattgatggcgcccccaccaacggctcctcagatgtcgtcaagaaggggtacgtagggatccacagctcgnngttcagagacttcctgctnncagcagagcttctcgcgccatcagggattggcgggtttgagcatcctttctgaagtgcaacatgagtgcatcccntcagctatctgggggaatgaatgtcatctgtcagcaaattctgaaaggttaaaaatgggcattttttgccctgccattcttcagcagattgaaccctgtggctggcaagaatgtgcatttggggtgggggccaaacaaaaaatagcttacaaatttgcccggaatttgggggggtttaaaaaaacggc

SEQ ID NO: 25720 - DNA, 564 bp, Zea mays
  misc_feature: Ceres CLONE 1397741-F
  misc_feature: Encodes the peptide sequence at SEQ ID NO. 25721
aaagctggagctccccgcggtggcggccgctctagaactagtggatcccccgggctgcaggaattcgcacgagaccattacctagaacatcctaatcgaaaagctggtgcttctacggggcctggcgatttgaattcgagtggtgcgtgtatagagcgtgagagagagaaaagagagtggctcttgcgctctgcagtccagttcttgaatccagagctgcgattcgtgctcgcctggacgccgaatggggccgggaagcctggagccccgtttgcttaccgcgggagctgacaaactggacaaggacctaaagcccccccgccccccttgaaggggttaagtttaaccccaaaacctgggacccaggccttccccaatcccccccgggggtccaaccccccccgggcggccccgggcccaaagagatttcccccccggggggagatcccccccctcctcaaggggggggggggggggggggggggccaaaattgggggggaaaaagggaattttggggggcccccgggggggggccccccccccccgggggggcgttccccccc

SEQ ID NO: 25721 - protein, 96 aa, Zea mays
  misc_feature: Ceres CLONE 1397741-F
KAGAPRGGGRSRTSGSPGLQEFARDHYLEHPNRKAGASTGPGDLNSSGACIEREREKREWLLRSAVQFLNPELRFVLAWTPNGAGKPGAPFAYRGS

SEQ ID NO: 25722 - DNA, 672 bp, Zea mays
  misc_feature: Ceres CLONE 1397742-F
  misc_feature: Encodes the peptide sequence at SEQ ID NO. 25723
  misc_feature (275)..(275): n is a, c, t, g, unknown, or other
  misc_feature (391)..(391): n is a, c, t, g, unknown, or other
  misc_feature (411)..(411): n is a, c, t, g, unknown, or other
aaagctggagctccccgcggtggcggccgctctagaactagtggatcccccgggctgcaggaattcgcacgagaccattacctagaacatcctaatcaaaaaatcccaaatagttactccactcccctcacccctcccgactcccgtgctctctctctctctctctctcggatccgaattgccagcgcaccagtcgagctcgcgggaactcgccggcaccggcgatggcctccgccctactgcgggacagggcggggcgcgccaccacggctggngggagacgcgcgccccactcgcgcccatacctcccaaccctaaccccagccagccccacccgcgcgccgacggggtccaagtcccagccgcgggcggcagcctcctcgccggcggncggatacgtgacgttcccgnccggccggccctgggcccgcgcgaggggccgggggttccggaccggccttggggggggaaggtcccccagggggggcgcccttcttccccccggatggacccctgggaaaaaccaggggcccgcccccccgcggggttccccgcggggaggggggggaaaggggggggggaaaaatcccccccagggtgggcaagggaaaaaggggcgggggggtttacaccccccccctcgggggggggacccccccccccccccccccc

SEQ ID NO: 25723 - protein, 55 aa, Zea mays
  misc_feature: Ceres CLONE 1397742-F
MDPWEKPGARPPAGFPAGRGGKGGGEKSPPGWAREKGAGGFTPPPSGGGPPPPPP

SEQ ID NO: 25724 - DNA, 717 bp, Zea mays
  misc_feature: Ceres CLONE 1397743-F
  misc_feature: Encodes the peptide sequence at SEQ ID NO. 25725
  misc_feature (427)..(427): n is a, c, t, g, unknown, or other
  misc_feature (586)..(586): n is a, c, t, g, unknown, or other
aaagctggagctccccgcggtggcggccgctctagaactagtggatcccccgggctgcaggaattcgcacgagaccattacctagaacatcctaatcgaaacttctacgtaacacttttcccgtcttccccttcctcgccgcctccactacagggctttgctcctcccaactctcgaaaccctacccacccgatgagagatcgatcggtcgagcgcgaattccccagccgcgagcggggggatcggccgccgcccggggtgctggggcccccgcgccgcgggccggcgtacaagacgaagttgtgcgcgctgtggcagcgcggcggctgttcccgcgacacatgcagcttcgcgcacggacacgccgagctccgccggttccccggatcgcgcacctcgttcccacccccgcgccgggagaagagantatagagctggtgactttagagatagggtttggataggaggcgctcacctcaataggaggcatccccctgatggagatttcaagacggcatcggttcccctcggggacggacggccaaatccccaggaaaggggaatcaagtttttcccggctccccantaggaaaaagggaaagggggcatggaaaaaaaccctgatggggggaaaactaactcttttagggggccccgggggctggaaaaaagggggaaaaaaaaaggggaccgtgtaaagggggggagtaaaagaga

SEQ ID NO: 25725 - protein, 78 aa, Zea mays
  misc_feature: Ceres CLONE 1397743-F
  misc_feature (33)..(57): Pfam Name: zf-CCCH Pfam Description: Zinc finger C-x8-C-x5-C-x3-H type (and similar)
MRDRSVEREFPSRERGDRPPPGVLGPPRRGPAYKTKLCALWQRGGCSRDTCSFAHGHAELRRFPGSRTSFPPPRREKR

SEQ ID NO: 25726 - DNA, 698 bp, Zea mays
  misc_feature: Ceres CLONE 1397744-F
  misc_feature: Encodes the peptide sequence at SEQ ID NO. 25727
  misc_feature (521)..(521): n is a, c, t, g, unknown, or other
  misc_feature (545)..(545): n is a, c, t, g, unknown, or other
  misc_feature (602)..(602): n is a, c, t, g, unknown, or other
  misc_feature (635)..(635): n is a, c, t, g, unknown, or other
  misc_feature (645)..(645): n is a, c, t, g, unknown, or other
  misc_feature (687)..(687): n is a, c, t, g, unknown, or other
  misc_feature (690)..(690): n is a, c, t, g, unknown, or other
  misc_feature (698)..(698): n is a, c, t, g, unknown, or other
ggagctccccgcggtggcggccgctctagaactagtggatcccccgggctgcaggaattcgcacgagaccattacctagaacatcctaatcaaaaacacgcgaaggcacctagcagccgccactcgccgaactgaggaacacgccgggcgacgggatacagcagcagcgcgcccctctatgcccgacgcgacggcgccctgcagctgcagataaacctgttccaatggccaaacaaaaagagggtgtggacaaaagaactgctaggaagatgatccgatctacggaaggctgtgcaaagagcattactttcgagaggaacaacaaatcagacgctgtgcagcttcacgatctgccgaatgacatcctaggtagcatactatcacggttgacattcagagaatcctcacagatgggccttgtttctcatacctggcggcggctgtggagaagctgttgccggaaactggtcttcaccagtgccaccatgttccaacccggaaataggagcatcaaacatacnaggaccaactttgccatgagagtncacagtttcttgcgtcagctacacactcatcctactcataaataagttgttattaangtcgggctgcgcaggaagcacactcgccatgtncacagatggnatcgcttctgctccgtgtcgcgagcaagaacatcactataanttncactcctn

SEQ ID NO: 25727 - protein, 121 aa, Zea mays
  misc_feature: Ceres CLONE 1397744-F
  misc_feature (38)..(85): Pfam Name: F-box Pfam Description: F-box domain
MAKQKEGVDKRTARKMIRSTEGCAKSITFERNNKSDAVQLHDLPNDILGSILSRLTFRESSQMGLVSHTWRRLWRSCCRKLVFTSATMFQPGNRSIKHTRTNFAMRVHSFLRQLHTHPTHK

SEQ ID NO: 25728 - DNA, 720 bp, Zea mays
  misc_feature: Ceres CLONE 1397746-F
  misc_feature (374)..(374): n is a, c, t, g, unknown, or other
  misc_feature (547)..(547): n is a, c, t, g, unknown, or other
  misc_feature (590)..(590): n is a, c, t, g, unknown, or other
aaagctggagctccccgcggtggcggccgctctagaactagtggatcccccgggctgcaggaattcgcacgagaccattacctagaacatcctaatcaaaaaacatcgattttcctccggaatcgtaacctcagaaagccaaatctcattctccggcgctcaggcccacccaagcgtcgactctcccgatccaatcggtacctcctagttcctcgccggcggtagcggcgtcgggcgaacagcggtgacttggcgagggcgcttggccggcgacaatcatccactaggatggaaggtgaggcagagaccgtgggttggttcttgttctaaaccatgtgggcctctggaggactactacattccagattacattnctgaagccaggtgcccaacaaggtacttggttgatcatgcggcaccctgccccgggttgtagtgttcatcaactcaaggatctggaggcaaactttgggaagtagtttaatcaaaacatatcgtgagcttctcatgaagcacagggtttttgatctctcaaaagagctccagnataaggtatttgcatcgtttatatgccaaccttgaaaggctgnaagatggaaggagccattcttggcagtcaaaatttggaggacctgaggctaattggtggcaggcggtgatgtaacagctagctggctggctggggggtagtcagtgacccttagctttccaccccactcc

SEQ ID NO: 25729 - DNA, 711 bp, Zea mays
  misc_feature: Ceres CLONE 1397747-F
  misc_feature: Encodes the peptide sequence at SEQ ID NO. 25730
  misc_feature (711)..(711): n is a, c, t, g, unknown, or other
aaagctggagctccccgcggtggcggccgctctagaactagtggatcccccgggctgcaggaattcgcacgagaccattacctagaacatcctaatcgaaaactcctctcgctcgcgtccgcacaaatcccgtgctcccccgtctgaaaaccctccccacctccggcggcggcggcggcgctggcgaccgggtgtcttctccggcgagtctcccccctagtaacaagaaaatatggatgtacctgttgatgaccctgtggagaacctcactggaagtcctagtacccttggcaatgaggaagaagccactacttatgctaatgtgcaagatcagtccaaggaagaaccagaaaagctttacgaggaacccaaagacccaatgcaagacgagttgggtaaccaagggcatgtgagcatgaacaatgaagatgtgggaggccagaacaaagtggaccaagctacccccacagagcacggcgaggaaagctggggtgaagcagcatgatgctacagttcctgatgacaagaaatgggcctggttggctgggaagagagtgtgttcccgtatactggttcctacaccaaggggtgggtgccgtcattgggcgcccaaaggggatttcatcaagaaaaatgtgtgaggaatcaagagccccgcatcagggttcttgagggaccaccatctgtgccagaaagagcctgtaatgattn

SEQ ID NO: 25730 - protein, 90 aa, Zea mays
  misc_feature: Ceres CLONE 1397747-F
MDVPVDDPVENLTGSPSTLGNEEEATTYANVQDQSKEEPEKLYEEPKDPMQDELGNQGHVSMNNEDVGGQNKVDQATPTEHGEESWGEAA

SEQ ID NO: 25731 - DNA, 711 bp, Zea mays
  misc_feature: Ceres CLONE 1397748-F
  misc_feature (279)..(279): n is a, c, t, g, unknown, or other
  misc_feature (351)..(351): n is a, c, t, g, unknown, or other
  misc_feature (440)..(440): n is a, c, t, g, unknown, or other
  misc_feature (566)..(566): n is a, c, t, g, unknown, or other
  misc_feature (569)..(569): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (592)..(592): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (655)..(655): n is a, c, t, g, unknown, or other
  misc_feature (656)..(656): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (709)..(709): n is a, c, t, g, unknown, or other
aagctggagctccccgcggtggcggccgctctagaactagtggatcccccgggctgcaggaattcgcacgagaccattacctagaacatcctaatcgaaaaatagcgaacaaacatcgagtacagccggctaggtaatctggtacgacgacccacgacgacttggcggcggccaccaccaccagcagcagcaagaagtcgtcgtcgccgtcgtcctcgagctcggcgcagcgggcagcagctgccgccctgctcgtggcggtgtccgtcctggtggtgnggcgcggcggcggtgtgcgacatgagcaacgagcagttcatgtcgtgccagcccgcggcggccaagacacgngacccgcgggccgcggccgtcgcaggcgtgctgcgacgcgcttggcgggggcggacctcaagtgcctgtgcggctacagaactcgccgntggatgggcgtctacaacatcgaccccaagcgcgccatggagctgccggccaagtgcggcctcgccacgccgcccgactgctagccaagcccaagcaggaaggcccccggcattgctagctgtagnggnggggggggggggggnnnnngggngnnnnnnnnnnnnnnnnnnnnnnnnnnnngnnnnnnnnnnnnnnnnnnnnnnnnnnnnnnngnngnnnngnnnnnnnnnnnnnnnnnnnnnnnnnnnnnnnngnnnnnnnngnnngngg

SEQ ID NO: 25732 - DNA, 728 bp, Zea mays
  misc_feature: Ceres CLONE 1397749-F
  misc_feature: Encodes the peptide sequence at SEQ ID NO. 25733
  misc_feature (204)..(204): n is a, c, t, g, unknown, or other
  misc_feature (259)..(259): n is a, c, t, g, unknown, or other
  misc_feature (700)..(700): n is a, c, t, g, unknown, or other
aaagctggagctccccgcggtggcggccgctctagaactagtggatcccccgggctgcaggaattcgcacgagaccattacctagaacatcctaatcgaaaagtccttcttccttctctcacacactccactccacgtccccctccttcaaatcctttcaacacccaagcacaaggagagagaagccgccgccgccgccatggnacaatattgaggtgaggaggaggaagaagaaagggagaagcagcggacgccgccnggggggacgggtacaggcggtcctgcgcgccggcctcgtcgccatggccttcgccctcctctgcctctgctcctccacgccctccgccattgccctcaccccagacggcgaggcgttgctggagctcaagctggccttcaatgccaccgtgcagcggctcaccagctggcgtcccagcgaccccaacccctggcggctgggagggcatctcctgctccgtccctggacctcagggtccaatccataaacctcccattcatggcagctcgggggcatcatttcgcccagcatcgggaggctcgacaagctgcagagactagctctgcaccagaacagcttgcacggccaatccccctgcagaagatcagaactgcaccgagctcagggcaatttacctgagagccactacccctgcaggagcatccccctcaaagaatgggngagctcgtgcacctcaccatcttggacg

SEQ ID NO: 25733 - protein, 67 aa, Zea mays
  misc_feature: Ceres CLONE 1397749-F
MAFALLCLCSSTPSAIALTPDGEALLELKLAFNATVQRLTSWRPSDPNPWRLGGHLLLRPWTSGSNP

SEQ ID NO: 25734 - DNA, 716 bp, Zea mays
  misc_feature: Ceres CLONE 1397750-F
  misc_feature: Encodes the peptide sequence at SEQ ID NO. 25735
  misc_feature (508)..(508): n is a, c, t, g, unknown, or other
  misc_feature (548)..(548): n is a, c, t, g, unknown, or other
  misc_feature (636)..(636): n is a, c, t, g, unknown, or other
caaagctggagctccccgcggtggcggccgctctagaactagtggatcccccgggctgcaggaattcgcacgagaccattacctagaacatcctaatcgaaaaatccgctccccgccttccgcttccctaccccccgcatcacctaccaacgccgacaccatgggggccttcgcgaaggaggagcaccagttcctagccgagctcggcctcgcgcagcgcaacccaggcgcgttcgcatgcggtgcgtggggcggctcaggtcccaccgtcacctccacgagcccgaccaacaatcaggtcatcgcagaggtcgtggaggcgtccgtgcacgactacgaggagggcatgcgcgcctgcttcgatgccgccaagacatggatggcgattcctgctccaaagcgaggagagatcgttaggcaaatcggtgatgcactgagagcaaagctccatcaccttggcaggcttgtgtcacttgagatggggaaattcttcctgaagggaatcggntgaggttcaggaaatcatcgacatgtggtgattatgctgntggggctaagtcgccaactaaatggatccattataccatctgaacgaccaacatatgattgatgggaggtgtggatcctcttggaagntggggggtgttataacggcatttaatttcccttgtgctgtgctttggttggaatgcttgcattgctttggtctgtggaaa

SEQ ID NO: 25735 - protein, 116 aa, Zea mays
  misc_feature: Ceres CLONE 1397750-F
  misc_feature: SWISSPROT Homolog: EC 1.2.1.3 Aldehyde dehydrogenase (NAD(+))
MGAFAKEEHQFLAELGLAQRNPGAFACGAWGGSGPTVTSTSPTNNQVIAEVVEASVHDYEEGMRACFDAAKTWMAIPAPKRGEIVRQIGDALRAKLHHLGRLVSLEMGKFFLKGIG

SEQ ID NO: 25736 - DNA, 716 bp, Zea mays
  misc_feature: Ceres CLONE 1397751-F
  misc_feature: Encodes the peptide sequence at SEQ ID NO. 25737
aaagctggagctccccgcggtggcggccgctctagaactagtggatcccccgggctgcaggaattcgcacgagaccattacctagaacatcctaatcgaaaaaggctcctctcccccgttgcgcaacgcgctttcccccacttcacccgcctcggcgccatggctaagctcgcgctggcgctcctcctcctgctggccgtggcggcgtccgcgtcggccagcagcgggagccacctggatctcgacctgggcttcctctcctctggggaacgccggagggagtgccgcggcacggtggccgagtgcctcgccgaggagtcggatgaggagggccttgacctggtcggatcccaccgccgcgcgctctacggcggcgggtacatcagctacggcgcgctgcggcgggacaacgtgccctgctcccgccgcggcgccagctactacaactgccgcccgggcggccaggccaacccctaccaccgcggctgctcccgcatcacccgctgccgcggctgaggcgcctccggatccgcccgactgccgaggaaaggtctggttggtcaaggccccggtccttatcgcgtaaataatttctttcgccttggatggaccggcgctaccgccaccgtcacgggtgtttactattagcccagccccaacggatgaactccctgatagcccttgaatagaacagcgacttacaccagatacacccc

SEQ ID NO: 25737 - protein, 118 aa, Zea mays
  misc_feature: Ceres CLONE 1397751-F
  misc_feature (53)..(118): Pfam Name: RALF Pfam Description: Rapid ALkalinization Factor (RALF)
MAKLALALLLLLAVAASASASSGSHLDLDLGFLSSGERRRECRGTVAECLAEESDEEGLDLVGSHRRALYGGGYISYGALRRDNVPCSRRGASYYNCRPGGQANPYHRGCSRITRCRG

SEQ ID NO: 25738 - DNA, 708 bp, Zea mays
  misc_feature: Ceres CLONE 1397752-F
  misc_feature: Encodes the peptide sequence at SEQ ID NO. 25739
  misc_feature (119)..(119): n is a, c, t, g, unknown, or other
  misc_feature (306)..(306): n is a, c, t, g, unknown, or other
  misc_feature (338)..(338): n is a, c, t, g, unknown, or other
  misc_feature (574)..(574): n is a, c, t, g, unknown, or other
aaagctggagctccccgcggtggcggccgctctagaactagtggatcccccgggctgcaggaattcgcacgagaccattacctagaacatcctaatcgaaaaaccctcccccaccgccnttgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatggtggtggcgtcggtgctcaagnaaccggcggtgtcgacggcctcccgccggggncctccgggttggccgggtggtggggaacctgttccaggtgatcctgcagcgacggcccttcatgtacgtggtgcgcgacctccgggagaagtacgggcccatcttcaccatggcggatggggcagccaccctcatcgtggtcacctcggcggagctcatccacgaggcgctgggtgaagcagggccccatgttcgcgagccggcccgaggacagccccacccgcctcctcttcagngtcggcaagtgcaccgtcaactcggcgcctacggcccccctgtggcgtgctctgcgccgcacttcgtcgccgagatcgtgtcccgcacggcgtcagggcttctctggaaccgggaaggggccgtggacgcgcct

SEQ ID NO: 25739 - protein, 103 aa, Zea mays
  misc_feature: Ceres CLONE 1397752-F
  misc_feature (59)..(59): Xaa is any aa, unknown, or other
MYVVRDLREKYGPIFTMADGAATLIVVTSAELIHEALGEAGPHVREPARGQPHPPPLQXRQVHRQLGAYGPPVACSAPHFVAEIVSRTASGLLWNREGAVDAP

SEQ ID NO: 25740 - DNA, 666 bp, Zea mays
  misc_feature: Ceres CLONE 1397754-F
  misc_feature: Encodes the peptide sequence at SEQ ID NO. 25741
  misc_feature (379)..(379): n is a, c, t, g, unknown, or other
  misc_feature (557)..(557): n is a, c, t, g, unknown, or other
  misc_feature (558)..(558): n is a, c, t, g, unknown, or other
  misc_feature (566)..(566): n is a, c, t, g, unknown, or other
  misc_feature (642)..(642): n is a, c, t, g, unknown, or other
  misc_feature (647)..(647): n is a, c, t, g, unknown, or other
  misc_feature (648)..(648): n is a, c, t, g, unknown, or other
aaagctggagctccccgcggtggcggccgctctagaactagtggatcccccgggctgcaggaattcgcacgagaccattacctagaacatcctaaaaaagaagacctttgccgtttttattcttcctccgtctctgcctgtacagcggcggcttggccacctctgagcctcaagccctcaacctccctcttcggcgcgtaacgtcagtcctcaggtattggcagcataaagtgttagatttgtccttgattgaggtaccccttcaaaggtcaagatgttgtggcgcgcagtacgcagtatggatgtaataatgcattcttcgagtttccttcttccgaaactgtatcaacctgtcaacaaaccagtcaagaactatgcntttagttgttctaaaccagcatcttccacgattcatgcctcgactctgggatcatgcaaacttgaggatctgcgctgatggaggagctaatcatatttttgatgagatgtatcagataaccaatgatgaagacaaaaaaagaccagaaaataagtatgttccagaaataattgaaggnngacatggnatctataagactgaaggtaaaactggtctactcctagtcagggatccaaaattttctgataagtcacataaccagnagacnnacagatctacacaaatgt

SEQ ID NO: 25741 - protein, 97 aa, Zea mays
  misc_feature: Ceres CLONE 1397754-F
  misc_feature: SWISSPROT Homolog: EC 2.7.6.2 Thiamine diphosphokinase
  misc_feature (2)..(2): Xaa is any aa, unknown, or other
  misc_feature (62)..(62): Xaa is any aa, unknown, or other
  misc_feature (90)..(90): Xaa is any aa, unknown, or other
  misc_feature (92)..(92): Xaa is any aa, unknown, or other
MXLVVLNQHLPRFMPRLWDHANLRICADGGANHIFDEMYQITNDEDKKRPENKYVPEIIEGXHGIYKTEGKTGLLLVRDPKFSDKSHNQXTXRSTQM

SEQ ID NO: 25742 - DNA, 699 bp, Zea mays
  misc_feature: Ceres CLONE 1397755-F
  misc_feature: Encodes the peptide sequence at SEQ ID NO. 25743
  misc_feature (351)..(351): n is a, c, t, g, unknown, or other
  misc_feature (473)..(473): n is a, c, t, g, unknown, or other
  misc_feature (492)..(492): n is a, c, t, g, unknown, or other
  misc_feature (530)..(530): n is a, c, t, g, unknown, or other
aaagctggagctccccgcggtggcggccgctctagaactagtggatcccccgggctgcaggaattcgcacgagaccattacctagaacatcctaatcaaaaattttccaaatccgtctacgccctcacgcacgcggcccaactagcctaacaaaccctagctagatttagaaaaaaagtttgtccccaatccgaaccgacgaggagctcgccgccgtgagatgtccgagtacgacgagcgctaccagggcaacgccgacatgcccgcagccgaaggcggctatccgcaggccgagtacgccgccgccgccgcgcctggccgccgggggttcgccgcccgcagacagcaagnccctccgggttctccgaccacgccgacggccgctcctcccagcaccagcatgagacacaatcacatgacagtggttcctcgaaatctcgagaaagggaccgagaacgcgataagggcaaggnatagggagcgtgacagggnatcgtggccgagaaaaaggggagggaccgagacagggnataagggatcgtgaaagaagtggacagagacagagatcgcgatcgccaccacagggaccatcgagagcgcagcgagaaagggaaccaccgtgatcgtttctgatgatcgtgacgtcaaccgggatggtcgtgacgccacccgtgatgatcgtgatctagagggaggaga

SEQ ID NO: 25743 - protein, 107 aa, Zea mays
  misc_feature: Ceres CLONE 1397755-F
  misc_feature (44)..(44): Xaa is any aa, unknown, or other
  misc_feature (85)..(85): Xaa is any aa, unknown, or other
  misc_feature (91)..(91): Xaa is any aa, unknown, or other
  misc_feature (104)..(104): Xaa is any aa, unknown, or other
MSEYDERYQGNADMPAAEGGYPQAEYAAAAAPGRRGFAARRQQXPPGSPTTPTAAPPSTSMRHNHMTVVPRNLEKGTENAIRARXRERDRXSWPRKRGGTETGXKGS

SEQ ID NO: 25744 - DNA, 713 bp, Zea mays
  misc_feature: Ceres CLONE 1397756-F
  misc_feature: Translation starting site: 190
  misc_feature (408)..(408): n is a, c, t, g, unknown, or other
  misc_feature (447)..(447): n is a, c, t, g, unknown, or other
  misc_feature (454)..(454): n is a, c, t, g, unknown, or other
  misc_feature (459)..(459): n is a, c, t, g, unknown, or other
  misc_feature (460)..(460): n is a, c, t, g, unknown, or other
  misc_feature (473)..(473): n is a, c, t, g, unknown, or other
  misc_feature (491)..(491): n is a, c, t, g, unknown, or other
  misc_feature (503)..(503): n is a, c, t, g, unknown, or other
  misc_feature (689)..(689): n is a, c, t, g, unknown, or other
aagctggagctccccgcggtggcggccgctctagaactagtggatcccccgggctgcaggaattcgcacgagaccattacctagaacatcctaatcgaaaaacattccatcggtcgtgaaaagaaaaagggaaacaaaccaagctagagaaaagaagaaggtactacatactagctagctagcttagctatgggcaccatcgtcgacgctgacgtcgggttcgcggtgaagaggacgagcaggtcgctggtgccgcctgcgtcggcgacgccgcgggagacgctgcggctgtcggtgatcgaacgcgtggcggggctgcgccacctggtgcggtcgctgcacgtgttcgccgcgggcggcgacaagaagcggcagcaggcgacggcgacgccggccaaggcgctgcgnggaggcgctggggaagacgctggtggactactacccgtncggcggngcggnntcgtggtggtggnacgcggaggggcggcggngaagaacgcggntggcgtgcaccggcgagggcgcctgggttcgtggaggccaacgccgcgtgctcgctcgaggaggcccgccacctcgaccaccccatgctcatccccaaggagcagctgctgccggagccctcgccggacgtcaacccgctggactgccgctcatgatgcaggtgacggagttctcgtgcgggggcntcgtggtggggctcatctcgtgca

SEQ ID NO: 25745 - DNA, 689 bp, Zea mays
  misc_feature: Ceres CLONE 1397757-F
  misc_feature: Encodes the peptide sequence at SEQ ID NO. 25746
  misc_feature (569)..(569): n is a, c, t, g, unknown, or other
  misc_feature (621)..(621): n is a, c, t, g, unknown, or other
tggagctccccgcggtggcggccgctctagaactagtggatcccccgggctgcaggaattcgcacgagaccattacctagaacatcctaatcgaaaaaaaaaattcgattccacgaagcagcaatcgcaagttcgaagctctaaaataatctcttcccgacgtctctggaaggtcagcatctgaacccaggtagcctccagcgctggagacgtgccgtactcaaaccctagccaccaatggcagccggcggcggggctccgtgggcggagcgcgcgcgggtggtggggacgcagatccgcaacaggttccgcgtggcgcccgtggaccaccggtcgctgtggctgcgggcggacggtcgtgtcgccactgaggcggtccggcggtggtcggatcgcgttcgggccctgctgcagaggggccggagcgcggatcggaactccacatcgacggagacatcacctgaggcggtggcaaagccttcgtccagcgttttgagattctacagaaagagagggggcaaagaagttaatggggattgaagactctggttattttccgttcgcttcanggcattggctggttctcttattggcaatgcatgctatgtttttatgcatggncctaaactcagttccagtttaatgggggaaaaagaagcttcatcaggcattaacatgggagacctaaa

SEQ ID NO: 25746 - protein, 100 aa, Zea mays
  misc_feature: Ceres CLONE 1397757-F
MAAGGGAPWAERARVVGTQIRNRFRVAPVDHRSLWLRADGRVATEAVRRWSDRVRALLQRGRSADRNSTSTETSPEAVAKPSSSVLRFYRKRGGKEVNGD

SEQ ID NO: 25747 - DNA, 693 bp, Zea mays
  misc_feature: Ceres CLONE 1397758-F
  misc_feature: Encodes the peptide sequence at SEQ ID NO. 25748
  misc_feature (379)..(379): n is a, c, t, g, unknown, or other
aaagctggagctccccgcggtggcggccgctctagaactagtggatcccccgggctgcaggaattcgcacgagaccattacctagaacatcctaatcgaaaaaccacgagtttttcctgttcgctttgctttctcggctcagctactgctgctctgctaggaacaccaacagtagtgtgttcttgcgccggcttttcttgccgtgtttcgggtcgatattattgggagggtgggtctcccgtcccgtttcgatgaggccggaggagagagatgctgccgtggggagagtcagggaccagttccccgtcggcatgagggtcctcgccgtggacgacgaccccgtgtgcctcaaggtgcttgagaacctcctgcgccgctngcagtatcatgtgacaacgacgaatcaggctgttgtcgccttgagtatgctgaggcaaaacagggacctgtttgatcttgttatttagtgatgtcacatgccagacatggatggctttaagcttctagagcttgtggggcttgaaatggactccctgtcattatggttatcgtggatggagagacaaaactgaaatgaaggggatacttcatggggccggggctatccctaaaaaccggttcggttgaaaaactaagaatacttggcaaaggttttaaaagaaaatcgaactggggaccggtaaaaaggtggga

SEQ ID NO: 25748 - protein, 71 aa, Zea mays
  misc_feature: Ceres CLONE 1397758-F
  misc_feature: SWISSPROT Homolog: EC 3.1.4.17 3',5'-cyclic-nucleotide phosphodiesterase
  misc_feature: The sequence is a functional homolog of SEQ ID NO 936 in the 10/666,642 US patent application
  misc_feature: The sequence is a functional homolog of SEQ ID NO 934 in the 10/666,642 US patent application
  misc_feature: The sequence is a functional homolog of SEQ ID NO 172 in the 10/666,642 US patent application
  misc_feature: The sequence is a functional homolog of SEQ ID NO 2510 in the 10/374,780 US patent application
  misc_feature: The sequence is a functional homolog of SEQ ID NO 686 in the 10/412,699 US patent application
  misc_feature: The sequence is a functional homolog of SEQ ID NO 976 in the 10/225,066 US patent application
  misc_feature: The sequence is a functional homolog of SEQ ID NO 1410 in the 10/666,642 US patent application
  misc_feature: The sequence is a functional homolog of SEQ ID NO 476 in the 10/412,699 US patent application
  misc_feature: The sequence is a functional homolog of SEQ ID NO 580 in the 10/666,642 US patent application
  misc_feature: The sequence is a functional homolog of SEQ ID NO 238 in the 10/666,642 US patent application
  misc_feature: The sequence is a functional homolog of SEQ ID NO 912 in the 10/412,699 US patent application
  misc_feature: The sequence is a functional homolog of SEQ ID NO 937 in the 10/666,642 US patent application
  misc_feature: The sequence is a functional homolog of SEQ ID NO 1452 in the 11/479,226 US patent application
  misc_feature: The sequence is a functional homolog of SEQ ID NO 148 in the 10/225,066 US patent application
  misc_feature: The sequence is a functional homolog of SEQ ID NO 2512 in the 10/374,780 US patent application
  misc_feature: The sequence is a functional homolog of SEQ ID NO 688 in the 10/412,699 US patent application
  misc_feature (43)..(43): Xaa is any aa, unknown, or other
MRPEERDAAVGRVRDQFPVGMRVLAVDDDPVCLKVLENLLRRXQYHVTTTNQAVVALSMLRQNRDLFDLVI

SEQ ID NO: 25749 - DNA, 672 bp, Zea mays
  misc_feature: Ceres CLONE 1397760-F
  misc_feature: Encodes the peptide sequence at SEQ ID NO. 25750
  misc_feature (398)..(398): n is a, c, t, g, unknown, or other
  misc_feature (546)..(546): n is a, c, t, g, unknown, or other
  misc_feature (578)..(578): n is a, c, t, g, unknown, or other
  misc_feature (581)..(581): n is a, c, t, g, unknown, or other
  misc_feature (634)..(634): n is a, c, t, g, unknown, or other
  misc_feature (647)..(647): n is a, c, t, g, unknown, or other
  misc_feature (660)..(660): n is a, c, t, g, unknown, or other
  misc_feature (661)..(661): n is a, c, t, g, unknown, or other
aagctggagctccccgcggtggcggccgctctagaactagtggatcccccgggctgcaggaattcgcacgagaccattacctagaacatcctaaaaaaaatctctcgtctctatcgccgcatcgcttctctgccggagctccaacaacctcgcctcgcgcagcactccgctgaccctccctgactccctccctgccgctgggatggccgggaaacgagttacgggccgcgatgggcaagacgagggcggcgccaaggtcgggctcccggcgatggacctctccctcgcgttcccgcaggccacacctgcctccattttcccgccgtccgcttcggattattaccagtctgatgatttgctgaccagtgaagagcgctctatcaggatgaaggtcaggngtattatggaaaaagaaattgctcccattatgtcagcgtactgggaaaaggcagagtttccatttaatgccattcctaaacttgcaagccttggtgttgctggtgtacaataaaggggttatggggtgcccaggactttcattacagncagtgctggtactatgtcagaaattgcacggntanatgcaagctggtcacatttatactggtgcactcctctctttgcgatggtgacnatagctctttgcngatccgagctcannaaagcagagta

SEQ ID NO: 25750 - protein, 102 aa, Zea mays
  misc_feature: Ceres CLONE 1397760-F
  misc_feature: SWISSPROT Homolog: EC 1.3.3.6 Acyl-CoA oxidase
  misc_feature (66)..(66): Xaa is any aa, unknown, or other
MAGKRVTGRDGQDEGGAKVGLPAMDLSLAFPQATPASIFPPSASDYYQSDDLLTSEERSIRMKVRXIMEKEIAPIMSAYWEKAEFPFNAIPKLASLGVAGVQ

SEQ ID NO: 25751 - DNA, 669 bp, Zea mays
  misc_feature: Ceres CLONE 1397763-F
  misc_feature (425)..(425): n is a, c, t, g, unknown, or other
  misc_feature (637)..(637): n is a, c, t, g, unknown, or other
gctctagaactagtggatcccccgggctgcaggaattcgcacgagaccattacctagaacatcctaatcaaaaaacgtctcgtcagtttttttccctttttcccgtggcccgtgggtgtgcgtcctaggtgtgcggcgggcggtgcgccgtgcgcctcctctcctcgccgcgacgctgccgtgttcgcgattcagcgccgtgctcgacgcccctcctcccttcagaagtcagcgccgcatctccggttgcagagacttgcgctgccacctctccgcttttcgtccttcagttgctcgacgcccctcctcccctcagaagtcagcgcagcgtctccactctccacgccgtcgcgtcggcgacgcgggtccttcgaataagacggtttgttctcgcatcgggcgtcagccggattcgagggacatanatgatggaagtcgatcttgggtgccaccacgtcgaagcggcttgtgctgtgtagatccggcgaaagcgcgcaggcaaagcccgggtctgcgtcgtcattggcctcatgatcttcgtattgccatcgcgctaaagggacgaaggcgacgaggtcttaaactttgattgatatatgcggatatgaaatgcatgcactacatgctagaagctggncttggtttgggttgagaaaattctttggtacg

SEQ ID NO: 25752 - DNA, 676 bp, Zea mays
  misc_feature: Ceres CLONE 1397766-F
  misc_feature (466)..(466): n is a, c, t, g, unknown, or other
  misc_feature (501)..(501): n is a, c, t, g, unknown, or other
aaagctggagctccccgcggtggcggccgctctagaactagtggatcccccgggctgcaggaattcgcacgagaccattacctagaacatcctaatcaaaaaagaatatcgcatcgccgtcgcgtcgtcgtcgatctccccgccccgccccgcccgcgccgcggaatctgacacatctccctaatctctcctaggaccgggtgcccttacatccacgccgcaacgcaaatcgccgtccgagccctcgcggtctctcgtctccccgtgcgagaggacgccggcagcagcggcgtgccagtgcggtggcttggtgggggaagaccggaggcggcggcagagctcgcgcccagaggtgcacggcaggcctgttctcggcgtcggctgggggaaggcgagtagccccgggaaggacgagtgaataatcatgagctcgatctgccctttcgcgggagcaccactgggtggntggtgtatgccctgtgaaatctgataagagcaacnactggggtgtgccctgcaaaatctgacagagcatcagtggtgtatgccctgtcactggcaaggatcatggtagcagctcaaggaaaaggggtgattcttgttgaagaaagggcacccgatctcgtgtcgtaccagaaaaatgcccatccggtatgactcaaacttttcaggcgga

SEQ ID NO: 25753 - DNA, 716 bp, Zea mays
  misc_feature: Ceres CLONE 1397768-F
  misc_feature: Encodes the peptide sequence at SEQ ID NO. 25754
aaagctggagctccccgcggtggcggccgctctagaactagtggatcccccgggctgcaggaattcgcacgagaccattacctagaacatcctaatcgaaaagaagtttcggcggtggtgtacgtagcggcggtctcaaccccaggcgagctcggctccggtcacccgtcgatccacgcaaccatgtcgaggaggaagaccagggagcccaaggaggagaacgttacccttggacccactgtccgtgaaggagagtttgtctttggtgttggtcacatctttgcatccttcaatgacaccttcattcatgtcactgatttgtctgggagggaaactttggttcggatcactggtggcatgaaggttaaggctgatcgtgatgagtcgtctccttatgctgctatgcttgctgctcaagatgttgcacagcgttgcaaggagctcggtatcaccgcgctgcacattaagcttcgtgcaactggaggcaacaagaccaagacccctggacctggtgctcagtctgctctcagggctcttgctcgttctgggatgaaaattggacgcattgaggatgttaccccggttgccactgacagactcgagaaaaaggggggggtgggaaaggggaaagtgagcctgtggggggaggatcccgtgctgatttgcgatcacggtagcactggccgtctggaatagcgttgcttgattatgaggct

SEQ ID NO: 25754 - protein, 170 aa, Zea mays
  misc_feature: Ceres CLONE 1397768-F
  misc_feature (28)..(144): Pfam Name: Ribosomal_S11 Pfam Description: Ribosomal protein S11
MSRRKTREPKEENVTLGPTVREGEFVFGVGHIFASFNDTFIHVTDLSGRETLVRITGGMKVKADRDESSPYAAMLAAQDVAQRCKELGITALHIKLRATGGNKTKTPGPGAQSALRALARSGMKIGRIEDVTPVATDRLEKKGGVGKGKVSLWGEDPVLICDHGSTGRLE

SEQ ID NO: 25755 - DNA, 723 bp, Zea mays
  misc_feature: Ceres CLONE 1397770-F
  misc_feature: Encodes the peptide sequence at SEQ ID NO. 25756
  misc_feature (685)..(685): n is a, c, t, g, unknown, or other
  misc_feature (693)..(693): n is a, c, t, g, unknown, or other
aaagctggagctccccgcggtggcggccgctctagaactagtggatcccccgggctgcaggaattcgcacgagaccattacctagaacatcctaatcgaaaagaagtttcggcggcggcgtaggtagcggcggtctcaaccccaggcgagctcggctccggtcacccgtcgatccacgcaaccatgtcgaggaggaagaccagggagcccaaggaggagaacgttacccttggacccactgtccgtgaaggagagtttgtctttggtgttgctcacatctttgcatccttcaatgacaccttcattcatgtcactgatttgtctgggagggaaactttggttcggatcactggtggcatgaaggttaaggctgatcgtgatgagtcgtctccttatgctgctatgcttgctgctcaagatgttgcacagcgttgcaaggagctcggtatcaccgcgctgcacattaagcttcgtgcaactggaggcaacaagaccaagacccctggacctggtgctcagtctgctctcagggctcttgctcgttctgggatgaaaattggacgcattgaggatgttaccccggttcccactgacagcctcaaaaaaaggagggggtggaaaggagggaaaaaggaggctgtagggcgagtatcccttggctatttgccatcactttgcactgggncctctggntagcgtctgctgcattattagccttgccaa

SEQ ID NO: 25756 - protein, 170 aa, Zea mays
  misc_feature: Ceres CLONE 1397770-F
  misc_feature (28)..(143): Pfam Name: Ribosomal_S11 Pfam Description: Ribosomal protein S11
  misc_feature (168)..(168): Xaa is any aa, unknown, or other
MSRRKTREPKEENVTLGPTVREGEFVFGVAHIFASFNDTFIHVTDLSGRETLVRITGGMKVKADRDESSPYAAMLAAQDVAQRCKELGITALHIKLRATGGNKTKTPGPGAQSALRALARSGMKIGRIEDVTPVPTDSLKKRRGWKGGKKEAVGRVSLGYLPSLCTGXSG

SEQ ID NO: 25757 - DNA, 678 bp, Zea mays
  misc_feature: Ceres CLONE 1397776-F
  misc_feature: Encodes the peptide sequence at SEQ ID NO. 25758
  misc_feature (598)..(598): n is a, c, t, g, unknown, or other
aaagctggagctccccgcggtggcggccgctctagaactagtggatcccccgggctgcaggaattcgcacgagaccattacctagaacatcctaattgaaaaacaggcaccatggcgatgcgagcagctacagcggcggcgacaggcttcttctctccatccaccgtccctccgaggcgcttctcgtccgttacaccgccggcgtcactctgcaccgcgcgctgcatccagcgtcaccgtctccgcgccttcccaagcttggaaatacctctagaggaactcaacccatccgtcgatctacttaggagaactgcggaggccgttggcgatttcaggaaaacgccaatctatattgttggtacggattgcacagccaagcgcaacatcgccaagctgcttgcgaattccataatataccgctacctcagcagtgaggaactgcttgaggatgttcttggtggcaaggacgccctcagagccttcaaggaatctgatgagaagggttatctttgagtcgaggtgctttccttctttctccctcatgtttttcttactagttttcttgctctaaatggtactgcccctgcattacctagcnacaattttcattttctgtctcgctgctaagaccgaggggtaaagcagctcacgtccatgggtagccttgtactgtgcctg

SEQ ID NO: 25758 - protein, 133 aa, Zea mays
  misc_feature: Ceres CLONE 1397776-F
MAMRAATAAATGFFSPSTVPPRRFSSVTPPASLCTARCIQRHRLRAFPSLEIPLEELNPSVDLLRRTAEAVGDFRKTPIYIVGTDCTAKRNIAKLLANSIIYRYLSSEELLEDVLGGKDALRAFKESDEKGYL

SEQ ID NO: 25759 - DNA, 621 bp, Zea mays
  misc_feature: Ceres CLONE 1397780-F
  misc_feature (621)..(621): n is a, c, t, g, unknown, or other
aaagctggagctccccgcggtggcggccgctctagaactagtggatcccccgggctgcaggaattcgcacgagaccattacctagaacatcctaatcgaaaacgtatatgaatcttctcagacagaattccagggaggggatgttcagaaggtgcttatttcgttgttgaaaatattgtgccaacactatggaaagcttcgttcatcctttgggtctgacccgtcacaagagggtatagatggcccagagatggcagtgacgaaacttttctcatcttgtaagagcagtgctaatatgaaagggtatggagctgttgtccattgcatgagaaatcttccctcagaaagccagattcagactactgcccaggaggttcaaagtctcttggtttctggtagaaggaaagaggcccttcaccaggcacaagaaggtcacctttggggccctgcactgatccttgctttacaacttggtgataagttttatgcggatactgtgaagaaaatggcccactgccattttgtttctggatcacccttgaggacactgtgccttcttattgctggacaacctgcagatgttttcagttttgagaatcctgttaacagtggtttgtcttn

SEQ ID NO: 25760 - DNA, 636 bp, Zea mays
  misc_feature: Ceres CLONE 1397786-F
  misc_feature: Encodes the peptide sequence at SEQ ID NO. 25761
aagctggagctccccgcggtggcggccgctctagaactagtggatcccccgggctgcaggaattcgcacgagaccattacctagaacatcctaatcgaaaaaaaaaaaaaaaaaaatagcaaatttctcggcttccgccacacccgctccaggtcccctcccccaaactgaaacgaagttgcggcggtcgcgactgagtgcagaggctgcagttcccggcgctgatgcggcagtggccatcgccgccgctgatcccggcgtccacgctgctccccgtgccggccacctcccaggaggacgagcttctcctctccatggccgagtccgacctcgaggataagctgaacgagatccggaagaccaacagccacctggttatcatcgggaagcccacgggcgacaccaaggaggagtacgacgctgacgtggaggacgacgatgcagacaacgtcgaggagtctgacggcgacgacttcgaccaggagaccggttgacccaggtggctcccccgtgcttcgtcggcgtccttgagcgtcgtcatccccgctgtccagtctgtatttcgcaatccctgagttgctccttctatctagatacgctgttaccctattttgctgctgtctgttctcaggatct

SEQ ID NO: 25761 - protein, 89 aa, Zea mays
  misc_feature: Ceres CLONE 1397786-F
MRQWPSPPLIPASTLLPVPATSQEDELLLSMAESDLEDKLNEIRKTNSHLVIIGKPTGDTKEEYDADVEDDDADNVEESDGDDFDQETG

SEQ ID NO: 25762 - DNA, 618 bp, Zea mays
  misc_feature: Ceres CLONE 1397793-F
  misc_feature: Encodes the peptide sequence at SEQ ID NO. 25763
  misc_feature (618)..(618): n is a, c, t, g, unknown, or other
atagctggagctccccgcggtggcggccgctctattactagtggatcccccgggctgcaggaattcgcacgagaccattacctagaacatcctaatcgaaaaaaagatcttatctcgagttctccgccgccgtcgccgctatgcctccctccccatcctccggcgcgggctccgcctcgccgtccggctccgcgtccgcctcggcctctgacccaaccccgtcctggtgggagtccgtctcgcaggcgcgctcccgcatcctggagctctcctccatcctgccggccccggcctcccacgacgtcgcggcgctggccgacgccgaccgcccggcgcgcgcgcttctccgctcacccgctgcctacgcggcgctctctgacgcactgcgggcgggtggcggcgccgatgaccctgcctgccactggctctacgacacgctcctctccgccgaccccgacctccgcctcgccgcgctcgagttcctgcccctgttggcggaggtctacctccgccacctcccgaccgagctcccctcctcgctttcgggcttccaggccgtcctcctcgccgtctactcctccggaagccagaaatctcaggcgaagccggtcctcgtcn

SEQ ID NO: 25763 - protein, 159 aa, Zea mays
  misc_feature: Ceres CLONE 1397793-F
MPPSPSSGAGSASPSGSASASASDPTPSWWESVSQARSRILELSSILPAPASHDVAALADADRPARALLRSPAAYAALSDALRAGGGADDPACHWLYDTLLSADPDLRLAALEFLPLLAEVYLRHLPTELPSSLSGFQAVLLAVYSSGSQKSQAKPVLV

SEQ ID NO: 25764 - DNA, 654 bp, Zea mays
  misc_feature: Ceres CLONE 1397796-R
  misc_feature: SWISSPROT Homolog: EC 1.6.99.5 NADH dehydrogenase (quinone)
cgattgggtaccgggccccccctcgaggtcgacggtatcgatattttttttttttttttttcggtaatactaatatgaaggttaaaagtggaatgtaactggtatacataaagtttttgataagcagttcaggtgccaaacagaagtagtattccaagtttgaggcagcaactgacagacagcactacaaaactttaactgaaaagtgcccatcaaaatccgtcagatgcttgagtgcatcaaataaacatccacataaacggttcaaagaaatcaggaatgctagcatttgcttacacagaaaggagctccatcagtttgtattatttcggtagaaagaaatcagaaaactagtacatgcggctggcacatcatgcagaagccgccaacagctccctttcagctcgctcgcggatcctcctctccaactccggcctgaagtgcctgataagtccctgcacaggccacgccgcagcgtccccgagggcacagatagtatgcccttcgatttgcttcgtgacctcctgaagcatgtcgatttcctctagcttcgcgtcaccaaccttgagcctctccatgatcatccagagccagggcgtgccctctcggcagggcgtgcactgcccacagctctcgtgtttgtagaagtaggaa

SEQ ID NO: 25765 - DNA, 635 bp, Zea mays
  misc_feature: Ceres CLONE 1397796-F
  misc_feature: SWISSPROT Homolog: EC 1.6.99.5 NADH dehydrogenase (quinone)
aaagctggagctccccgcggtggcggccgctctagaactagtggatcccccgggctgcaggaattcgcacgagaccattacctagaacatcctaatcgaaaagatctccccaatccgatcagaccggtatgtaccttcgactcgagcggataaggcgaggaacacatggacgctgcgacgggcgctcctcatattgcctcacttctcccccgacaggaagggtgcaactgagtactcttattctttctcaagggcacagtctgcttgctctctcaatggcgctggtctatgtcctgctagaagattatttacgacccaggctgccactacgtcaagcacaccacagcctccacctccaccaccccctcgagagaatactcactttgggggcctcacagatgacgatcgcattatcaccaacctctatggtctgcatgacccttttctgaaaacagcgccgaagacatgtgactgctatacgaccaacgattcggcgattaagggctcagactggataattaatgaaatgaagaaatcacgtcttcggtgtcgtggaggcggaagttttccctctgggctgaaatggtcctttatgcccaagccttctgatggacgcccttcttatcttgttgcta

SEQ ID NO: 25766 - DNA, 610 bp, Zea mays
  misc_feature: Ceres CLONE 1397829-F
  misc_feature: Encodes the peptide sequence at SEQ ID NO. 25767
  misc_feature (425)..(425): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (494)..(494): n is a, c, t, g, unknown, or other
  misc_feature (499)..(499): n is a, c, t, g, unknown, or other
aaagctggagctccccgcggtggcggccgctctagaactagtggatcccccgggctgcaggaattcgcacgagaccattacctagaacatcctaatcgaaaacttcccctctctcgcccctcctccctccgtctcgtctcccaggtcatggcaaaagctggagcaccgggaaaaataacaagtgggagataaacaggaagagctaggtgaatacttggagaaaaaggtcccccacaccccccacgcaggtgaatactacaagtagcagtacaaggaagagagccaatctgcccgtgactgtcagtgagttgctcgggtgtggtggttagttgaggtcacgatgatgggaggcgggctgatgatggatcagagcgctgttccctggcgtcacaacttcgtggatctcctgcagcagaacggcgacnagaacctgggcttcgcctcactcatggcgcagacgtcctccggcgaccagtgcgtgatggnnngaaggntgatnctcgtggacccaccgccagacagcttcccggacggcgtggaggacgacagcgatgaccgacgttgaggacatcgaggagctggagcggcgcatgtggcgcgaccgcatgaa

SEQ ID NO: 25767 - protein, 74 aa, Zea mays
  misc_feature: Ceres CLONE 1397829-F
  misc_feature (29)..(29): Xaa is any aa, unknown, or other
  misc_feature (49)..(49): Xaa is any aa, unknown, or other
  misc_feature (50)..(50): Xaa is any aa, unknown, or other
  misc_feature (52)..(52): Xaa is any aa, unknown, or other
  misc_feature (53)..(53): Xaa is any aa, unknown, or other
MMGGGLMMDQSAVPWRHNFVDLLQQNGDXNLGFASLMAQTSSGDQCVMXXRXXLVDPPPDSFPDGVEDDSDDRR

SEQ ID NO: 25768 - DNA, 635 bp, Zea mays
  misc_feature: Ceres CLONE 1397833-F
  misc_feature: Encodes the peptide sequence at SEQ ID NO. 25769
  misc_feature (618)..(618): n is a, c, t, g, unknown, or other
aagctggagctccccgcggtggcggccgctctagaactagtggatcccccgggctgcaggaattcgcacgagaccattacctagaacatcctaatcaaaactgaaatcccaaaagcccaaaccaaatccaagcgcaagagggggcaaaggcgcaaagggggaggcaccaggcaccggcagccattacttactggtcctcactcccacaccaaccaaccaacctcctctgcctgccgcttctcctgctgcgggcggtcacggctgcaagtactagaggaggacatccgcttccattactgcgcctgcggaggatcggaggaaccagtagcggaggcttcgattttcggcgggcgcaataaatttcccgcatggctcggagggccgcgtcctcgctcgtctcccgctgcctcctggagagggcccctgccggcgcgccgcccgctgccccctctgcgctgcgcaggacagtgcctgcagatgagatgcacaggctgttgccaggtgtcccttcagaggttcagcactgcagcagcagtagaggagcccatcacgccgtcggtccatgtgaactacacaaagctcctcatagtggcccagcctttgttgattccgcatccnggcaagaccttcccact

SEQ ID NO: 25769 - protein, 52 aa, Zea mays
  misc_feature: Ceres CLONE 1397833-F
MRCTGCCQVSLQRFSTAAAVEEPITPSVHVNYTKLLIVAQPLLIPHPGKTFP

SEQ ID NO: 25770 - DNA, 804 bp, Zea mays
  misc_feature: Ceres CLONE 1397841-F
  misc_feature (20)..(20): n is a, c, t, g, unknown, or other
  misc_feature (76)..(76): n is a, c, t, g, unknown, or other
  misc_feature (77)..(77): n is a, c, t, g, unknown, or other
  misc_feature (79)..(79): n is a, c, t, g, unknown, or other
  misc_feature (82)..(82): n is a, c, t, g, unknown, or other
tatgtctcggggcggtggtnccaccccatataaagcacacccccggggggcaataccggaatgttaattaaccccnngnggngaaaagctggagctccccgcggtggcggccgctctagaactagtggatcccccgggctgcaggaattcgcacgagaccattacctagaacatcctaatcaaaaaagggccgcctcgagagtcgctgaagtcatggcgaccacggcgaccactgcaatcctccgcctcactccagccccttctccccgcaccgcgcgccctcctcgctctgctaccttcctccagcccgcgctctccgtttccctctcccactccctccccgactgccgcaaccaccgccttgccgctgcttccaaggacactgctagcagcaaggggcaggaacaagaccaagagcccgcaccgtcggcgccccacgaaggaggaccgggagaaggtaacggaggtgggggggaggatcgccccggggagaagaggccgggaggcccattgacggccggagcttaaagggaggtgcctgaacggcccggggaaaggaaggccgaaagcccgccgaacgtccccccggttagccagggcggggtcaggccgtgggccgcaaggaccatgaacccgagtatcgaaagtggcccgcgcggcccgggaaaaagggcgcttggggcaccccaccgcccgggtgggcggctttgggggagtcacattccggggagcctccccactctgttcgcacccttgtcttgttcccggataaatcccgccccatcccgtgccggccggggggtt

SEQ ID NO: 25771 - DNA, 654 bp, Zea mays
  misc_feature: Ceres CLONE 1397845-F
  misc_feature: Translation starting site: 170
  misc_feature: SWISSPROT Homolog: EC 3.1.3.2 Acid phosphatase
  misc_feature (403)..(403): n is a, c, t, g, unknown, or other
  misc_feature (652)..(652): n is a, c, t, g, unknown, or other
  misc_feature (654)..(654): n is a, c, t, g, unknown, or other
aaagctggagctccccgcggtggcggccgctctagaactagtggatcccccgggctgcaggaattcgcacgagaccattacctagaacatcctaatcgaaaaccatccatccatccagttagttagttagtaagttagttgagggagaagaagcaggggaggggaagcgatgagcaacatgctgcgggctcgccgccgcctggacctcctgcaggtggtgctcttcgccgctgtgctcctcgtcgtcgtcgccgacgccggcgtgacgagccagtaccggcggaagctggaggcgacggtggagatgccactggacgccgacgtcttccgcgtcccgccggggtacaatgccccgcagcaggtgcacatcacgctgggtgaccaggagggcacggggatgatncgtgtcgtgggtgacggccaatgagctgggcagcagcaccgtcatggacagcgaggcgtcgccggacccggagaagatggagctcctgggcggagggcacccacacgcgctacgactacttcaactacacctccggcttcatccaccactgcaccctcacgaacctcaggcatagcaccaagtacactacgcccccatgttgttcggacacacgggggaggagcttctgcttcacacgcaatccatgcngn

SEQ ID NO: 25772 - DNA, 488 bp, Zea mays
  misc_feature: Ceres CLONE 1397851-F
  misc_feature (266)..(266): n is a, c, t, g, unknown, or other
  misc_feature (304)..(304): n is a, c, t, g, unknown, or other
  misc_feature (345)..(345): n is a, c, t, g, unknown, or other
  misc_feature (420)..(420): n is a, c, t, g, unknown, or other
aagtggagtcccgcggggggcgctctagaatagtgatcccccgggctgcaggattcgcacgagaccattacctagaacatcctaatcgaaaaacggtccaccgacgactcttcttcctcacctcctcccgctccagctccagctcgtctctctcctcgctcggtagggttcgcttcccgtctcgccgccgcagatggggacactacgatgacgaggcgagccgatcgtgaacctcgacgaacgggaacccctccctgagcatcagncgtacgaagacctcgatgacgacctcgacggcgggggngaattggacccgggaccggttctccgacccccgttcacggngaacaacgggggggcggggtcttctccaagccggaaagcgccttctcagaaggccggcggtgaaggcatgcccgncgataacgggctggatgactttgggttggaggaaaaggaccccgacccttcggctgagggaaggaaaa

SEQ ID NO: 25773 - DNA, 885 bp, Zea mays
  misc_feature: Ceres CLONE 1397860-F
  misc_feature: Encodes the peptide sequence at SEQ ID NO. 25774
  misc_feature (20)..(20): n is a, c, t, g, unknown, or other
  misc_feature (23)..(23): n is a, c, t, g, unknown, or other
  misc_feature (34)..(34): n is a, c, t, g, unknown, or other
  misc_feature (876)..(876): n is a, c, t, g, unknown, or other
tttctggggggggggggggnccnccccatattangcgcagcgggggcggccaatttattgggaagggggggggccccctgttttaaaaaggtggggctccccgcggtggcgggcgctctagactagtggatcccccgggctgcaggaatgcgcacgagaccattacctaaaacatcctaatcgaaaaatttccgggcttctcctccgaggagttgtcccaatccgcccagacctccaacatcgcaacgggagcccaccctgcctgcctcgcggcgatccctccgcgctgctcgagggctcctgtcgggcagcaatcgagaacgccgacttccgggcacccgatcatcgaaggtcgggcgccgttccgtcggaatccggccgaaactgcggccgggaggcggagggcaccgcgacttcccctctggagcaagcccccgaaaaggaagcccgcgcctggcgcatgggcgaggccggggtctttacttttgaggggcggcccggccgagactccttcaatccgcgggcgtacatgggcgccccccccccctgggccccgggcggaggtctaacggggcggggcagtccgggcgcccgtcgaggcggaggcgtcctcggggtacgccggtccacgaaatcccgcactagccctgttatgtcgggcccacctgtgcgggcgggttaccgcctctacacccccgaggaggtgtgtgtcgccgtagccgcgcggggagcaatatcaacgcatgcgaagggcctcgggcgcgcgcgccgtgagccgccgggccgcggggggtggaggcggagcgaggagggagggtggtggggcggcaactgccctccttggctctctacctcttatgggcaacccggagacgntggacccgc

SEQ ID NO: 25774 - protein, 141 aa, Zea mays
  misc_feature: Ceres CLONE 1397860-F
  misc_feature (139)..(139): Xaa is any aa, unknown, or other
MGEAGVFTFEGRPGRDSFNPRAYMGAPPPWAPGGGLTGRGSPGARRGGGVLGVRRSTKSRTSPVMSGPPVRAGYRLYTPEEVCVAVAARGAISTHAKGLGRARREPPGRGGWRRSEEGGWWGGNCPPWLSTSYGQPGDXGP

SEQ ID NO: 25775 - DNA, 678 bp, Zea mays
  misc_feature: Ceres CLONE 1397861-F
aaagctggagctcaccgcggtggcggccgctctagaactagtggatcccccgggctgcaggaattcgcacgagaccattacctagaacatcctaatagaaaagcatcgcagccgcgcctctatataacaccacaccaagccaggggggaccagggcacatccctcactcatgagaacgattgtagtcagaggtcgtcaggtgcctcctcgaaggcctcgcaacgaaggaaaggaacaaagccagcggctcgtcatcggccccagagccccgttctcctcttcttcctcctcctccactccgagtctccgagccgcatcatcacgttgatggagctggagatgcagaaccactccttctacatatgttggtggcgtatgaatcgttgaaggcggagatcgacctcctgacggattcgccaagaaaacgcgtcaaagcggcggaaccagggggggggcgcgggctaattccgcgaaggctacggggaagtgggaccaggagcgagggcaatgcgtttcaggaaaatcccggcagcaagggcttacgggtccccaaggataaacccccccagaatgaccgcgccccccaaaaggggaggggtgtcgggaggccccaagggggggggttccacaatagggaggggggagcggaaccataggggggcaaacaaacgggggagg

SEQ ID NO: 25776 - DNA, 667 bp, Zea mays
  misc_feature: Ceres CLONE 1397862-F
  misc_feature: Encodes the peptide sequence at SEQ ID NO. 25777
  misc_feature (605)..(605): n is a, c, t, g, unknown, or other
  misc_feature (653)..(653): n is a, c, t, g, unknown, or other
aagctggagctccccgcggtggcggccgctctagaactagtggatcccccgggctgcattaattcgcacgagaccattacctagaacatcctaatcgaaaagtccctccactcctcccgtcgagcacttggcactgccaatggcggcagccgcccacaccccttcgatgcgcgcaagccgcctcctttcctcctgagatcgacgcacctcctcctctcgtactccattcccgctccaagttcgtttcttcggcaccgagccatcgcacggccgcccccgcatctcgtcctgctctcaggtccttggcctccgccgttcttcgacaggggcgcgccccggtgcccactccgcgaaatccgagtcccttgtgcagctccgtagggtggaagagatccatcaggcggtgagcggtaggaggcgcccgtacaactgaggggacgggcaatggcggccgtggcaggcccactctgcacgtggctcgtcgccgcgtgcttgtctgcggcttgcgacgcagaagagtacaagcagaagcattgctgccccggcggaagcggcgcttgggggcggcgtcatgctcggcctgcgccgccgcctcggcgcgcggncgtcgcggcttggcgcgctctggaatgggttatggctgttgccttacnaggctgaaagaagt

SEQ ID NO: 25777 - protein, 71 aa, Zea mays
  misc_feature: Ceres CLONE 1397862-F
  misc_feature (54)..(54): Xaa is any aa, unknown, or other
  misc_feature (70)..(70): Xaa is any aa, unknown, or other
MAAVAGPLCTWLVAACLSAACDAEEYKQKHCCPGGSGAWGRRHARPAPPPRRAXVAAWRALEWVMAVALXG

SEQ ID NO: 25778 - DNA, 654 bp, Zea mays
  misc_feature: Ceres CLONE 1397864-F
  misc_feature: Encodes the peptide sequence at SEQ ID NO. 25779
  misc_feature (515)..(515): n is a, c, t, g, unknown, or other
  misc_feature (581)..(581): n is a, c, t, g, unknown, or other
  misc_feature (614)..(614): n is a, c, t, g, unknown, or other
  misc_feature (615)..(615): n is a, c, t, g, unknown, or other
  misc_feature (617)..(617): n is a, c, t, g, unknown, or other
  misc_feature (620)..(620): n is a, c, t, g, unknown, or other
aaagctggagctccccgcggtggcggccgctctagaactagtggatcccccgggctgcaggaattcgcacgagaccattacctagaacatcctaaaaaaaaaaagcgaagccaaccagcacaaaaaggagcacaaagttctctctccctcccccctctctctctctcctgttccccgcgagagtcgctcaaggccgcggcgaggagaagcagcagcgcgtcacctctccaatggcatccccgtccttcctccgtgcaacctgtgcgcttctcgagtgctgaggctccctgtccctaagacaagcttgcgcgcgcgatggagggtttttcgagggacttgctgtgcgggattggcaagggggacgcgccgccaccggagaagaggccggggcagctgcgggaggagatggaggaggtggagcttagcctcgggctgtcgcttggcggccgattcgggctcgacaggaaggggagcaagctcccccggtcgtcgtccgtggcggcctgctgacaacncccggtggaaggtgccggcgccgcctccccttctcgcgggcgagctcgctgcggtccaaggcgganggcggtcggaagttgagaggaaacaggggctgnnanggngattggggtttccttgcgggagaaggcggcggct

SEQ ID NO: 25779 - protein, 64 aa, Zea mays
  misc_feature: Ceres CLONE 1397864-F
MEGFSRDLLCGIGKGDAPPPEKRPGQLREEMEEVELSLGLSLGGRFGLDRKGSKLPRSSSVAAC

SEQ ID NO: 25780 - DNA, 656 bp, Zea mays
  misc_feature: Ceres CLONE 1397865-F
  misc_feature: Encodes the peptide sequence at SEQ ID NO. 25781
  misc_feature (365)..(365): n is a, c, t, g, unknown, or other
  misc_feature (570)..(570): n is a, c, t, g, unknown, or other
  misc_feature (571)..(571): n is a, c, t, g, unknown, or other
aagctggagctccccgcggtggcggccgctctagaactagtggatcccccgggctgcaggaattcgcacgagaccattacctagaacatcctaatcgaaaagcccatccatggtgctcggcacctggtatccctgctcctcttccttggcggccgagcggggctccctctgacgactccgcgcttcctctggtgcacggccgcctctattgccgtcgcctggggcttctgctgcgttaccatgggccaaacagcgaggaaaatgccgagagagaggtagagacagtttggtcgtcgagtcacatggagggtgccctggtggccggggaatccttcacctgcggggtgctacatcgccgggctgcntgcatcgtggtctgcctctactaccagggctgactccattgccggacagccaaaactctcggtcgagtctctgaaaggccgtctgtccctgttcctttccggtgagatttctttccccgagttcaatttcttgcccactatgagtagaagctatttgcgtcatgattcatactcccagaacgttggtattatggatactgggggnnctatccgctgtccccccggtgagatccggccgccagattcaaaggcgcccgcgggctgtgctgtaccgcttgtttgtttgaggtt

SEQ ID NO: 25781 - protein, 31 aa, Zea mays
  misc_feature: Ceres CLONE 1397865-F
MEGALVAGESFTCGVLHRRAACIVVCLYYQG

SEQ ID NO: 25782 - DNA, 764 bp, Zea mays
  misc_feature: Ceres CLONE 1397868-F
  misc_feature (79)..(79): n is a, c, t, g, unknown, or other
tttttttccctctcgccctctgtgagggggagggggtctccccacatggtacaacaccaggggataaaaacccccctgnggttcggcgggcgggaggtcccgggggtgggggccgctctagaactagtggatcccccgggctgcaggaattcgcacgagaccattactagaacatcctaatcgagaaagtttattaattaacaaagagaagagttcttccttcctcgtcgtctccagcccattccaatgcttgattgcgtcggcccaccatccacaactcccctaatccttccaacctcctcgtcgggcagtccaccacctccgcgcgcaatggccagcggctaggcggcaccaaccagatgacaaggattcgtttcatcggggagcgcagctctagagcctccatgaggagctagggcggacaagtacggtatgtggttcaggcgcaaggttccgatcccccggacgcccagccggccgctagtagtctggaggcgcccacctcgtccttcgcccgctggacgcccatggccctcgggcgggcttcggtcgccgccaggcccggggggggaggcgccccggcccggaggggtcggacggggagccccgggacggtggctcgtccccggcgggcgggggtctcactggaagagcgggcggggctggcggccacagagggaggggcgcgggaggggaggtgcgaagcgggccggccgcctccaaaagagacgtgcctgttacgacctatcgcttcctttgctgcc

SEQ ID NO: 25783 - DNA, 642 bp, Zea mays
  misc_feature: Ceres CLONE 1397871-F
  misc_feature: Encodes the peptide sequence at SEQ ID NO. 25784
  misc_feature (314)..(314): n is a, c, t, g, unknown, or other
  misc_feature (642)..(642): n is a, c, t, g, unknown, or other
aaagctggagctccccgcggtggcggccgctctagaactagtggatcccccgggctgcaggaattcgcacgagaccattacctagaacatcctaatcgaaaaccatccgtccatccagttagttagttagtaagttagttgagggagaacaagcaggggaggggaagcgatgagcaacatgctgcggtgtcgccgccgcctggacctcctgcaggtggtgctcttcgccgctgtgctcctcgtcatctgctgcgacgccggcgtgacgagccagtaccggcggaagctggaggcgacggcggagatgccctggnacgccgacgtcttccgcgtcccgccggggtacaatgccccgcagcaggtgcacatcacgctgggtgaccaggagggcacggcgatgatcgtgtcgtgggtgacggccaatgagctgggcagcagcaccgtcatgtacagcgaggcgtcgccggacccggagaagatggagctccgggcggagggcacccacacgcgctacgactacttcaactacacctccggcttcatccaccactgcaccctcacaaacctcaagcatagcaccaagtactactacggccatggggttcggccacacggtggaggagcttctgcttcaccacgcan

SEQ ID NO: 25784 - protein, 157 aa, Zea mays
  misc_feature: Ceres CLONE 1397871-F
  misc_feature: SWISSPROT Homolog: EC 3.1.3.2 Acid phosphatase
  misc_feature (49)..(49): Xaa is any aa, unknown, or other
MSNMLRCRRRLDLLQVVLFAAVLLVICCDAGVTSQYRRKLEATAEMPWXADVFRVPPGYNAPQQVHITLGDQEGTAMIVSWVTANELGSSTVMYSEASPDPEKMELRAEGTHTRYDYFNYTSGFIHHCTLTNLKHSTKYYYGHGVRPHGGGASASPR

SEQ ID NO: 25785 - DNA, 660 bp, Zea mays
  misc_feature: Ceres CLONE 1397876-F
  misc_feature: Translation starting site: 349
  misc_feature: SWISSPROT Homolog: EC 1.2.1.70 Glutamyl-tRNA reductase
aagctggagctccccgcggtggcggccgctctagaactagtggatcccccgggctgcaggaattcgcacgagaccattacctagaacatcctaatcgaaaaattttgccaatgcgacggtgaaatcccgcacctacctccttcctctctcaccgaggaccctcgcaccaagaactgagcgggaagagaggtagagaggcaagcgcacgagagtttctgctcctagtctcgtctcgccccgcctccgtctcctttccctctctggttctctctctgcgattctcgtcgcattggttccgttccctcacgaaaggcggtagctttctgtcttccctgatctatctagataatggcgaccacgacgtcagcgaccaccgccgcagcagcagccgccaccaccgccaagccgcgggggtcgtcgtcggccctctgccagagggtggccggcggcggcaggcggcgctccggggtggtgcggtgcgacgccgccggcgtggaggccaggcgcaggccgtggcaaggcggccagcgtcgccgccctcgagcagttcaggatatcgccgaccggtactgaagggaaagagtaccatagctgtgataggcctcaggggacccacagcaccagtggagatgcgggaaaaacttgctggtgcagaggact

SEQ ID NO: 25786 - DNA, 682 bp, Zea mays
  misc_feature: Ceres CLONE 1397879-F
tccttctgtagctcctcttagtggcggccgctctagtctagtggatcccccgggctgcaggaatttgcacgagaccattacctagaacatcctaatcgaaaaactaaaaacatgggactccaccctgtctccgaggccaacgcttcaagccccttcggctctctctccgccgccgaattctactccctccattccgtcgcccactcctccgcctacatcaccaacccaaccggtctcaaactcttcacccaatggtggacccctctccaccgtccaccactcggcctcatcgccgtcgtccacggcttcaccggcgagtccagctggttcctccaactaacctccgtcctcttcgccaagtcagggttcctcacttgcgccatcgaccaccaaggccacggcttctccgacgggctaaccgctcacatccccaacatcaacctcatcgtcgacgactgcatctccttcttcgacgacttccgtagccgtcacgcttcctcctcctccctaccttccttcctctactccgagtccctcggcggcgcgatagctctctacatcaccctccgccagaaatcaaaatggaacggtctcatcctcagcggcgccatgtgctccatcagccacaagttcaaacccccgtgggcggtacaacacctcttaaacctcgccggtactctca

SEQ ID NO: 25787 - DNA, 736 bp, Zea mays
  misc_feature: Ceres CLONE 1397883-F
aagctggagctcaccgcggtggcggccgctctagaactagtggatcccccgggctgcaggaattcgcacgagaccattacctagaacatcctaatcgaaaaaagcaaattgcatttcaagccttttgggcattatacagtacagatgaaggcggcagcggcagcagcagagcagactaccttttcgcctctccacctcgcgcaaggaaactcacgggcacggtaccgaccccgcacccactggcctctagcttcttcctccccgctttcatggcatgaaagggtgaggcgatgagggccatacggcatccagtgtgatccatgccatactgaacctctatacatactgccccagtccggacactcgcgatctctacttctctacaggcgatgtgccctgtgctagcacctcgctcggcttctgctacagcttttgcctcactcagacggctgcaagatattgctgtgaattaggtgcttcttttgcatgcctttactgtacccccccactatagctcgctttgccacgcacacgagaagctcctgcctatacctactcggaccttatctacgccccgtagtgtgattagaagagagctgcgctgcagctgcttgccccctcgcgtatatatgctcaattggtggtgtcgagcgcgctcgagatagaaatgtcgcgatcatgcttgcacagtacacgaccgcgctcgcgacccataccattgtgcgattgcggttga

SEQ ID NO: 25788 - DNA, 609 bp, Zea mays
  misc_feature: Ceres CLONE 1397886-F
  misc_feature (216)..(216): n is a, c, t, g, unknown, or other
cgctcaagaactagtggatcccccgggctgcaggaattcgcacgagaccattacctagaacatcctaatcgaaaaaaaaataaaatccaattttctcagtctcgagcgcccgcgtccctcgccccgtcgcgactcgcgacttcgcgagtcgccccgtcccagcctcccagccgtcccggctccccgcgaccccgccctccggcagtccggcgcggnggctcctctccgatccggtgagccgaacgaggatccccactcccccgaggaaagcggccacaggcagagccagggtggttcgggttctcctctcaaagactgcgcccccacggcctaaggggtcgggtgggaaaccgttccccggcggtcgggcccccgccccccggcccctggtggcaaaaatccgccttgaaagcaaaaaaaactggccccccaggaaccccccctggccggccccctgggggggtttggggggtcttgggaacccaaaaaaaggcacttgggcccccaaaaaagaggggggggggggggggaatttccaaaaaaattttcccccggaaaaaaaattcaccggggagggggggaggggtttcctctccaagggggggaggg

SEQ ID NO: 25789 - DNA, 679 bp, Zea mays
  misc_feature: Ceres CLONE 1397887-F
  misc_feature: Encodes the peptide sequence at SEQ ID NO. 25790
  misc_feature (679)..(679): n is a, c, t, g, unknown, or other
aaagctggagctccccgcggtggcggccgctctagaactagtggatcccccgggctgcaggaattcgcacgagaccattacctagaacatcctaatcgaaaactcaaacgcaaaccccaatctcggcgtcaccgccccaaatctagcaaacggaaatcccatctcgccgccgccgcgatgtctcgccgctatgacagtcgcacgacgatcttctcgccggaggggcgtctctaccaggtggagtacgcgatggaggcgatcggcaacgccgggtcagccctcgggatcctggcggccgacggcgtagtcctggtcggcgagaagaaggtgacctccaagctcctccagacctcccgctccgccgagaagatgtacaagatcgactcccacctggcgtgcgctgtggcagggatcatgtccgacgccaacatcctcatcaacaccgcccgcctccacgcccagcgctacgcgctctccctaccagagcccatccccgtcgagcagctcgtccagtccctctgcgacaccaagcagggttacacccagtttggtgggcctcgccccctttggggtctccttcctattttcgcggtggggacagcaccacgggttccagctctacatgagcgacccatctgggcactacggcgggtggaaggccccgcgctggtggggccan

SEQ ID NO: 25790 - protein, 167 aa, Zea mays
  misc_feature: Ceres CLONE 1397887-F
  misc_feature (28)..(164): Pfam Name: Proteasome Pfam Description: Proteasome A-type and B-type
  misc_feature: SWISSPROT Homolog: EC 3.4.25.1 Proteasome endopeptidase complex
MSRRYDSRTTIFSPEGRLYQVEYAMEAIGNAGSALGILAADGVVLVGEKKVTSKLLQTSRSAEKMYKIDSHLACAVAGIMSDANILINTARLHAQRYALSLPEPIPVEQLVQSLCDTKQGYTQFGGPRPLWGLLPIFAVGTAPRVPALHERPIWALRRVEGPALVGP

SEQ ID NO: 25791 - DNA, 679 bp, Zea mays
  misc_feature: Ceres CLONE 1397894-F
  misc_feature (246)..(246): n is a, c, t, g, unknown, or other
atagctggagctccccgcggtggcggccgctctagaactagtggatcccccgggctgcaggaattcgcacgagaccattacctagaacatcctaatcgaaaactctcttcttccaccaccacctcctactccgctgcaaccccaaatctctccttcctcgcatacgcgcgcagcggaggagctgagaccaacgaagaagaagaagaacaaccgagcaagcacaagcttagctagcgtgtaggtgtncaaggccgacgacggccgccgcgcccggctagccaacaggttgctcatcgttcctagctggggagcccaaatggctgggccccacgcccacattccgcccgacccccccccctttttcttgcccccgggcccctttccccgctccccccgccctcccctcgggaatccccccacgaaccccctggcgctaagccccccaattactccgcccccatgaccccgctacgcgcccggtatatcttacccgccgtatcccgccgcgcccccaaattggagagccccgtcctacaaattcccccgccccccccgcttttcttctaaccccattatccctcccgcccccgatccgcggccccctaaaataggaatatgacacttacactcgcacccccgatcccttatactcccggctctcccccgcccctctccgccg

SEQ ID NO: 25792 - DNA, 635 bp, Zea mays
  misc_feature: Ceres CLONE 1397895-F
  misc_feature: Encodes the peptide sequence at SEQ ID NO. 25793
  misc_feature (494)..(494): n is a, c, t, g, unknown, or other
tggagctccccgcggtggcggccgctctagaactagtggatcccccgggctgcaggaattcgcacgagaccattacctagaacatcctaatcaaaaaaaacaacacacgaacaccgcaccgcaacgtagccggctaggggaagagctctttccttcagctgtgccgtgcacaacgcacggcacgctggtttggtttgcatcgcccccgccaagaaagacgctgccgtgagcgggctgagcgggcgggaagcagcagcaggcgggcgacatgccgagcggcagcgcgttctccgggtcggtgaacctcaagcacgtcaagctggggtaccagtacctggtgaaccacttcctgacgctgctgctggtgccggtgatggccgccacggcgctggagctggcgcgcctcggccccggcgagctgctctcgctgtggcgctcgctggagctggacctggtcacatcctctgctcggcgttcctggtcttcttcgtcgncaccgtgtacgtgatggcgcgccccaggcggtgaacctgttgaactaggctggtacagccccccgccagctggcgggggcccctcggcaccttcatggagaacacgggctccatcagggacaagaaaaaaaaggggggctt

SEQ ID NO: 25793 - protein, 79 aa, Zea mays
  misc_feature: Ceres CLONE 1397895-F
  misc_feature: SWISSPROT Homolog: EC 2.3.1.119 Icosanoyl-CoA synthase
  misc_feature (76)..(76): Xaa is any aa, unknown, or other
MPSGSAFSGSVNLKHVKLGYQYLVNHFLTLLLVPVMAATALELARLGPGELLSLWRSLELDLVTSSARRSWSSSSXPCT

SEQ ID NO: 25794 - DNA, 760 bp, Zea mays
  misc_feature: Ceres CLONE 1397896-F
  misc_feature: Encodes the peptide sequence at SEQ ID NO. 25795
  misc_feature (418)..(418): n is a, c, t, g, unknown, or other
  misc_feature (421)..(421): n is a, c, t, g, unknown, or other
  misc_feature (426)..(426): n is a, c, t, g, unknown, or other
  misc_feature (433)..(433): n is a, c, t, g, unknown, or other
  misc_feature (434)..(434): n is a, c, t, g, unknown, or other
  misc_feature (437)..(437): n is a, c, t, g, unknown, or other
  misc_feature (442)..(442): n is a, c, t, g, unknown, or other
  misc_feature (453)..(453): n is a, c, t, g, unknown, or other
  misc_feature (475)..(475): n is a, c, t, g, unknown, or other
  misc_feature (483)..(483): n is a, c, t, g, unknown, or other
  misc_feature (484)..(484): n is a, c, t, g, unknown, or other
  misc_feature (585)..(585): n is a, c, t, g, unknown, or other
  misc_feature (655)..(655): n is a, c, t, g, unknown, or other
  misc_feature (668)..(668): n is a, c, t, g, unknown, or other
aagctggagctccccgcggtggcggccgctctataactagtggatcccccgggctgcaggaattcgcacgagaccattacctagaacatcctaatcgaaaaatcgatcccagccccaggccatggcgacgaggtggaggaggtcgctgctctgggtcgccgtcgtccggttcctgaccctgtgcgtcctcgagtttctctttgtggaagcatacaaccagtcctacattgtgtatctgggatcacatgcatatggccgtgatgcgtcggcggaggagcatgctcgcgtaacccagtctcaccaccacctcctggcatcgatcctcggcggcgacgaccaccaccaccatgagacggggggggagtccctcttctcctcctcctgccaggggggcctccatggttttctggcgccccanganggagngggcggnnttnccgangggggggcccnattgcgtcttctctgtgtgtgnggaacgcnnggaggagccgtgtcgactcggccgccgccgcagaaacagcctggtggccggcgccagtgccgccgccccctagcacctccgggccagctccgcttctcgtnctgcgactttattccggatccgtttatccttgctcctacgctccccgcgcctcctttcgctcattgaccngtgcgcgtattcncttttctcttacggaacgttgtccgctgtttcccttccttgtttctgcgctgcctcgtcctcctccgccgctgcgcactctcgcgcggccct

SEQ ID NO: 25795 - protein, 176 aa, Zea mays
  misc_feature: Ceres CLONE 1397896-F
  misc_feature (99)..(99): Xaa is any aa, unknown, or other
  misc_feature (100)..(100): Xaa is any aa, unknown, or other
  misc_feature (102)..(102): Xaa is any aa, unknown, or other
  misc_feature (105)..(105): Xaa is any aa, unknown, or other
  misc_feature (106)..(106): Xaa is any aa, unknown, or other
  misc_feature (107)..(107): Xaa is any aa, unknown, or other
  misc_feature (111)..(111): Xaa is any aa, unknown, or other
  misc_feature (118)..(118): Xaa is any aa, unknown, or other
  misc_feature (121)..(121): Xaa is any aa, unknown, or other
  misc_feature (155)..(155): Xaa is any aa, unknown, or other
MATRWRRSLLWVAVVRFLTLCVLEFLFVEAYNQSYIVYLGSHAYGRDASAEEHARVTQSHHHLLASILGGDDHHHHETGGESLFSSSCQGGLHGFLAPXXGXGGXXXGGAXLRLLCVXGTXGGAVSTRPPPQKQPGGRRQCRRPLAPPGQLRFSXCDFIPDPFILAPTLPAPPFAH

SEQ ID NO: 25796 - DNA, 722 bp, Zea mays
  misc_feature: Ceres CLONE 1397897-F
  misc_feature: Encodes the peptide sequence at SEQ ID NO. 25797
  misc_feature (578)..(578): n is a, c, t, g, unknown, or other
aagctggagctccccgcggtggcggccgctctagaactagtggatcccccgggctgcaggaattcgcacgagaccattacctagaacatccctaatcaaaaaagcaaccacttctgctctgcatcccgtctgggcctctgcatttgcttggctgctgctcccttctcccaccgaccaactcgatcccgcgccatggatcgcgccaaccccgcgcggggccgccttgccgtgctctcctcccacctccgtggtgcacgggccgaggaggcggtggcgctggagaggtcgccggtatccgcgtcggcgcccgggtcccgcgccggcgcgcttgccgtggtgtacggcaggaccggcaagcgacacgaggcctaggtctccaaagacggcaccgtgagcgccatcgacttcaagaagatgaccactgtaaaggacgacgaggttcttaagatttatgatcctggttacgttagcactgcccctgttcgctcgttcatctgctacatcgatggagatgagggaatccttcgctatatgcgttatccagatcgagaactggctgaagcacctcggttgttgangaagactatcttataatgcatggcaacttgcctactcacagtcaattgggaggctgggaatatagttattctggcagatctgctggtcccgaaggatggtggatatctacatcagtgcccatgatgtcacccccagggttgtct

SEQ ID NO: 25797 - protein, 59 aa, Zea mays
  misc_feature: Ceres CLONE 1397897-F
  misc_feature: SWISSPROT Homolog: EC 2.3.3.1 Citrate (Si)-synthase
MDRANPARGRLAVLSSHLRGARAEEAVALERSPVSASAPGSRAGALAVVYGRTGKRHEA

SEQ ID NO: 25798 - DNA, 800 bp, Zea mays
  misc_feature: Ceres CLONE 1397898-F
  misc_feature: Translation starting site: 303
  misc_feature (14)..(14): n is a, c, t, g, unknown, or other
  misc_feature (15)..(15): n is a, c, t, g, unknown, or other
  misc_feature (45)..(45): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
gggggtgtcccccnnccccccccccccccccaccaccgccccggnccccccnnnnaacacagctggactccccgcggtggcggccgctctagaactagtggatcccccgggctgcaggaattcgcacgagaccattacctagaacatcctaatcgaaaacttccgtccttggcaaccaggcccaggcatcgtttcaccgctattcctcctgccgcatctcctcccgatccatccgagcccaaaccctagtccagccagatctccgccgccgccggcgagagcacggcatgagatccgccgcgatggcgttccgccggatcttatccacagcggtgcgccgccgctcggccatcgccgcggcagcggccgggaacgcgcgcgaggcctccacgggcgtcgccgcggcgcccggcgtgctagcccccgacgcgaccccggcgcgcgctccccgtgatgccggaaggatcgcatccgccgaagcccggtaaaccccagggctgccgggggggctggaagcacccaggaccccgccggtttccctccggctaaggccagcgcccccgttgggcgtcccccagggccgaaccaccacggggccattcctttgccgggggccgggatacccccgggttccaccaacggttgccccaaccggccctgccgccgtgggcccccgggaattcatcccctttccccgcggggaacggcctaaccggggggctggggtgggaatccgacggcgcggggaggcaacggcaccaacaacgggggatggcggcgcccccggtcgcgaactattt

SEQ ID NO: 25799 - DNA, 653 bp, Zea mays
  misc_feature: Ceres CLONE 1397900-F
ggagctccccgcggtggcggccgctctagaactagtggatcccccgggctgcaggaattcgcacgagaccattacctagaacatcctaatcaaaaaacgtctcgtcagtttttttccctttttcccgtggcccgtgggtgtgcgtcctaggtgtgcggcgggcggtgcgccgtgcgcctcctctcctcgccgcgacgctgccgtgttcgcgattcagcgccgtgctcgacgcccctcctcccttcagaagtcagcgccgcatctccggttgcagagacttgcgctgccacctctccgcttttcgtccttcagttgctcgacgcccctcctcccctcagaagtcagcgcagcgtctccactctccacgccgtcgcgtcggcgacgcgtgtccttcgaataagacggtttgttctcgcatcgggcgtcagccggattcgagggacatagatgatggaagtcgatcttgggtgccacacgtcgaaagcgcttgtgctgtgtaaatccgggcaaagcgcgcaggcaaaggccgggtctgcgtcgcctttggcctcctgatctttcgaattgccttcccgttaagggaaacgaaagggcacccaaggcttaaacttttgattgggaattttggggtttttgaaaaggcgtgggcccta

SEQ ID NO: 25800 - DNA, 677 bp, Zea mays
  misc_feature: Ceres CLONE 1397902-F
  misc_feature: Encodes the peptide sequence at SEQ ID NO. 25801
  misc_feature (522)..(522): n is a, c, t, g, unknown, or other
  misc_feature (579)..(579): n is a, c, t, g, unknown, or other
  misc_feature (677)..(677): n is a, c, t, g, unknown, or other
aagctggagctccccgcggtggcggccgctctagaactagtggatcccccgggctgcaggaattcgcacgagaccattacctagaacatcctaatcgaaaaagtctgcacaccgccactcgcccacacgcgaaggcacctagcagccgccactcgccgaactgaggaacacgccgggcgacgggatacagcagcagcgcgcccctctatccccgacgcgacggcgccctgcagctgcagataaacctgttccaatggccaaacaaaaagagggtgtggacaaaagaacttctaggaagatgatccgatctacggaaggctgtgcaaagagcattactttggagaggaacaacaaatcagacgatgtgcagcttcacgatctgccgaatgacatcctaggtagcatactatcacggttgacattcagagaatcctcacagatgggccttgtttctcatacctggcggcggctgtggagaagctgttgccggaaactggtcttcaccagtgccaccatggtccnacccggaaataggagcatcaaacataccagggacaactttgccatgagagtcaacangtttcttgcgtcagctacgcactcatcctaactcttaataaggttggtataaagttcgggctgcgcaggaagcacactcgccatgtcaacagatggan

SEQ ID NO: 25801 - protein, 118 aa, Zea mays
  misc_feature: Ceres CLONE 1397902-F
  misc_feature (38)..(85): Pfam Name: F-box Pfam Description: F-box domain
  misc_feature (90)..(90): Xaa is any aa, unknown, or other
  misc_feature (109)..(109): Xaa is any aa, unknown, or other
MAKQKEGVDKRTSRKMIRSTEGCAKSITLERNNKSDDVQLHDLPNDILGSILSRLTFRESSQMGLVSHTWRRLWRSCCRKLVFTSATMVXPGNRSIKHTRDNFAMRVNXFLASATHSS

SEQ ID NO: 25802 - DNA, 745 bp, Zea mays
  misc_feature: Ceres CLONE 1397904-F
  misc_feature: Encodes the peptide sequence at SEQ ID NO. 25803
  misc_feature (320)..(320): n is a, c, t, g, unknown, or other
  misc_feature (448)..(448): n is a, c, t, g, unknown, or other
cgctcttaactagtggatcccccgggctgcaggaattcgcacgagaccattacctagaacatcctaatcgataaatccaatacccccacgaacccactctctctccccacgatggcaaaaatggcgatggcgtcctcccgcctcccggctctcctctgcctcgccgccgtcgccgtcgccgtcgcggcggaggccgccgccgccgccggagaaggcggcctccgcctgccccgcgacgccacgttcccggcggcgcaggcggagcggttcatccgcgcgctcaacctcctgcctaaggagaagggaggcgggccggccgncggcggtggcgacgggcccagcgtgggcgcccggggagctcctaaagcgtcgcgtcgggttggccgggggcgcccgccgggggtcggggactttcggcaccacggcggggatatttccggctggccgnaaaggaaggacgccagaaggttctacttcttccttcaatccggggggaaaaaaaaagggggacaaccccctccggattttggtttaccgggagggcccggtttggaaaaagagatgggcccttcttaaaaaaaaggggcccttcccatgggaaaaaaagtgggggtgtgtgggaaaaaattgggggggacccaccccaaaaaaaatttttggggtccccccccgcaggtggttttaaaaacccctggtgggggggaacccccggggggagggggggggcaaagagagattattattt

SEQ ID NO: 25803 - protein, 154 aa, Zea mays
  misc_feature: Ceres CLONE 1397904-F
  misc_feature: SWISSPROT Homolog: EC 3.4.16.5 Carboxypeptidase C
  misc_feature (70)..(70): Xaa is any aa, unknown, or other
  misc_feature (113)..(113): Xaa is any aa, unknown, or other
MAKMAMASSRLPALLCLAAVAVAVAAEAAAAAGEGGLRLPRDATFPAAQAERFIRALNLLPKEKGGGPAXGGGDGPSVGARGAPKASRRVGRGRPPGVGDFRHHGGDISGWPXRKDARRFYFFLQSGGKKKGGQPPPDFGLPGGPGLEKEMGPS

SEQ ID NO: 25804 - DNA, 674 bp, Zea mays
  misc_feature: Ceres CLONE 1397908-F
  misc_feature: Encodes the peptide sequence at SEQ ID NO. 25805
  misc_feature (607)..(607): n is a, c, t, g, unknown, or other
  misc_feature (674)..(674): n is a, c, t, g, unknown, or other
aaagctggagctccccgcggtggcggccgctctagaactagtggatcccccgggctgcaggaattcgcacgagaccattacctagaacatcctaatcgaaaaaccaccgcatcccacaacccccgagctcagcttagctccactccagctccaatcgcagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtctgtgggcgcgaacatctccggcgggcacgtgaaccctgccgtgaccttcggcgccttcgtgggcggcaacatcaccctggtcccggggctcctgtactgggtggcgcagctgctggggtccacgtggcgtgcttcctgctccgcttctcgacgggcgggcagccacgggcaccttcggctgacggncgtgtcggtgtggaagcgctggtgctggaaacgtgatgaccttcgggctgtgtacacgtgtacgcan

SEQ ID NO: 25805 - protein, 157 aa, Zea mays
  misc_feature: Ceres CLONE 1397908-F
  misc_feature (13)..(154): Pfam Name: MIP Pfam Description: Major intrinsic protein
  misc_feature (136)..(136): Xaa is any aa, unknown, or other
MPINRIALGSHQEVYHPGALKAAFAEFISTLIFVFAGQGSGMAFSKLTGGGPTTPAGLIAAAVAHAFALFVAVSVGANISGGHVNPAVTFGAFVGGNITLVPGLLYWVAQLLGSTWRASCSASRRAGSHGHLRLTXVSVWKRWCWKRDDLRAVYTCT

SEQ ID NO: 25806 - DNA, 651 bp, Zea mays
  misc_feature: Ceres CLONE 1397909-F
  misc_feature (349)..(349): n is a, c, t, g, unknown, or other
  misc_feature (358)..(358): n is a, c, t, g, unknown, or other
  misc_feature (365)..(365): n is a, c, t, g, unknown, or other
  misc_feature (376)..(376): n is a, c, t, g, unknown, or other
  misc_feature (391)..(391): n is a, c, t, g, unknown, or other
  misc_feature (454)..(454): n is a, c, t, g, unknown, or other
aagctggagctccccgcggtggcggccgctctagaactagtggatcccccgggctgcaggaattcgcacgagaccattacctagaacatcctaatccaaaaacaccaacccgttctgcctccgcttcgatcatggggtggtcgcgctttcgtcgccgccatcaacggtgtcgctatctcctccctatccggcgtccgcgatgctcgccacccctcctcccccacgcgtcggacgctcgccatgctcgcctccctcccctccggtccgcctcgctccccttccgccccttcgtcgcgtgcgcttggaaaaaggtcagcagccccaaactcccagcggggccatctcgccnacctctccntgcacgncggatccccgncgtccccaccatcgnctggtgtgggtccgaccccagtcgctcatgcctcgacgcgcagttctcggacaccgtcggggngggggtcggcctggggcgggttcgaaaaccgttccggaggggaatcaaataaggctccctaccttccggtggctccttcaatcccctttccaatggaatccgggattcccggtccccaggggaaaacggggagctcgcccccgcccccgggggccctcccccccgtggggaatcccccgggccccggtggaaagggg

SEQ ID NO: 25807 - DNA, 813 bp, Zea mays
  misc_feature: Ceres CLONE 1397910-F
  misc_feature (16)..(16): n is a, c, t, g, unknown, or other
  misc_feature (50)..(50): n is a, c, t, g, unknown, or other
  misc_feature (51)..(51): n is a, c, t, g, unknown, or other
  misc_feature (813)..(813): n is a, c, t, g, unknown, or other
ggggggtttgtttttntttttttgttggcgttgtttccttttgcggggcnngagggcgaaaaaatggaactccccgcggaggcggccgcctctttaactagtggatcccccgggctgcaggaattcgcacgagaccattacctagaacatcctaatcaaaaaaccatcaccgcctcgtgtgcagcgtgctcgcccacctcctctgtcgacactcagggtactgacgcaccaccccgaagccctcccgccgcgctcgcagggtgttcgatccttcgcccgcgcgtcctcacgacatgcctcctccgtctccgccgccgccaaggacgcacgaggcgttcgcgcacaaggaccaaaaggaactggccgcgacaccgcatcgccgctcagccattgacccgccgataccaaacccgtgcagagtgcgtcgtcgtctcttcacccgcaccacgcccctgctactccacccgcctccggtgcaacaacctctatgactgatgatccaccagacacagactggccccccggccaactgaaatggaataagtttctttgtagagcccggggcatacactcccgttgacccaaatacgtaccaacctagcccccatgcccgcccacaaagcacagccaccacacccgacacccccttcggcgccgtacgtccacgtaaaaccacaaccacaacaaaaaacaacaaaaaaaaaccccccccccccccccgcaccccccccgcccccctcccccaaaaccctctagtattaaaaaaaaaaagagaacctcacggcttcttcatcgactctcgtctccacacan

SEQ ID NO: 25808 - DNA, 679 bp, Zea mays
  misc_feature: Ceres CLONE 1397911-F
  misc_feature: Encodes the peptide sequence at SEQ ID NO. 25809
  misc_feature (521)..(521): n is a, c, t, g, unknown, or other
aaagctggagctccccgcggtggcggccgctctagaactagtggatcccccgggctgcaggaattcgcacgagaccattacctagaacatcctaatcgaaaagcctctgtatccgagcatactagcggatcctggcccgatccctcttcccacctacctccgcttctctccaagtgaggaaccccaagccctcgccatggcgtcgcggatcctggcccgatccaagtcccttcacctcgtcgccgccctcacccctgccgctgccaaagcagcaacgcctatcgccggagcccgcgcgctctcgtccctgccccgctacccgtctgccccgtcgccccatgggctcggcaaggttctgggatatgaaccaacatctcacctcagtggaccacaagttttacctcgttggttttcctctctagcatccaatggatctcaggtgcagaagtcacagatctctgagacatacaagtcaggtggtgaaatgaaacagtctgagacacggaaatcaagtgaggaangcacacccaaaagtgtggcgttcagtccgctagaagcagctatcgctaaacctagaagtagtcccctgacaagtgagagttctaaagtaaggcgatcagagatagcaccccaagtcaccttttacatgatcccagccctgcttcttttgctcaagaaa

SEQ ID NO: 25809 - protein, 161 aa, Zea mays
  misc_feature: Ceres CLONE 1397911-F
  misc_feature (109)..(109): Xaa is any aa, unknown, or other
MASRILARSKSLHLVAALTPAAAKAATPIAGARALSSLPRYPSAPSPHGLGKVLGYEPTSHLSGPQVLPRWFSSLASNGSQVQKSQISETYKSGGEMKQSETRKSSEEXTPKSVAFSPLEAAIAKPRSSPLTSESSKVRRSEIAPQVTFYMIPALLLLLKK

SEQ ID NO: 25810 - DNA, 790 bp, Zea mays
  misc_feature: Ceres CLONE 1397913-F
  misc_feature: Translation starting site: 189
  misc_feature (347)..(347): n is a, c, t, g, unknown, or other
  misc_feature (411)..(411): n is a, c, t, g, unknown, or other
aagctggagctccccgcggtggcggccgctctagaactagtggatcccccgggctgcaggaattcgcacgagaccattacctagaacatcctaatcgaaaaaaaccgatcgagcctcgacgagccagcagagaggactcatcctagctagctaagctgtccgacacagcacagcagaccgatacgacgatgatgagtagcaccggcggcgagagcaagctggagagcccgctgctgggcctgcccgcgccgggctcgtcggccggcagcgggcacagccacggcgaggcggtgagcgggcagctggagagcatcctcagcgacgcctccctggcgtggaggcagcgnatgctgtcagcgtccatggttgaaatgcggctgctcgtgcgcctgggcgcgcccgcgggctcgnctacatgatcaactacctcatgtccatggtcaccgaaaatctctcgggaaaccctcgcacgttcgagatcgcccggcgggcgcttgggaacaccgggaatcaagggctttcccaattgccccttgttggaaatgggaaagccgggggaaaactttggggggaaaggggtaagggcccacaaaaaaacaaagtggggggattcattgggaggggtcccaccctctcggtgggggcccccggggggggcctttgaaagggtttataacccttcccccccccccctgggggcccccgggggagagacccccaaagaacctcccccgcccgcccttttttggggggcgccctcctccacaaatttttgtgggggcccgcctcc

SEQ ID NO: 25811 - DNA, 738 bp, Zea mays
  misc_feature: Ceres CLONE 1397914-F
  misc_feature: Encodes the peptide sequence at SEQ ID NO. 25812
  misc_feature (513)..(513): n is a, c, t, g, unknown, or other
  misc_feature (524)..(524): n is a, c, t, g, unknown, or other
  misc_feature (600)..(600): n is a, c, t, g, unknown, or other
  misc_feature (648)..(648): n is a, c, t, g, unknown, or other
  misc_feature (702)..(702): n is a, c, t, g, unknown, or other
  misc_feature (720)..(720): n is a, c, t, g, unknown, or other
ggagctccccgcggtggcggccgctctagaactagtggatcccccgggctgcaggaattcgcacgagaccattacctagaacatcctaatcgaaaagacccccaaactccggacgagccttccgcgcgacgctgcacggctccgccagccacccgtaaaaccctagacggctagccggcgcacggaagcgggcagcggagcggaggtgagcctctcctgcgtcggattgtccccgcccccgctaggcgccatgaagctgacggtgaagaccctcaagggaacgcacttcgagatccgggtgcagcccaacgacacgattatggctgtgaagaagaatattgaagagatacaagggaaagacagctatccatggggccaacaactgctgattttcaatggaaaggtcttgaaagatgaaagtacattggaagagaataaagtcaatgaggatgggtttctagttgtcatgcttagtaagggtaaaacatctggttcaactgggacttcatcttnccagcactcanacactcctggcacaaggcaggcacctcctctagaggcccacaacaagctcctcaacccccggtggcaccaattacnacttctcagcctggaggacttcctgcacagggacctaacacacatgancatgcggcatcaaatcttctgtctgggagggatggtgacacaataattaccagnctatgggaaagggggggnggcaggtgggacaaggat

SEQ ID NO: 25812 - protein, 147 aa, Zea mays
  misc_feature: Ceres CLONE 1397914-F
  misc_feature (6)..(78): Pfam Name: ubiquitin Pfam Description: Ubiquitin family
  misc_feature (88)..(88): Xaa is any aa, unknown, or other
  misc_feature (92)..(92): Xaa is any aa, unknown, or other
  misc_feature (117)..(117): Xaa is any aa, unknown, or other
  misc_feature (133)..(133): Xaa is any aa, unknown, or other
MKLTVKTLKGTHFEIRVQPNDTIMAVKKNIEEIQGKDSYPWGQQLLIFNGKVLKDESTLEENKVNEDGFLVVMLSKGKTSGSTGTSSXQHSXTPGTRQAPPLEAHNKLLNPRWHQLXLLSLEDFLHRDLTHMXMRHQIFCLGGMVTQ

SEQ ID NO: 25813 - DNA, 695 bp, Zea mays
  misc_feature: Ceres CLONE 1397920-F
  misc_feature (342)..(342): n is a, c, t, g, unknown, or other
  misc_feature (344)..(344): n is a, c, t, g, unknown, or other
aaagctggagctccccgcggtggcggccgctctagaactagtggatcccccgggctgcaggaattcgcacgagaccattacctagaacatcctaatcgaaaaagcctccgccatttcttcatctccaatctccatccttccatcttccgctccctcccctgcttgcgctcgtcgcgcaggcgacctcggcggcgctcgggctcggcctctcagcgacggcgtcagcggcttcccctcctgcctctcgccagtcccctcggctctgttcctctgcgcaccggccggtgaccctgcgtgcgtgcctctttctctctctctctctctctctctctctctctcccncnctctcccctctctctctccctcccggccttctggaaatcggcaaacggggccccggcccgggaggcaaccccccggcgcggcccggagggcaaaggggagccaaaagggcgcgcggcccccaccaagggggggcgcggcccgtttttcggaaacccttaggcgtggtaacgcccccaatgggaaaaggggttacccccttcttcttatccggttttccggtaagagccccttttttttgaacccccgggataacggggaaaaaatctaggctacatcgtactccaggacctctccctccgctccgaaaaaaaaaaaaaatttctggactttcccgaaggataaaagaaatt

SEQ ID NO: 25814 - DNA, 742 bp, Zea mays
  misc_feature: Ceres CLONE 1397923-F
  misc_feature: Encodes the peptide sequence at SEQ ID NO. 25815
  misc_feature (419)..(419): n is a, c, t, g, unknown, or other
  misc_feature (605)..(605): n is a, c, t, g, unknown, or other
caaagctggagctccccgcggtggcggccgctctagaactagtggatcccccgggctgcaggaattcgcacgagaccattaacctagaacatcctaatcgaaaagagccacagagaaatgggggccctggtcgtccctggcgccggcacgtcttcctcgtcgtgtcgctgcagcttctccttgtggcgccatggcaggacgagacggccgctcgagctctcaatttcaccaggcaggatttccccagggccttcgtctttggtgccggcacgtcagcttaccagtacgaaggggcaaccgatgaagacggaaggagcccaagcatatgggacaactttactcatgcaggtaggatgccggacaagagcactggcgacctagggggcggacggctaccacaaatactagggagacgtgcnagctgatgagtgacactgggcctggaggcctaccgcttgctccatttcttggtccaggcttattccaagcaggaagaggagccatcaaccccgaggggcctcgagtattacaacaacctcatcaatgagctagtagaacgaggaattgagatacacgtgaccctgtcccacctggattaccctcanatccctggaggacgagtaccacggctggctggcccccaggatggtggacgacttctaggggtaaggcggacgtgtggcttcccgcgagttcggccgaaccgggtgaggcactggaccaccatgaaccaagtccgacg

SEQ ID NO: 25815 - protein, 140 aa, Zea mays
  misc_feature: Ceres CLONE 1397923-F
  misc_feature: SWISSPROT Homolog: EC 3.2.1.21 Beta-glucosidase
KLELPAVAAALELVDPPGCRNSHETINLEHPNRKEPQRNGGPGRPWRRHVFLVVSLQLLLVAPWQDETAARALNFTRQDFPRAFVFGAGTSAYQYEGATDEDGRSPSIWDNFTHAGRMPDKSTGDLGGGRLPQILGRRAS

SEQ ID NO: 25816 - DNA, 679 bp, Zea mays
  misc_feature: Ceres CLONE 1397927-F
cgctcaagaactagtggatcccccgggctgcaggaattcgcacgagaccattacctagaacatcctaatcgaaaaatcacccgcagcaccgcatcactccgcctcgtcccccacttctcgcacttccgcttcagcttccaccgtgcccaagagtcacgaggcggcggcgggtcacgccgacgtactctcaggtgctgcggtgggactgcccctgctgctgccgcgggggcggcggaggggaggatggccgcgacgacggcgccggacatggtgtgggtgagggtgcttgaggatgccgtgttccggttcgacgcgtcggaaggcggcgcgcgccgccaatgggcccagtctctcgttcgcggacccgcgatcggcggtaggcggccgcatgacggctgctgacatgccacgccgtgtctcgtgtatgctaggtgcgcgtagggcgggatacccagaagtacgggataaaggttccttctggcacatcttgctatggaactggaaactcgagtgcccccttggagggactagctaacgagtttctgatggatacgtatgcatgcggattggggcagcaccactacgtcgaccagtacgccatgtggggatgggtgccccactgatgctcagctgggtctgcctcgctatccactacgggatggccgatgatttggacagt

SEQ ID NO: 25817 - DNA, 698 bp, Zea mays
  misc_feature: Ceres CLONE 1397927-R
cgattgggtaccgggccccccctcgaggtcgacggtatcgataagcttatttctgctcttcggggaggtgtttaggttgtttgctgcacctcatactggtgggaaaccctccacggcgtctcattggacaccggtactttcctctgaccatagctcgctgttcgcttcaccagttccccagtgcacaaagcatttgctgacctccctggcattaccaccggattcaccaagctcagcccgactcacttgtccactaccatccgttctccgttggctttgaggactccctcgaatgttatctctccttgtcctctcgggcagatctcttgcctctgaaccattgatggccgtagaacgcggctactacctcacttgggtgcccctgggtgaatgcatgatgaactcggatactgaccaaccttgaggacccaccccaaccagctcctacacttcttgcctgattgctggagaccatctgatccaactttgggttgtccttcggaatggatatctggcgctggagaaccagaccaccacctatgtctccttccgtacgaatagattcctcctctccagatagttcaaggtgcctcctgatgactgtgtactcttctgtgcaaccggcatacctatattcagccccactgtattcttcatacacgtttatctcacttctgctgctgagacactgaggatca

SEQ ID NO: 25818 - DNA, 714 bp, Zea mays
  misc_feature: Ceres CLONE 1397929-F
  misc_feature: Encodes the peptide sequence at SEQ ID NO. 25819
tggagctccccgcggtggcggccgctctagaactagtggatcccccgggctgcaggaattcgcacgagaccattacctagaacatcctaatcgaaaaacccccgcgagacctgttcgaatcgcgtccaggtccctcgatgggaggttcggcgaggagcgtcccggctccagcgtacattgatgagggtactgcttctcgaccttaccgacgcgcccctccggccgccgacgacccgaactgcgccgtggtggccgcgcactccccggccacctacgacgagcagtggggcgtgccccacagcagcagtaagctgatggtgaacgactgctcggtgctctgccgcgcgccctgccttttcctcgccgcggtttgcgaggacctgtcctcccttctccccgggccttctccccctagcttgccggccaagacctttccggtacccttctgtcctccctgcgccagcccgtcgtatggacatggttatttcgcccgttcgacccgcggattttgccctcctcccccgcatattttaatgctctgtatgccccccgcccgctcactgtcatgctcccctgttaatccccgctcaacatgctctcggtccttacggatgccggcccggccgccggcgcggcggtgcgttattattattgattattcggccccgccccccgatcccgtcatcgccggtatcgtctcccccccctccgcca

SEQ ID NO: 25819 - protein, 192 aa, Zea mays
  misc_feature: Ceres CLONE 1397929-F
MGGSARSVPAPAYIDEGTASRPYRRAPPAADDPNCAVVAAHSPATYDEQWGVPHSSSKLMVNDCSVLCRAPCLFLAAVCEDLSSLLPGPSPPSLPAKTFPVPFCPPCASPSYGHGYFARSTRGFCPPPPHILMLCMPPARSLSCSPVNPRSTCSRSLRMPARPPARRCVIIIDYSAPPPDPVIAGIVSPPSA

SEQ ID NO: 25820 - DNA, 764 bp, Zea mays
  misc_feature: Ceres CLONE 1397930-F
  misc_feature: Encodes the peptide sequence at SEQ ID NO. 25821
  misc_feature (54)..(54): n is a, c, t, g, unknown, or other
  misc_feature (55)..(55): n is a, c, t, g, unknown, or other
aaaaaaaaagggtttgggggggggagggcctatgtggaaagaaaacaagcagcnnttcaaagctggggctccccgcggtggcggccgctctagaactagtggatcccccgggctgcaggaattcgcacgagaccattacctagaacatcctaatcgaaaagcaacgagatccctcgcgcgcgcggaccccggagaggccgagggagggtgacagggcgcggcagctcgaggggaatgggatcggagggacgggcctggaacggcgcgggcatggccgccggcagcggctatggcagcggtggagaggccaaagcgaccaccacggctgtgtcggccgcggcccccgcggaggttcccacgtcggaggcctccgtcgacatctcgctgccgctcctgaagatgtcgcctcccatcatagctctctgcaaggaattggtcgaagggtggtcgtcgattgacagctcgctcttccccatcgagaccgtgtccgggggcatcacgaatctattgctgaagggttctgtcaaagaagacaacggcaatgagccttctgttactgctcggctgtatggacccaatacggaacttggtggatgataggcaaaagggaattgcagggggataccataatctctcagcctgcggggggtccgggggttccggcctaccttggaaataattcgaaaaaaggggagcaacctcagaccatttccttctaatggctgcggaaacacctgccacaccccggaagaacaatggaaaag

SEQ ID NO: 25821 - protein, 120 aa, Zea mays
  misc_feature: Ceres CLONE 1397930-F
MGSEGRAWNGAGMAAGSGYGSGGEAKATTTAVSAAAPAEVPTSEASVDISLPLLKMSPPIIALCKELVEGWSSIDSSLFPIETVSGGITNLLLKGSVKEDNGNEPSVTARLYGPNTELGG

SEQ ID NO: 25822 - DNA, 755 bp, Zea mays
  misc_feature: Ceres CLONE 1397933-F
  misc_feature: SWISSPROT Homolog: EC 1.14.14.1 Unspecific monooxygenase
  misc_feature (1)..(1): n is a, c, t, g, unknown, or other
  misc_feature (18)..(18): n is a, c, t, g, unknown, or other
  misc_feature (19)..(19): n is a, c, t, g, unknown, or other
  misc_feature (21)..(21): n is a, c, t, g, unknown, or other
  misc_feature (22)..(22): n is a, c, t, g, unknown, or other
nggggggggggggataanntnntgggaggggtaaatgtgtattacaaaaaccaaaactgggactccccgcggtggcggccgctctagaactagtggatcccccgggctgcaggaattcgcacgagaccattacctagaacatcctaatcgaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggtggtgtcgacggactcccgacggggcctccgggttggccggtggtggggaacctgttccaggtgatcctgcagcgacggcccttcatgtacgtggcgcgcgaccctccgggagaagtacgggcccatcttcaccatgcggatggggcagcgcaccctcatcgaggtcacctcggcggagctcatccacgaggcgctggtgaaacaggcccccatgtttcgcgagcccggaccgaggaaagcccccaacccggctcctctttcagcggtcgggcaaggggcaccggtcaacctcggggggccctaacgggcccccctggggggcgggggctcctggggccggcaaaccttccattcgcgccgaagaaatccgaggtccccccaccaaccggcggt

SEQ ID NO: 25823 - DNA, 695 bp, Zea mays
  misc_feature: Ceres CLONE 1397938-F
  misc_feature: Encodes the peptide sequence at SEQ ID NO. 25824
  misc_feature (527)..(527): n is a, c, t, g, unknown, or other
aaagctggagctccccgcggtggcggccgctctagaactagtggatcccccgggctgcaggaattcgcacgagaccattacctagaacatcctaatcgaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtgccgcaaggtgtggggggaggccacctacgaactcgccaccgtgctcgccttcctcgccgncctcgcctttcccctcctcgtctacattctgtccaggccagggcccgggaccccccccaactttcgcaggcctacaggccggtcgaccagcttcaaggggcccaagggggaagttcattcgaccgggcggggaaagtcccggaaggtttgaccgaggaaagccctggg

SEQ ID NO: 25824 - protein, 156 aa, Zea mays
  misc_feature: Ceres CLONE 1397938-F
  misc_feature: SWISSPROT Homolog: EC 2.3.1.119 Icosanoyl-CoA synthase
  misc_feature (107)..(107): Xaa is any aa, unknown, or other
MAREEQALLSTEIVNRGVEPSGPDAGSPAFSVRVRRRLPDFLQSVNLKYVRLGYHYLISHGVYLATIPVIVLVCGAELGSLSRDELCRKVWGEATYELATVLAFLAXLAFPLLVYILSRPGPGTPPNFRRPTGRSTSFKGPKGEVHSTGRGKSRKV

SEQ ID NO: 25825 - DNA, 749 bp, Zea mays
  misc_feature: Ceres CLONE 1397939-F
  misc_feature: Encodes the peptide sequence at SEQ ID NO. 25826
aaagctggagctccccgcggtggcggccgctctagaactagtggatcccccgggctgcaggaattcgcacgagaccattacctagaacatcctaatcgaaaactctaccccttcctctcccggcgaccagctggcctctcctttgttgaggcgagagacccccacccgatccggcgatggacgccgcgtccaggccgcctccgccccacggaacaggggtccgcgtccgcgccccgctggtggagtctgtctcctgctactgcagattagatacaggccttaaaactgttgttgaggccaggaagtttgttcctggcgcgaaaatgtgcatgcaacctgaagtcaaacaaaacaagcgcaagtcaaggggctcaaaaaaggaaaggtgcaggactcaagcaccacttttacctggccttcctgatgatcttgctattgcctgccttatacgagttcctcgacttgaacagcccaaactcaggatggtttgcaaaagatggaaccgtcttttgtctgggaattacttttactccttgcgtaagaaaattggagtggcaaaagaatgggtatatgtctttaaaagggaccgtgaagggaagatatcctggtatgcctttgatccactccccagctatgggaagcactcccaccagttccacaagaggattcagaagatttgggcttggggtggggcgtcctgagtggtggtatccggacttggttggcgggaaaaaccctttggaggggtc

SEQ ID NO: 25826 - protein, 174 aa, Zea mays
  misc_feature: Ceres CLONE 1397939-F
  misc_feature (76)..(123): Pfam Name: F-box Pfam Description: F-box domain
MDAASRPPPPHGTGVRVRAPLVESVSCYCRLDTGLKTVVEARKFVPGAKMCMQPEVKQNKRKSRGSKKERCRTQAPLLPGLPDDLAIACLIRVPRLEQPKLRMVCKRWNRLLSGNYFYSLRKKIGVAKEWVYVFKRDREGKISWYAFDPLPSYGKHSHQFHKRIQKIWAWGGAS

SEQ ID NO: 25827 - DNA, 711 bp, Zea mays
  misc_feature: Ceres CLONE 1397943-F
  misc_feature: Encodes the peptide sequence at SEQ ID NO. 25828
cgctctagaactagtggatcccccgggctgcaggaattcgcacgagaccattacctagaacatcctaatcgaaaaatctccccttccttcctttcctactcccagcactcccccaccctccactaggactagtactagtgccacaatcaccccagcgggaaaaaacccaacaaggtgtaaggactacgccgacgccagcgccgccgagaaaatagaggccggatctacggtgctgggacacggaagtccccggatcgacgacgcctccgccgaggatatgcatggatatgcgaaaagaaaaccctgtgcttattgcttgtcgagcattccatgagctgatcacgcgagctcatgctgctgaacatcgtcgaagctttggagctattccttctgttccattgcctgtacaaaccgaactacaacatactgcacatgggagggcaacacgatgatcttcatatgacaacaccactgtgagcgctgcactgtcatgcctcctgcctaacatgtgcacagtactgaggcatgtgtacaagttgagcatgatgactcgtacatcagtgttgctgctggactgaagcttcagaccatctcatctctatggtgtggatcacctggcagcaaaagcatgcgggcgcaataagattcctaacatgcccatcagctggaatggagggctttgctaaagttttgacatcctgacgaaaacaa

SEQ ID NO: 25828 - protein, 56 aa, Zea mays
  misc_feature: Ceres CLONE 1397943-F
MDMRKENPVLIACRAFHELITRAHAAEHRRSFGAIPSVPLPVQTELQHTAHGRATR

SEQ ID NO: 25829 - DNA, 996 bp, Zea mays
  misc_feature: Ceres CLONE 1397943-R
ttcgattgggtaccgggccccccctcgagtcgacggtatcgataagcttttttttttttttttttgttttttttttttttttttttttttttttttccacccaaaaaaaactttccggatccggtaaaaccgggcccttgtttccttaacaaacccccattcagccttccctcccaaagtaaccccgggcaataaactatttcccttcccaaacctcccatggaacaatttgtgtcaacacaaacttctccccgccttttgtcgtcttaaaagccacccggaccttccccccttacggttaacaccgccccaggcaaaaacccctccccccagggttgtttccaaccgggggaaccttttcctccaaacaaacaaaagaaagcccaaggagccttccctctgtccttcttcatccccatttgcaacccaaaaaagcccaggcccgggaacacaccagcccctattaccacccccccggcccaattcgaacattggggggggttaaaaagggggatggcttcccattaatgtttaaacgccacaccgggcgccttcggggttggcgggcgtaaagggttggccccctacaaaaccgggggcccccttttgggcggtgttcccccctgtgaaaaaaaccacccccgggggggaaaaccccccggggagaaaaattaaggggttcgccctcaccccctatttaaaaaaacttttgttaggtggcgcgtggtaccctttcctccccgggaaatggcgcgtttataaaatggggggaggtttccccgggtggggttttatgccgcgggagatttcccccgtgtggagcgccccccaccccccccctttgtgttgttgttttcaaaaaaacttatttgtaaaaaaaaggggtgtgtggggcgcccccacaaaagcccgtgggctccccacggagaaggagccgcggtatttgtttccaaacacgccccccttcttgtgggagaaatacacacccgccaccaa

SEQ ID NO: 25830 - DNA, 797 bp, Zea mays
  misc_feature: Ceres CLONE 1397944-F
caagctggagctcaccgcggtggcggccgctctttcactagtggatcccccgggctgcaggaattcccacgagaccattacctagaacatcctaatcgaaaaagcctgcctcggtgcgccttcgccacacctccaccatggttgcgaccacgccggtcaccgactcgacggatgccttttttgcactaatcgttgtcgcttccactattgctcgacacaccccggtcaaccgtttcttctccggatccgcacccccaaacgcagtttgtccctagggacgtcggattctctcctcctaccaattccttagctgaggcctctgttttaaaacgctgttccacctaaggcaagaaattccacctttgttttttatttcggtctccgcccttagtcacatcctccttcccccaccatagacccccctccctatattcttacaaactttgcccccccttcccctagtctggtttacttgacctacgtcctagcgggctgggtctgagaaattccacgtctgagataccacagaaaaagttacctctacaacgatcccctaaacaaacccacaataaaaaatcatccgaatgcaccggcgcccgtgacaaacccgaatgagcccgccccacctatgaatcaggaatctatatggaaggcggtatattaacatcaaagtcgcctaacccactttcccgagagattatgtcccataaatgcgatatctatatgtacgccccatcccacctcctcaatccctaccaacgccatctaatatctcccctccccaccttctccaaccc

SEQ ID NO: 25831 - DNA, 660 bp, Zea mays
  misc_feature: Ceres CLONE 1397945-F
  misc_feature: Encodes the peptide sequence at SEQ ID NO. 25832
aaagctggagctccccgcggtggcggccgctctagaactagtggatcccccgggctgcaggaattcgcacgagaccattacctagaacatcctaatcgaaaaaactcgccgtctgccttctgcgcctccatttcggcctctgtcccttgcaagttcaatctcacctccaaccatgggtaaagagaagtcccacatcaacattgtggttattggccatgtcgactctggcaagtcgaccaccacaggacaccttatctacaagcttggaggcattgacaagcgtgtgatcgagaggttcgagaaggaggctgctgaaatgaacaagcggtccttcaagtacgcgtgggtgctcgacaagctcaaggctccccgtgagagaggtatcaccattgatatcgctctgtgggagtttgagaccaccaagtactactgcacggtcattgatgccccctgggacaccgtgacttcatcaagaacatgatcactggtacctcccaggctgactgtgctggccttatcattgactccaccactggtgggttttgaggctggtattctccaaggatggcccagaccccgggaacatgcttctcctttgcggtcaccccttggaggggaacaaaatgattttgttgctgccaacaaaatgggatgcaaccc

SEQ ID NO: 25832 - protein, 102 aa, Zea mays
  misc_feature: Ceres CLONE 1397945-F
  misc_feature (5)..(103): Pfam Name: GTP_EFTU Pfam Description: Elongation factor Tu GTP binding domain
  misc_feature: SWISSPROT Homolog: EC 2.7.7.4 Sulfate adenylyltransferase
MGKEKSHINIVVIGHVDSGKSTTTGHLIYKLGGIDKRVIERFEKEAAEMNKRSFKYAWVLDKLKAPRERGITIDIALWEFETTKYYCTVIDAPWDTVTSSRT

SEQ ID NO: 25833 - DNA, 628 bp, Zea mays
  misc_feature: Ceres CLONE 1397947-F
  misc_feature: Encodes the peptide sequence at SEQ ID NO. 25834
  misc_feature (156)..(156): n is a, c, t, g, unknown, or other
  misc_feature (157)..(157): n is a, c, t, g, unknown, or other
  misc_feature (367)..(367): n is a, c, t, g, unknown, or other
  misc_feature (368)..(368): n is a, c, t, g, unknown, or other
  misc_feature (460)..(460): n is a, c, t, g, unknown, or other
cgctctagaactagtggatcccccgggctgcaggaattcgcacgagaccattacctagaacatcctaatcaaaaaaaaagcgcagacaagagagagaaatcggaatccaagcgcaaccaaaagagaagagggcagacacgagggagcgcgtggggnngagagggcatggtctctctcgtcccggcagtcccgtctcaagcaaaagctctctcctcttcttccgctcagtgcaccaatcactgcaacatactggcctgaggtcattgagttggtgaaagggaaggagggggtatcatgggcatctcatccaagtggattaaatccttggttggcataaggaaagcagaaaaagcgcagaatgcagaannagcagaaaaaggggtggaacgctgagagcagtgaaactaagagctctgctaattcatcactgcaccaaacggaaacattcttgggatcccgnagctgcacttgcagtcgaagaaattacagtacaaggtgaagctttgactgataacaaaagcgcccaatggtttcaaattcttttttttcgacggacccccgttgatgggccaatttccccgttggacttctaggtaccgaaatttgccccaattggttcccgtctggt

SEQ ID NO: 25834 - protein, 46 aa, Zea mays
  misc_feature: Ceres CLONE 1397947-F
  misc_feature (3)..(3): Xaa is any aa, unknown, or other
  misc_feature (4)..(4): Xaa is any aa, unknown, or other
MQXXQKKGWNAESSETKSSANSSLHQTETFLGSRSCTCSRRNYSTR

SEQ ID NO: 25835 - DNA, 720 bp, Zea mays
  misc_feature: Ceres CLONE 1397948-F
  misc_feature: Encodes the peptide sequence at SEQ ID NO. 25836
  misc_feature (593)..(593): n is a, c, t, g, unknown, or other
  misc_feature (691)..(691): n is a, c, t, g, unknown, or other
  misc_feature (695)..(695): n is a, c, t, g, unknown, or other
aaagctggagctccccgcggtggcggccgctctagaactagtggatcccccgggctgcaggaattcgcacgagaccattacctagaacatcctaatcgaaaaacggatcaaaatcgaatccgacgctactgcctagggtttcctctgcatttcccctaccacaccccgcgccgcccacccatggccgccgcagacgcgtccgccgagaccgccgccatcgcgcggcgcctggcctcctgcaacaccggcacccgggagcgcgcgctccgctacctcctctccgaatttctgccggcctccgcgccgcgcctctccgccaccgacctcctcaagctctggaagggcatcttcttctgcttctggcacgccgacaagccgctctaccagagctccgtcgcctcgcctccgccgtctccgtcccgccgtcccccgccgatggtgccgccttcctcgccgcctacctcaccacgctccgccgcgagtggggccacatcgacgtccaccgcctcgacaagttctacctcctcaaccgccggttcctccaccacgccttcctgcttctccatgctaactcctccgcccccgacgtaccntcgcagggtcgtgtaccgtcctgtcagacaaggccctggctcccggaagccgactacgtcgccgctggcaccatccgggaagccctcgggtaccacgnttcntcggaggcggttccttgacgagctt

SEQ ID NO: 25836 - protein, 180 aa, Zea mays
  misc_feature: Ceres CLONE 1397948-F
  misc_feature (9)..(180): Pfam Name: Nop52 Pfam Description: Nucleolar protein,Nop52
  misc_feature (138)..(138): Xaa is any aa, unknown, or other
  misc_feature (171)..(171): Xaa is any aa, unknown, or other
  misc_feature (172)..(172): Xaa is any aa, unknown, or other
MAAADASAETAAIARRLASCNTGTRERALRYLLSEFLPASAPRLSATDLLKLWKGIFFCFWHADKPLYQSSVASPPPSPSRRPPPMVPPSSPPTSPRSAASGATSTSTASTSSTSSTAGSSTTPSCFSMLTPPPPTYXRRVVYRPVRQGPGSRKPTTSPLAPSGKPSGTTXXRRRFLDEL

SEQ ID NO: 25837 - DNA, 680 bp, Zea mays
  misc_feature: Ceres CLONE 1397950-F
  misc_feature: Encodes the peptide sequence at SEQ ID NO. 25838
aaagctggagctcaccgcggtggcggccgctctataactagtggatcccccgggctgcaggaattcgcacgagaccattacctagaacatcctaatcgaaaaatgctgtcaccggcagctctgacataacacaccgcttcttccccagttcaagtgccacaccgctcgacgccttcccatctcgccgcgacatgaatttctgccgccacctgctcctcgccgcggtgttcgcgctcctcctcgctgtctgcgcttctgcggcgaggacgggagctggttccttcgacccatccagagtggtccaactctcgtggcgccccagagcgctcctgcacaagggtttcctgacggatgcgaagagagaccacctcatcgcgctggccaaggacaagatggagaagtctatggaggccgataacgagtccggcaagagtgtccagagtgaggtgcgcaccacctccggcatggtcctcgagaggaagcaggatgaagtagtaacgaatatagaggagaggagatctgcttggacatttcttccaccagaaaatggcgaatccattcagatattacactaccagaatggtgagaaatatgaaccccactacgactacttccatgacaaaaaaaatcaagccttgggtgagcatcgcatcgccactgtgctgatgcacctctctaag

SEQ ID NO: 25838 - protein, 163 aa, Zea mays
  misc_feature: Ceres CLONE 1397950-F
  misc_feature: SWISSPROT Homolog: EC 1.14.11.2 Procollagen-proline dioxygenase
MNFCRHLLLAAVFALLLAVCASAARTGAGSFDPSRVVQLSWRPRALLHKGFLTDAKRDHLIALAKDKMEKSMEADNESGKSVQSEVRTTSGMVLERKQDEVVTNIEERRSAWTFLPPENGESIQILHYQNGEKYEPHYDYFHDKKNQALGEHRIATVLMHLSK

SEQ ID NO: 25839 - DNA, 511 bp, Zea mays
  misc_feature: Ceres CLONE 1397954-F
  misc_feature (209)..(209): n is a, c, t, g, unknown, or other
  misc_feature (221)..(221): n is a, c, t, g, unknown, or other
  misc_feature (226)..(226): n is a, c, t, g, unknown, or other
aagctggagctccccgcggtggcggccgctctagaactagtggatcccccgggctgcaggaattcgcacgagaccattacctagaacatcctaatcgaaaaagaactgactccctcgatcccagcggcagcggcggaaagcgaacggtgaccgcgacctcccctgaccctgagctgcatatactcggatcggggtttcacatctcccgnttttggatgggntgggntgccccccggtgaatggaaggaaaacttggggggatccatagggaccccgtggggcctggggagggttcacctcctttctggttacccgggaaaaaatggaaaaaccctggggtacgggggcccctttttttctggggctcccaaaaaacgcggggaaaagccccacaatggcccgtttttcccgggaaattttaaaggggagggggtcccccccgggggggggaaaaaaaaaaagggggggggggaaccccccgggggggggtttttaaaaggaggggaggaaa

SEQ ID NO: 25840 - DNA, 673 bp, Zea mays
  misc_feature: Ceres CLONE 1397955-F
  misc_feature: Encodes the peptide sequence at SEQ ID NO. 25841
aaagctggagctccccgcggtggcggccgctctagaactagtggatcccccgggctgcaggaattcgcacgagaccattacctagaacatcctaatcgaaaaaatacacacactctaatctctccacacagccaacacagatacggacaggacaggaggatgaagctggaagcaaaaggcctcggtctcctgatcctccttgtcctgcttgcgctttgctccaccattgaagacggcgaggaaagaacagaccggcattggagggcgacgaggacctcctcctctcaactgctgaagaaaggaaaaggaaagaagaccagctcccgtcgtcaatacagaaaaaaccgggtaaatccgaaggcaccggccaggtcgacaccgagctctggggtcgccgtgaaaggaaaccagactccggaccaaccaagaccgaatgcccctcacatcccgaggccaagcccccctgccaatggcagcgccgattccactcccaagccgacgactcctccaaggtgcgggaaggatcatcaggagacatcacagtcacagtcggcaccaccagcaatctcctcgcaggatggtgcagaattctatgagagtgattttggaggccagggtgacggagctacagacgatactaaggatattcacggagcgtgaactgctgcctgca

SEQ ID NO: 25841 - protein, 166 aa, Zea mays
  misc_feature: Ceres CLONE 1397955-F
MKLEAKGLGLLILLVLLALCSTIEDGEERTDRHWRATRTSSSQLLKKGKGKKTSSRRQYRKNRVNPKAPARSTPSSGVAVKGNQTPDQPRPNAPHIPRPSPPANGSADSTPKPTTPPRCGKDHQETSQSQSAPPAISSQDGAEFYESDFGGQGDGATDDTKDIHGA

SEQ ID NO: 25842 - DNA, 821 bp, Zea mays
  misc_feature: Ceres CLONE 1397955-R2
  misc_feature: Encodes the peptide sequence at SEQ ID NO. 25843
ttccgattgggtaccgggccccccctcgaggtcgacggtatcgataagcttttttttttttttttttagtaaattgacgtcacattataaaccagttcagtaatgataacagaagtttcaacaccttaacagcaacatactgcagccgagagcccccgtttctgtcacaaatcgccactaaaaccctagccttccgccatggccacctcccctgccgcctcgtcctcctccgctccgaccgcctccgcggtggctgcggctacgatggctgttgaggccaccgacgggccggtgctcagcgtagtatcgaagcgtctccgcgcactgcggaagaagtacaaccgaatcacgcagatggaggagtcgctcgccgccgacaagacgctcaaccgagagcaggaggaggttctccgctccaagcccgtcgtcgccgctctgatcgacgagctcgagcgcctccgccctccgctcgcctccgccctcgcggaggagctctcctcccgccccgcccccgccccctccgccgcttcctcctccgactcagattcgtcagtccaggacttgcttgcgctcgtctacttcggctccctctttgacgtcaagcagcaaagcgacttcgtctctttggtttacatgcgcgaactcgagcggagcagctgcctcacttatgactacgtcggggatgatccggaggacagtctcgcggagaccgatctgaacgcggtttctgcccttgcctccctcgccgcgttgcgccctcctgctgcagccggagtctcgcaccgtgacgcccttcaggcttgtgctcatcacgcccgccc

SEQ ID NO: 25843 - protein, 185 aa, Zea mays
  misc_feature: Ceres CLONE 1397955-R2
MAVEATDGPVLSVVSKRLRALRKKYNRITQMEESLAADKTLNREQEEVLRSKPVVAALIDELERLRPPLASALAEELSSRPAPAPSAASSSDSDSSVQDLLALVYFGSLFDVKQQSDFVSLVYMRELERSSCLTYDYVGDDPEDSLAETDLNAVSALASLAALRPPAAAGVSHRDALQACAHHAR

SEQ ID NO: 25844 - DNA, 671 bp, Zea mays
  misc_feature: Ceres CLONE 1397955-R
  misc_feature: Encodes the peptide sequence at SEQ ID NO. 25845
cgattgggtaccgggccccccctcgaggtcgacggtatcgataagcttttttttttttttttttagtaaattgacgtcacattataaaccagttcagtaatgataacagaagtttcaacaccttaacagcaacatactgcagccgagagcccccgtttctgtcacaaatcgccactaaaaccctagccttccgccatggccacctcccctgccgcctcgtcctcctccgctccgaccgcctccgcggtggctgcggctacgatggctgttgaggccaccgacgggccggtgctcagcgtagtatcgaagcgtctccgcgcactgcggaagaagtacaaccgaatcacgcagatggaggagtcgctcgccgccgacaagacgctcaaccgagagcaggaggaggttctccgctccaagcccgtcgtcgccgctctgatcgacgagctcgagcgcctccgccctccgctcgcctccgccctcgcggaggagctctcctcccgccccgcccccgccccctccgccgcttcctgctccgactcagattcgtcagtccaggacttgcttgcgctcgtctacttcggctccctccttgacgtcaagcagcaaagcgacttcgtctctttggatttacatgcgcggactcgagccgagcaactgcctcacttatgact

SEQ ID NO: 25845 - protein, 135 aa, Zea mays
  misc_feature: Ceres CLONE 1397955-R
MAVEATDGPVLSVVSKRLRALRKKYNRITQMEESLAADKTLNREQEEVLRSKPVVAALIDELERLRPPLASALAEELSSRPAPAPSAASCSDSDSSVQDLLALVYFGSLLDVKQQSDFVSLDLHARTRAEQLPHL

SEQ ID NO: 25846 - DNA, 704 bp, Zea mays
  misc_feature: Ceres CLONE 1397961-F
  misc_feature: Translation starting site: 466
  misc_feature: SWISSPROT Homolog: EC 2.3.1.15 Glycerol-3-phosphate O-acyltransferase
ttccaaagctggagctccccgcggtggcggccgctctagaactagtggatcccccgggctgcaggaattcgcacgagaccattacctagaacatcctaatcgaaaagacaactcgcacgcagcaggacgacgtctctcctctgggtctggggccgagacacctagtacgtactaccagcaagatggtggcgtctcccagattcaagcccatcgaggagtgctgctcggaggggcggtcggagtagactgtggccgccgacctggacggcacgctgctcatctccaggagcgcgttcccctactacctcctcgtggctctcgaggccggcagcgtcctccgcgccgcgctgctgctcctgtccgtgccgttcgtctacgtcacctacgccttcttctccgagtcgctggccatcagcacgctggtatacatctacgtgggcggggctcagggtgcgcagcatccagatggtggtgcgcttcgtgctccccaggttctacgcggtcgacgtgccaccggaaagttggaggatggtcaggtccttccgtaaggggttacgtgggtcccggccatgcccaaggggaatggggcaagccccttccccagggccttttcaaggggcccaaaaaggggggggggggacaaaaacttgggggccccccaaggaaaagggaaggggccccttttttttgggggaaaaccccaa

SEQ ID NO: 25847 - DNA, 719 bp, Zea mays
  misc_feature: Ceres CLONE 1397964-F
  misc_feature: Encodes the peptide sequence at SEQ ID NO. 25848
  misc_feature (630)..(630): n is a, c, t, g, unknown, or other
  misc_feature (631)..(631): n is a, c, t, g, unknown, or other
  misc_feature (691)..(691): n is a, c, t, g, unknown, or other
aaagctggagctccccgcggtggcggccgctctagaactagtggatcccccgggctgcaggaattcgcacgagaccattacctagaacatcctaatcaaaaaacatccgctccccgccttccgcttccctaccccccgcatcacctaccaacgccgacaccatgggggccttcgcgaaggaggagcaccagttcctcgccgagctcggcctcgcgcagcgcaacccgggcgcgttcgcatgcggtgcgtggggcggctcaggtcccaccgtcacctccacgagcccgaccaacaatcaggtcatcgcagaggtcgtggaggcgtccgtgcacgactacgaggagggcatgcgcgcctgcttcgacgccgctaagacatggatggcgattcctgctccaaagcgaggagagatcgttaggcaaatcggtgatgcactgagagcaaagctccatcaccttggcaggcttgtgtcacttgagatggggaaaattcttcctgaagggatcggtgaggttcaggaaatcattgacatgtgtgattatgctgtgggactaagtcgccaactaaatggatccattataccatctgaacgaccaaaccatatgatgatggaggtgtggaatcccttgnnagtgtgggtggtataacggcatttaatttccctgtgctgtgcttgggtggaatgctgcanttgcttggtctgtgaaaatgtgtcgtct

SEQ ID NO: 25848 - protein, 161 aa, Zea mays
  misc_feature: Ceres CLONE 1397964-F
  misc_feature: SWISSPROT Homolog: EC 1.2.1.3 Aldehyde dehydrogenase (NAD(+))
  misc_feature (157)..(157): Xaa is any aa, unknown, or other
MGAFAKEEHQFLAELGLAQRNPGAFACGAWGGSGPTVTSTSPTNNQVIAEVVEASVHDYEEGMRACFDAAKTWMAIPAPKRGEIVRQIGDALRAKLHHLGRLVSLEMGKILPEGIGEVQEIIDMCDYAVGLSRQLNGSIIPSERPNHMMMEVWNPLXVWVV

SEQ ID NO: 25849 - DNA, 707 bp, Zea mays
  misc_feature: Ceres CLONE 1397967-F
  misc_feature: Encodes the peptide sequence at SEQ ID NO. 25850
aaagctggagctccccgcggtggcggccgctctagaactagtggatcccccgggctgcaggaattcgcacgagaccattacctagaacatcctaatcgaaaagtttctagttctagggtttaaagagctcgccgagcccgtcgtgcgccggcccagcaagagcccactactttccgccgtcgccatcgccggcgccgacctctccgtctccgcgcgcggcaatggcattctccttcgcctcgccgccagcttcgaaccccttccagacgccggctgcgtcgaatcccttccagacgccagctgcgtccaatccctttcagacgccggcggcgccgaatccgtttcagacaccgactccggccacctcacaggcgccgtccctatgcgccctcgccgttccagttcagcttccagccgcagccgcagcagcagccacagcagcagcaggtgggcgccggcggtgcaacctcagcagccgcagccacagcatcagaagctgatgctgtacacgacggatatgaaacccgctgggtacaacaccaagtgggaggagctgcacgccgagtcgcagaaggctttgctccagatcgaggacaagatacgggactacagagacgagtgtgagagggtggatcagtgcagtcgcctttatgactcctcaatctcgaatgtaaattttgagcttgatgcaagtcggattgttcagg

SEQ ID NO: 25850 - protein, 108 aa, Zea mays
  misc_feature: Ceres CLONE 1397967-F
MRPRRSSSASSRSRSSSHSSSRWAPAVQPQQPQPQHQKLMLYTTDMKPAGYNTKWEELHAESQKALLQIEDKIRDYRDECERVDQCSRLYDSSISNVNFELDASRIVQ

SEQ ID NO: 25851 - DNA, 706 bp, Zea mays
  misc_feature: Ceres CLONE 1397968-F
  misc_feature: Encodes the peptide sequence at SEQ ID NO. 25852
  misc_feature (578)..(578): n is a, c, t, g, unknown, or other
  misc_feature (579)..(579): n is a, c, t, g, unknown, or other
  misc_feature (666)..(666): n is a, c, t, g, unknown, or other
  misc_feature (706)..(706): n is a, c, t, g, unknown, or other
cgctctagaactagtggatcccccgggctgcaggaattcgcacgagaccattacctagaacatcctaattgaaaaacatcgatcagtcgcgtgtctaggtttcctctctcaccatagcgcccgctctgtcgcccttcgttcacctctccttcctctcgtccctgcctgtcagggagaggggaagtcagaggcacgtagtgtcgcacagcagacgcccgtgaaccattgtagctgtccctgtcgtcgtcgtcgtcaacgaacccacacaaggaaaggatggagaataagtcgaccatcctcatgaacaggtacgagctcgggcgcacgctcggacagggtaccttcgacaaggtgtaccacggtcggaacctcgcgtccgacgagagcgtgcacatcaaggtcatcgacaagcagaaggtgatgcgcgtccgcatgatcgaccagatcaagagtgagatctccgtcatgcgactcgtccgacacaccaacgtcttgcagctgcacgaggtgatgggcagcaagagcagatatacttcaccatggagtacgtccgggggcggaaagctcttcttccgctnnccctcgcgacggttcaagtaggacgtcgcgagaagtacttccacagatcgtcgaagcgtcgacttctgcacagccgctgggttacanccggactcagccgaaaacccccctcgttgaggagacggan

SEQ ID NO: 25852 - protein, 107 aa, Zea mays
  misc_feature: Ceres CLONE 1397968-F
  misc_feature: SWISSPROT Homolog: EC 2.7.11.1 Non-specific serine/threonine protein kinase
  misc_feature (101)..(101): Xaa is any aa, unknown, or other
MENKSTILMNRYELGRTLGQGTFDKVYHGRNLASDESVHIKVIDKQKVMRVRMIDQIKSEISVMRLVRHTNVLQLHEVMGSKSRYTSPWSTSGGGKLFFRXPSRRFK

SEQ ID NO: 25853 - DNA, 689 bp, Zea mays
  misc_feature: Ceres CLONE 1397969-F
  misc_feature: Encodes the peptide sequence at SEQ ID NO. 25854
  misc_feature (560)..(560): n is a, c, t, g, unknown, or other
  misc_feature (668)..(668): n is a, c, t, g, unknown, or other
aaagctggagctccccgcggtggcggccgctctagaactagtggatcccccgggctgcaggaattcgcacgagaccattacctagaacatcctaatcaaaaatcctcatcacaggcgagaaggcaccacacctcttcttcttcttcctcctcctcctagcacagctagcgcctgctccccttcccctgagatcatgtgttgcagcagcggctagagcgactgtggatcccgctgatcctgcgggatctcatgcaactgcatgtcccctaacgtggagaccgccgacgtcagcagcataaagaccacggtcctcgccgaggcgaccaccaaggccagcgccggcgaattcgaggcggtcaccgaggacggagactgcgactgcaacacctgcaactgcggaaccagctgcggctgctcctgctgcagctgcaactgagccggtcaggcgatggcgcacgagagtcgagaggacgactatgagtcgtataaatataatagcggcgtctaaataacatcctgtcaactgcacccgccattatcgatccatggtcgctcctggnggttcatgttcatctgtaacgtgctcgcagtcatgaccgtctcgtgacggatttaatatttatatgcatggaatttggtgtattttctgcgttatcacatgtgccggnattcttgcgtgtcataaaaaa

SEQ ID NO: 25854 - protein, 58 aa, Zea mays
  misc_feature: Ceres CLONE 1397969-F
MSPNVETADVSSIKTTVLAEATTKASAGEFEAVTEDGDCDCNTCNCGTSCGCSCCSCN

SEQ ID NO: 25855 - DNA, 731 bp, Zea mays
  misc_feature: Ceres CLONE 1397970-F
  misc_feature: Translation starting site: 175
aagctggagctccccgcggtggcggccgctctatactagtggatcccccgggctgcaggaattcgcacgagaccattacctagaacatcctaatcgaaaaagaatcttctgccactgcccttccatctcgtcccttagctacaagtcatctcgccgcaaccggaacccgcagccatggggacggaggcggagcagccggacatggacagccaccgaaacgacggcgtcgtggtggtgccagtgccgcgcccgcgcaaggggctcgcctcctgggcgcttgacctgctcgagtccctcgccgcgcgcctcggccacgacaagaccaagccgctccactggctctccggcaacttcgcccccgttgtttatggagacccgccggccccaacccttatcgtccaccgacccccccccaaagcgccctgcatgcccgcggcgaacgtacctgactgccccccccccccccatttcctcgccctccacccccgtaccctcatatcccatctttatcattcaactgccccaccacgctcccctaactccaccccgtccacccccgcctctctcacctgccttcctaccagtcctctcgttcttattcgctgccagcccagacacccccccgccctcgtctctcccctattcgtcatcgctaccgctcatgttggtcctccgaagcccccgatggatctagaccctctcttcgcccccccccgttcctacggggcgca

SEQ ID NO: 25856 - DNA, 725 bp, Zea mays
  misc_feature: Ceres CLONE 1397972-F
  misc_feature: Translation starting site: 160
  misc_feature (416)..(416): n is a, c, t, g, unknown, or other
  misc_feature (539)..(539): n is a, c, t, g, unknown, or other
  misc_feature (548)..(548): n is a, c, t, g, unknown, or other
  misc_feature (549)..(549): n is a, c, t, g, unknown, or other
  misc_feature (582)..(582): n is a, c, t, g, unknown, or other
  misc_feature (590)..(590): n is a, c, t, g, unknown, or other
  misc_feature (600)..(600): n is a, c, t, g, unknown, or other
  misc_feature (601)..(601): n is a, c, t, g, unknown, or other
aagctggagctccccgcggtggcggccgctctagaactagtggatcccccgggctgcaggaattcgcacgagaccattacctagaacatcctaatcgaaaaaatctgaagcaaaatgtaccgggaatgttgaagagcgggactcttaagcagtagtgagatgcggcggtggtggtcgccggcgttggcggctgtggagccgcggtccgtgcagctcctgctcctgggcgtcgctctcgtcgcagcttctttctacgccggcaccctcttcggctcctccgcgtcccctgcgctcgtactgcccccttcgcgcccccgatcgcccgattccttcagggccaaagatattccagtgtttaccaacagagtttctcgtacgtaccgggcaaaatcagtgacagttccagatcacggagnttgatgtgtgtcctttggaatacaatgagtatgtcccctgccatgatggagcctatataagcagcttgaagagcctggatacatctaggcatgaggatctttgaagtatttgtcctcatcggnagaagcggnntgtttttgtttggtgccccctccaatgactacnagataccnatgagatggnncaacagccgagactacgtatgggcgtagtaatggtcaccatcacatcttgctgaggtcaaaggagacagaactgggtgcatgagaaggcaaaactttggtggtttccctggaggtggcactcac

SEQ ID NO: 25857 - DNA, 728 bp, Zea mays
  misc_feature: Ceres CLONE 1397973-F
  misc_feature: Encodes the peptide sequence at SEQ ID NO. 25858
aaagctggagctccccgcggtggcggccgctctatcactagtggatcccccgggctgcaggaattcgcacgagaccattacctagaacatcctaaaaaaaaagcagtccaaacacgcaacgcaacactcgccttcccctcccaaccctccgaaccgaagcagcaaagctagacgatgacgctgacgatcccggacgaggtgcgcgccaaggcggaggtgtacgtgggcgacgcggcggggcaggagaagacgcggctgctcctccaggagacgggcctcccgagcgggctgctcccgctgcgggacatcatcgagtgcggctacgtggaggagacgggcttcgtgtggctccggcagcgccgcaaggtggaccactacttcgccaaggccggccgccacgtgttctacggcgccgaggtgtctgcggtgatcgaccagggccggctcaagaagatcacgggcgtccaggccaaggagatgctgctgtgggtcaccctccactaaatcggcgtccaccgaccgccccacgggccaggctcccgtgaaaggcccttcgtgacgcctgcccgctgattctccgtaaagcctttccagacgtatgcgtccgaggtgatccgcaactgaaccttgccgcccccgcgtcggcgcgacggcccggatagtgctctctctagcactcccgcagccccgtacccgcgaagcctgctgccgcccgcccctctcgaccg

SEQ ID NO: 25858 - protein, 109 aa, Zea mays
  misc_feature: Ceres CLONE 1397973-F
  misc_feature (2)..(109): Pfam Name: DUF538 Pfam Description: Protein of unknown function, DUF538
MTLTIPDEVRAKAEVYVGDAAGQEKTRLLLQETGLPSGLLPLRDIIECGYVEETGFVWLRQRRKVDHYFAKAGRHVFYGAEVSAVIDQGRLKKITGVQAKEMLLWVTLH

SEQ ID NO: 25859 - DNA, 717 bp, Zea mays
  misc_feature: Ceres CLONE 1397974-F
  misc_feature (319)..(319): n is a, c, t, g, unknown, or other
  misc_feature (398)..(398): n is a, c, t, g, unknown, or other
aaagctggagctccaccgcggtggcggccgctctagaactagtggatcccccgggctgcaggaattcgcacgagaccattacctagaacatcctaatcgaaaaccaaaaagcccaatcttttactcgtgctcttttcttcctttctttgtcccggtgcggcgtgtgctcgcgtggcgtcaagagcggcggcagctcggcggtgttcacggccgagtgctcccacgccttccacttcccctgcatcgcagcccacgcgcgctcctcctccgccaacggcgttctgtcctgccccgtctgcgcctcgccgtggcgccaggngcccttcctcgcctccctccgcctccactgctccttccacgacgacaagcaccgaggaggaggcgacgggccccctaancttccccctcgtccatcgccaccacgcccacgatcggctggtgcccgcccacctcaagccccaggtcgcttgcaaacacccgacccgtcacccaaggaggccccaccacgcaaacaggcggcaacccccagttcacgcggcccccaccgggacggaagagagtcaaccccaatgcgcttcgcctagcacacagcgcccgaggcaacacttatgggcaaaggcgccccaaaaacccccgtcgccccgcacaatacccattatacggcgcaacggcgtatttagtgtggggactcccgccgctgcccatttcctagccgca

SEQ ID NO: 25860 - DNA, 749 bp, Zea mays
  misc_feature: Ceres CLONE 1397977-F
  misc_feature: Translation starting site: 145
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (702)..(702): n is a, c, t, g, unknown, or other
aaagctggagctccccgcggtggcggccgctctagaactagtggatcccccgggctgcaggaattcgcacgagaccattacctagtacatcctaatcgaaaaacctgccacatctggccatctctcagtctcacacgcgctgccatggacggatccatgtggtgcgctgccaactacgtgcctctgacgccgctcagcttcctggagcgcgccgcggtcgtgtacggcgaccgcgcggccgtcgtttgcggcgataggcggttctcgtggcgcgagacgagggagcggtgcctcgccggggcagccgctctcgctcgtctcggcgttggccgccgcgacgtggtcgcggtcatcgcctcgaacgtaccggcgatgtacgagctccatttcagcgtgccgatgaccggcgccgtcctgtgcacgctcaacacccgccacgacgcggcccatggtgtccgtcctgctgaaacactcggaagccaaggtcttcctcgtggagtcgcagttccacgccgtggcccgcgacgcgctcaggctcctcgccgacgccaaagacaggcttcctctcgtcatcacggtttctgaccctagcagcagcagcaccggcggcggctgcggcagcacgacgnnngcgtcgcgggtcggggagtacgaagcgctcctgcggagcgcgccgcgcgactccaaatccgggtggccggncgacgagcgcgacccgatatcgctgaactacacgtcgggcaccacgc

SEQ ID NO: 25861 - DNA, 691 bp, Zea mays
  misc_feature: Ceres CLONE 1397980-F
  misc_feature: Encodes the peptide sequence at SEQ ID NO. 25862
  misc_feature (435)..(435): n is a, c, t, g, unknown, or other
  misc_feature (459)..(459): n is a, c, t, g, unknown, or other
  misc_feature (484)..(484): n is a, c, t, g, unknown, or other
  misc_feature (489)..(489): n is a, c, t, g, unknown, or other
  misc_feature (491)..(491): n is a, c, t, g, unknown, or other
aaagctggagctccccgcggtggcggccgctctagaactagtggatcccccgggctgcaggaattcgcacgagaccattacctagaacatcctaatcgaaaaacccgaagcacatcccgtcgcatcccatcccactaccacccatctcgtcgtccgccgattcgatccggttcttccaacccaggggctgtgatggcgacgaagaggagcgtgggcaccctcggcgaggcggatctgaaggggaagaaggtgttcgtgcgcgccgacctcaacgtccctctcgacgacgcccagaagatcaccgacgacacccgcatccgcgcctccgtccccaccatcaagttcctcctcgagaagggcgccaaggtcatcctcgccagccacctgggtcgtcccaaaggtgtcaccccaaagtacagcttggagcctcttggntcacgcttgtctgagctccttggnagtgaagtcgtgatgggcaatgatngcatngntgaggaaagtgaaaagtgggctgccgctttgccagaggtggagtcctgctcctaaagatggtaaatcctacagggggaagaaaagaccgaccctgatttgctaaaagctagcaattggtgttgacctttatgcaaaggatgctttgggcagggaaacaggagttttggtttccccgaaggggtctccagtttttgaggcc

SEQ ID NO: 25862 - protein, 117 aa, Zea mays
  misc_feature: Ceres CLONE 1397980-F
  misc_feature (3)..(118): Pfam Name: PGK Pfam Description: Phosphoglycerate kinase
  misc_feature: SWISSPROT Homolog: EC 2.7.2.3 Phosphoglycerate kinase
  misc_feature (98)..(98): Xaa is any aa, unknown, or other
  misc_feature (99)..(99): Xaa is any aa, unknown, or other
  misc_feature (100)..(100): Xaa is any aa, unknown, or other
MATKRSVGTLGEADLKGKKVFVRADLNVPLDDAQKITDDTRIRASVPTIKFLLEKGAKVILASHLGRPKGVTPKYSLEPLGSRLSELLGSEVVMGNDXXXEESEKWAAALPEVESCS

SEQ ID NO: 25863 - DNA, 667 bp, Zea mays
  misc_feature: Ceres CLONE 1397983-F
  misc_feature: Encodes the peptide sequence at SEQ ID NO. 25864
  misc_feature (313)..(313): n is a, c, t, g, unknown, or other
  misc_feature (386)..(386): n is a, c, t, g, unknown, or other
ggagctccccgcggtggcggccgctctagaactagtggatcccccgggctgcaggaattcgcacgagaccattacctagaacatcctaatcgaaaatttctctcaatctctctcttctcctcgcctcgccttggtgttcacgccgtcgctagcgcctgccgcggcgaagcttctgtcctccccggcgccgggctcgggtcgtcgtcggccaggaagatggctggcggcttcagggtactgcatctggtcaggccttttctggctttcttgccagaggtgcagagcgcggataggaagatacctttcagagaanaagttatatacactgttatttccctcttcattttcctggtctgcagccagctcccactctatggcattcattncacaactggagctgatcctttctactggatgcgtgttatcctcgcatcaaaccgtggcactgtgatggaagtgggtattactcccattggtgacatctggggatggtaatggcaacttctttgttggatccgagaatcattggaagttgacaaaagggggaaaaaaagatcgtgcttctgctgaagggggccaaaaaagtggcttggaatcctaattgcatttggggaaacttgggaaaatttcccttcctggaaagtttggcaagggaacccacatttga

SEQ ID NO: 25864 - protein, 92 aa, Zea mays
  misc_feature: Ceres CLONE 1397983-F
  misc_feature (33)..(33): Xaa is any aa, unknown, or other
  misc_feature (57)..(57): Xaa is any aa, unknown, or other
MAGGFRVLHLVRPFLAFLPEVQSADRKIPFREXVIYTVISLFIFLVCSQLPLYGIHXTTGADPFYWMRVILASNRGTVMEVGITPIGDIWGW

SEQ ID NO: 25865 - DNA, 734 bp, Zea mays
  misc_feature: Ceres CLONE 1397984-F
  misc_feature: Encodes the peptide sequence at SEQ ID NO. 25866
  misc_feature (446)..(446): n is a, c, t, g, unknown, or other
  misc_feature (706)..(706): n is a, c, t, g, unknown, or other
ggagctcaccgcggtggcggccgctctagaactagtggatcccccgggctgcaggaattcgcacgagaccattacctagaacatcctaatcaaaaaaatgactataagggcgccaatctaggcaaggcattgtcttgtagtactttcccttacaggaatggcctcgattccgatcacattttcctgtccatgcaacgcgccggtggtggacgcctgtgccaccatgctccagctggtcatgaagattaagcatgcgctgaacgtcgcatcgacgctattggcgctgatatctctctcgctgctcctcctctgcctgatcctccgtatccggctgttcgtcttccgcgacgcggcgctgaagctccacatgttggtgcgcctcctgctcagagccgagctcctctgcctcgcgaggacctgccacgacgagcgggtcagcttcgagngccaccacgctgcgcgtctggagctccgccagctcatcgtccgaagcgccgctgctcctgctccacggctacttcgtctgacgcaagtgcatgtaggtgcgcagcatccgcgcctgtcccgctacttctacgtgaactcgccggaccacgaggtgttcttcttgcagcatcggcccgcgatcccgatgggatcgtcgcgatctacgaccactgcgcaacgagtcatgcaccctctcggatgccccgttacaggtgacgangtgcatctaggcagcatgcatcgctaca

SEQ ID NO: 25866 - protein, 192 aa, Zea mays
  misc_feature: Ceres CLONE 1397984-F
  misc_feature (97)..(97): Xaa is any aa, unknown, or other
  misc_feature (183)..(183): Xaa is any aa, unknown, or other
MASIPITFSCPCNAPVVDACATMLQLVMKIKHALNVASTLLALISLSLLLLCLILRIRLFVFRDAALKLHMLVRLLLRAELLCLARTCHDERVSFEXHHAARLELRQLIVRSAAAPAPRLLRLTQVHVGAQHPRLSRYFYVNSPDHEVFFLQHRPAIPMGSSRSTTTAQRVMHPLGCPVTGDXVHLGSMHRY

SEQ ID NO: 25867 - DNA, 564 bp, Zea mays
  misc_feature: Ceres CLONE 1397985-F
  misc_feature (270)..(270): n is a, c, t, g, unknown, or other
  misc_feature (274)..(274): n is a, c, t, g, unknown, or other
  misc_feature (295)..(295): n is a, c, t, g, unknown, or other
  misc_feature (300)..(300): n is a, c, t, g, unknown, or other
  misc_feature (312)..(312): n is a, c, t, g, unknown, or other
  misc_feature (338)..(338): n is a, c, t, g, unknown, or other
  misc_feature (339)..(339): n is a, c, t, g, unknown, or other
  misc_feature (360)..(360): n is a, c, t, g, unknown, or other
gctctagaactagtggatcccccgggctgcaggaattcgcacgagaccattacctagaacatcctaatcgaaaaataagcgcagatcgagtcatcaagctagctagcccggagcacgcctagacacgccagcagcaatggcggctcagctggccgtcgcgtttctcgccttgttgtcctcctctgcttcttggcggtctggcagaagttcaacgctcttcagcttcggcgactcatgtccgacaccggcactgtgcgtgaacgtcccccngcgnctgacgctcaccagccgcccntacgngagacttctttnggcgcgccactgcgctgctccgacgnncgctcgtcgtcgacttctggncgaaaagttcggctgccgctgctgaagccgtcaaaccaggccgctcaaacttcaagaagggggccacatggcgaatcttggccgcgaccaccatggacttgggttttttccagccggtgggcatcgcccaaaagaattggaaaacgggcccctcaaaaccaaaatccggggttcccaaaattgagccgcccattttggggtcaa

SEQ ID NO: 25868 - DNA, 705 bp, Zea mays
  misc_feature: Ceres CLONE 1397987-F
  misc_feature: Encodes the peptide sequence at SEQ ID NO. 25869
aaagctggagctccccgcggtggcggccgctctagaactagtggatcccccgggctgcaggaattcgcacgagaccattacctagaacatcctaatcgaaaaccattaagcttttatcgcttcgttatttctctgctgtgcttgccttgctcttttgttgctctaaccatggacgcaggctcccgctcgatctcctcggcgaacaaccgcgccggcgccgcgccccggccgccgctgcaggaggcgggctcccgcccctacatgtcatcgctgagctcggaaccccgcaagccgacggacgagtgctacagcgactggtacatcgcgcacgaggcggcgatggatatggagttggcgcactacttgcttactgagaccaggaggaacaaggagaacgcgtcggccatggcgacgaccgcgcccaaggaggcgaaccggaggctgctcgcgcagaagctgatcaacaaccggacacggatcctcgctttcaggaggaagtcgccggagaccgagaaggcatcttttgcggacacgacttcctgcaacctgcatgccaagacggtgaagcagcgtcgccacattccccagtctgccgagaggaccctagacgcaccggagctagttgacgactactacctcagcttgcttgagtggggaagcaacaacgtgctattcgttgctttggaagacacgatggacctgagt

SEQ ID NO: 25869 - protein, 179 aa, Zea mays
  misc_feature: Ceres CLONE 1397987-F
MDAGSRSISSANNRAGAAPRPPLQEAGSRPYMSSLSSEPRKPTDECYSDWYIAHEAAMDMELAHYLLTETRRNKENASAMATTAPKEANRRLLAQKLINNRTRILAFRRKSPETEKASFADTTSCNLHAKTVKQRRHIPQSAERTLDAPELVDDYYLSLLEWGSNNVLFVALEDTMDLS

SEQ ID NO: 25870 - DNA, 805 bp, Zea mays
  misc_feature: Ceres CLONE 1397988-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (13)..(13): n is a, c, t, g, unknown, or other
  misc_feature (20)..(20): n is a, c, t, g, unknown, or other
nnnnttttttttnttttttnttttttatttattgtgttggttgtgtctgtagtttacaaagctggagctccccgcggtggcggccgctctagactagtggatcccccgggctgcaggaattcgcacgagaccattacctagaacatcctaatcaaaaaacaaccgctccccgccttccgcttccctaccccccgcatcacctaccaacgccgacaccatgggggccttcgcgaaggaggagcaccagttcctcgccgagctcggcctcgcgcagcgcaacccgggcgcgttcgcatgcgctgcgtgaagagaatcaggacccaccgtcaccctccacgagcccgaccaacaatcacgccactcgcagaggccgtggcaggcagcccgtgcaccgactacgcaggagcgcatgaccagcctgccttccacgccgccaaacaacatggaatgcccgattcttgcccccaaagcccagggacaagctcccccacgcccaacccgctgaaccgcactcgaaaagacaaagctccccacccccccccgggcaagcctcggtagcccacttggggcacggggtgcaaaactctctctccttgcaaggggattgggggggaggggtccacgggaaaacctaccggcaccctggcgggcgcacatacagcgtgtgggtgacaccaaacctctccacccccccacaacagcacccacaaatcctacccattcatgccagacacccccaaaaacacataatgcgtcgacccgcgcgggctagagagcgaaaccccaccaatgacggaaagtcgta

SEQ ID NO: 25871 - DNA, 677 bp, Zea mays
  misc_feature: Ceres CLONE 1397990-F
  misc_feature: Encodes the peptide sequence at SEQ ID NO. 25872
aaagctggagctccccgcggtggcggccgctctagaactagtggatcccccgggctgcaggaattcgcacgagaccattacctagaacatcctaatcgaaaaacactgcatcacaacacacgccagccagacatcgtcacactggcgagctctgcactctgcttagatccgagcttcagtgccttcgctgtttgctccacagtccacacacacacacgtccagctagctgcactgcaccaatggccgccgtcaaggtccaggtcccgactgccgctcccgtcgaggaggctgcccagctggccgccgcctccgccgtcgagaccccaaacgaggagaccgctgctccggcggtggagaccgatgacgacgtctataaggagccgcagccggtggaggccgacactgagactgagaccaaggaggccgaggccgttgctgagtcgaacgaggtatagcccaaggaagcagagccggaggccgccgctgcgggcagtagagacagaggtcaaggaagcagagacggaggccgcccgaccggtagcagaagacgaggttgttgctgccccgggccaggctgctgagccggatatacccgccaaaaaccaaaaggtgccggttgtggaggttcaccaggaggaagaggaagcaacccctgctgtttgatgcactcctgagg

SEQ ID NO: 25872 - protein, 71 aa, Zea mays
  misc_feature: Ceres CLONE 1397990-F
MAAVKVQVPTAAPVEEAAQLAAASAVETPNEETAAPAVETDDDVYKEPQPVEADTETETKEAEAVAESNEV

SEQ ID NO: 25873 - DNA, 677 bp, Zea mays
  misc_feature: Ceres CLONE 1397991-F
  misc_feature: Encodes the peptide sequence at SEQ ID NO. 25874
aagctggagctccccgcggtggcggccgctctagaactagtggatcccccgggctgcaggaattcgcacgagaccattacctagaacatcctaatcaaaaaaactccacgtccacacctcacagagctgcagcagcatcagctgccacctcctgcctctcctccttccttcctgcctgcataggttgctacacgtatatattctgaagaagagatcgagatgaccagcgtgtgcaagaccaaggttctgcctggcctcaacaaaatctttgacaaggatggcaagaaggctgcagctgcaggcttcttgaagtccttcaacaaggaggagtttgacaaggagattgaggacaaaaagacagagctggagcccaaggccgaggaggcctacgaagcatctcctcctgaggtcaaggctctcttcaaggataagaacccagccaaggacaacaagaagaactcggctgcaatcaccaagctcctcgatgagctggctaatattgacttccctggagccaaggtgctgagcgacgcgctgaccaaatccggcacctcgcccctgcttccggcgatcaccttcatcttggacaaggtcgcaccgtttatccccaaggaggagcccaaggaagagccggagatgcaggccacctcccgggaaagtcaccgtggaggagaaga

SEQ ID NO: 25874 - protein, 152 aa, Zea mays
  misc_feature: Ceres CLONE 1397991-F
  misc_feature (2)..(149): Pfam Name: DREPP Pfam Description: DREPP plasma membrane polypeptide
MTSVCKTKVLPGLNKIFDKDGKKAAAAGFLKSFNKEEFDKEIEDKKTELEPKAEEAYEASPPEVKALFKDKNPAKDNKKNSAAITKLLDELANIDFPGAKVLSDALTKSGTSPLLPAITFILDKVAPFIPKEEPKEEPEMQATSRESHRGGE

SEQ ID NO: 25875 - DNA, 571 bp, Zea mays
  misc_feature: Ceres CLONE 1397994-F
  misc_feature: Encodes the peptide sequence at SEQ ID NO. 25876
caccgcggtggcggccgctctagaatagtggatcccccgggctgcaggaattcgcacgagaccattacctagaacatcctaatcgaaaagaaaacctcccacgcacattcttggcagctactctactcaatggcgctgtcctcctccggccacccggcgacgacccgcctgctcttctcgcttctgctcgtgggctcggcggcgggcttgccggagcgggcggccatcgacagggtcaaccggcgaggcccttccctcggcctcgtcatgtcctacgtcgacgaggccaccgcgctgcaggcctccggctacttccagccttggcgtgccctccctttcgttgacctctacggacggcggtatcacatcggcagcattcggggcgtgaacgtgatatacgcactgacagggcaacgcaggctggacgccgccgtcacagtacagacgctgatcgacgtcttcaggcgggtccggaattgttcactacgggacggcaagggagcttgaaacgaccccctctccttcgggggacgtcaggggcccccgggtttgccccccaacccggggggcg

SEQ ID NO: 25876 - protein, 125 aa, Zea mays
  misc_feature: Ceres CLONE 1397994-F
MALSSSGHPATTRLLFSLLLVGSAAGLPERAAIDRVNRRGPSLGLVMSYVDEATALQASGYFQPWRALPFVDLYGRRYHIGSIRGVNVIYALTGQRRLDAAVTVQTLIDVFRRVRNCSLRDGKGA

SEQ ID NO: 25877 - DNA, 709 bp, Zea mays
  misc_feature: Ceres CLONE 1397996-F
  misc_feature (564)..(564): n is a, c, t, g, unknown, or other
tggagctccccgcggtggcggccgctctagaactagtggatcccccgggctgcaggaattcgcacgagaccattacctagaacatcctaatcgaaaaaatgatagcgtaagccgacttctctctcactatgaacagatgtcaaccacctctgaaaacgaccggaccactcgacaagtacattttcttccgcccaccttagtacggcgcgacctcggcctcggcgacgcctacgtccgccggacgcggaagccatggcgtctgaagtaggagctcaagagctccgacacggagaccatcactctgccgccgaccgaacacgaatggtgcgctgtacacgatgccatgctactccacgatcccggcgcaacccgccgtggaagccggtagtccactccagagagcacgcaccacgccgcacaaggtgccacgtgtgtcgtgtgagctagaaggcactcgctacgttcagagcaggacaagctacgatggtgcgacggtggctgccgccgaacgtcagaagctaggcacgacgagcgtactactactgaggaccgacgatcaagaancatggtcgctgcaacacggagtattcctgccgccttaaaggaaatagatggccttcataatagtcatatgcggtgctacgaatgctttccagacaatgttactccttcatacgaacgttacatgaactgctacggtctgcagcat

SEQ ID NO: 25878 - DNA, 799 bp, Zea mays
  misc_feature: Ceres CLONE 1397997-F
  misc_feature: Encodes the peptide sequence at SEQ ID NO. 25879
  misc_feature (393)..(393): n is a, c, t, g, unknown, or other
  misc_feature (397)..(397): n is a, c, t, g, unknown, or other
  misc_feature (398)..(398): n is a, c, t, g, unknown, or other
  misc_feature (435)..(435): n is a, c, t, g, unknown, or other
  misc_feature (486)..(486): n is a, c, t, g, unknown, or other
  misc_feature (494)..(494): n is a, c, t, g, unknown, or other
ggagctccccgcggtggcggccgctctagaactagtggatcccccgggctgcaggaattcgcacgagaccattacctagaacatcctaatcaaaaaaggacctactttacacctcctcttcttcttcttcctcgtgcagcagctgtccatcgccgctgggttttctttgttggcattgggttttggaggagaggtcaaggctgagactcggagacgaaatgggtcataggatgttcagtcccttggggctttccttcttcttgccatcgtcgtcctctatggtggaacagagcagaggcgagcggaggcagcagaaggagggagcccgcacaggctgctggccaccatctcggtgtccaagccgtcctaccccacggtcaccacgcccatgtncggnnctacgcgaccggtctccacgccagccaccccgtactncaacgtcccgtcgctggcgaccgggaaacggcggtgccgttggccgtgcangcgggcgntgcttggtgtaagcggggggcgggcgcggcggccggaacttggttgcgtggcccaaccaaagccggaacccaaaccgcctttaaagtccccccttgaataacccccgggggattatggggccaaattgtccgccaaatccaaaagggggggggaggggttttttaacccccaaaaccgggcaaaaaacaacgggggtttaaacctttttaaaaggttatccaacaaaaaaaaacccccccccccacccttgtggaattttttgggggggggggcccccatacccaacacgggtcccgcgggtggg

SEQ ID NO: 25879 - protein, 68 aa, Zea mays
  misc_feature: Ceres CLONE 1397997-F
  misc_feature (2)..(2): Xaa is any aa, unknown, or other
  misc_feature (4)..(4): Xaa is any aa, unknown, or other
  misc_feature (16)..(16): Xaa is any aa, unknown, or other
  misc_feature (33)..(33): Xaa is any aa, unknown, or other
  misc_feature (36)..(36): Xaa is any aa, unknown, or other
MXGXTRPVSTPATPYXNVPSLATGKRRCRWPCXRAXLGVSGGRARRPELGCVAQPKPEPKPPLKSPLE

SEQ ID NO: 25880 - DNA, 707 bp, Zea mays
  misc_feature: Ceres CLONE 1398003-F
  misc_feature: Encodes the peptide sequence at SEQ ID NO. 25881
aaagctggagctccccgcggtggcggccgctctagaactagtggatcccccgggctgcaggaattcgcacgagaccattacctagaacatcctaatcaaaaaactacatactgctgcgcgctagcggtagcgctcgcactcgcaccacgccaccgctgctgcctgctcctcacagtcctccccgcgctcgcattgcgattcgcgacctagcgcgagggtaccgggtggggtggtgcgcgcgcgtgctcggtgatccgggaagcgccgcgagatggccgtcggttgcaggcggcgctgacgcgccgaagcacgacgacttcacgccgcagcccggcaaggagcacctccctggggtctcctactgcatcaccaggcctcccccgtggtcggaagacgatcttcttgcgtgccagcagtatctggccatgcttggcaccactgagatcataccaactgcacttgttccgcacatgggaggaaacaatgaggacaaagcagagcgtattcacacattgctgttgcgtgcaggtatcaacaccctcctgcatagtatctttggtaccatgttgcctgcagtgatcggcgagtcatacacctttgttctgcctaccatttcgatcatccttgctggacgttatgctaatgaacctaatccacatattacatttctccgcatcatgcgtgggacacaagggagcgttgagtgt

SEQ ID NO: 25881 - protein, 94 aa, Zea mays
  misc_feature: Ceres CLONE 1398003-F
MLGTTEIIPTALVPHMGGNNEDKAERIHTLLLRAGINTLLHSIFGTMLPAVIGESYTFVLPTISIILAGRYANEPNPHITFLRIMRGTQGSVEC

SEQ ID NO: 25882 - DNA, 681 bp, Zea mays
  misc_feature: Ceres CLONE 1398007-F
  misc_feature (223)..(223): n is a, c, t, g, unknown, or other
  misc_feature (279)..(279): n is a, c, t, g, unknown, or other
  misc_feature (315)..(315): n is a, c, t, g, unknown, or other
  misc_feature (317)..(317): n is a, c, t, g, unknown, or other
  misc_feature (318)..(318): n is a, c, t, g, unknown, or other
  misc_feature (364)..(364): n is a, c, t, g, unknown, or other
  misc_feature (372)..(372): n is a, c, t, g, unknown, or other
  misc_feature (497)..(497): n is a, c, t, g, unknown, or other
ggagctccccgcggtggcggccgctctagaactagtggatcccccgggctgcaggaattcgcacgagaccattacctagaacatcctaatcgaaaagggacccgatccctctccttctctgacccgacccgaccaatccaatccatcccctctccatctcccatgaccatgaacagcggctcggcaatatactactgctaggttatgctactccattacgaanaagcgcagaaagagcgcagaatggaatcgtcgctcttatcatactccatgactccntcactagactagagagagaaacccttgtaccctttngnntctgttatccccccatttctcgagtcacccacccatcggcgaattncgaggccnaggaagcggagcccccgaagaggggaatattggcttttcccgccggggccctagggaacaggaaaaatccacggggggcgggggcaaacgggggcggggtggggaaaacggcccagggggggtcngggaaaccccgggccttttgggttacccccccccccccggctcggggggcagggggccccccccaaaatcccgggggggggaaaaaaatcttccccccaaggggccctttctaagggaaattggggcggcgggggaaagaattttaaaggggccggccccccctatatatacccgtgggggggg

SEQ ID NO: 25883 - DNA, 649 bp, Zea mays
  misc_feature: Ceres CLONE 1398011-F
  misc_feature: Encodes the peptide sequence at SEQ ID NO. 25884
aagctggagctccccgcggtggcggccgctctagaactagtggatcccccgggctgcaggaattcgcacgagaccattacctagaacatcctaatcgaaaaatcacttatcatccccatccgcacctctctccatctccctgctcctccgccttcttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgaggaggtttctacctcaaagactggtaagcatggtcatgccaaatgccactttgttgccatagatatattcaacgggaaaaagctcgaagatattgttccttcgtcacacaactgtgatattccgcatgtgaaccgcactgagtatcagctgattgatatatcagaggatggatttgtgagccttcttacttcagatggcaacactaaggatgatcttagactcccaactgatgagactcttgtggcccagatcaaggaagggtttgaaagtggcaaggacgcgcgcgcacgaacgggtcgctctctctccgacacccagatccctcccgtttca

SEQ ID NO: 25884 - protein, 155 aa, Zea mays
  misc_feature: Ceres CLONE 1398011-F
  misc_feature (86)..(155): Pfam Name: eIF-5a Pfam Description: Eukaryotic initiation factor 5A hypusine, DNA-binding OB fold
  misc_feature (30)..(64): Pfam Name: KOW Pfam Description: KOW motif
MSDSEEHHFESKADAGASKTYPQQAGTVRKNGFIVIKNRPCKVEEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDARARTGRSLSDTQIPPVS

SEQ ID NO: 25885 - DNA, 695 bp, Zea mays
  misc_feature: Ceres CLONE 1398012-F
  misc_feature: Encodes the peptide sequence at SEQ ID NO. 25886
aaagctggagctccccgcggtggcggccgctctagaactagtggatcccccgggctgcaggaattcgcacgagaccattacctagaacatcctaatcgaaaaaaggtgttttgccctcttcttcgcgagcccccccgccgcaaccagcagccgcatcgggagacccgcagccgccgatggcgaagaagcacagggacccagcctctgaggccgcgagcggcgactccccggccgtgtccatccgctccctcttctccgcggacaacccgttccgccggaaggcctctacggaggagccccccgcgactcctgcacccgccacgacgcccctccccatgcaacccagccgtgacgccagggatgccgagccgtcctcgaagaagaataagaagagcaaggaggagggcccgcggcgcaagcggaagcgggacgagttggaggccggccgggagcggcggcgaggcgcggagaatccgtcgagagttggggagaagaggaaggctcccgacgacgcggcacagggggtcggggaggaacaggaggaggcgtccgacgaccagaagcagctgctcaggaccgcgcccgtgagggaactgccgctgcgaaccaacggccaggggccctccagggggttgtgtatctcgcgagatcgacgcctgcaggatcgaccccgtgccggtgcccccacacacacc

SEQ ID NO: 25886 - protein, 173 aa, Zea mays
  misc_feature: Ceres CLONE 1398012-F
MAKKHRDPASEAASGDSPAVSIRSLFSADNPFRRKASTEEPPATPAPATTPLPMQPSRDARDAEPSSKKNKKSKEEGPRRKRKRDELEAGRERRRGAENPSRVGEKRKAPDDAAQGVGEEQEEASDDQKQLLRTAPVRELPLRTNGQGPSRGLCISRDRRLQDRPRAGAPTHT

SEQ ID NO: 25887 - DNA, 719 bp, Zea mays
  misc_feature: Ceres CLONE 1398014-F
  misc_feature: Encodes the peptide sequence at SEQ ID NO. 25888
  misc_feature (684)..(684): n is a, c, t, g, unknown, or other
aaagctggagctccccgcggtggcggccgctctagaactagtggatcccccgggctgcaggaattcgcacgagaccattacctagaacatcctaatcaaaaaactgcagcagtgctcctcctcctccaccaccacctcggtccatctcactctcacaggctccaattggcatctcgtctcgcgctcgctttccccagtccactcgcgctctcgtttcccggagcttcacgatgcagcgccttctcgcgctggtggcagccctgctggtgctgctggagtcgcgtccagcgctggccaccgacccctacgccttcttcgactgggacgtctcctacggcactgcggtgccgctcggcgtcaagcagcaggtgataggcatcaacggcaagttcccagggcccgtcgtgaacgtcagcaccaactggaacgtcgtcgtcaacgtgctcaacgacctcgacgagcccctcctcatcacctggaacgggatccagcaccggaagaactgctggcaggacggggtgctcggcaccaactgtcccatcccgcccggctggaactggacgtacgagttccaggtgaaggaccagatcggaagcttcttctacttccccatctgcagcgcgccgccggcggcttcggcggaatcgtcgtcaacaagcgcgacgtcatcagcgagcccttcgnccgccccgacggagacgtcaccatcttcatcgggg

SEQ ID NO: 25888 - protein, 163 aa, Zea mays
  misc_feature: Ceres CLONE 1398014-F
  misc_feature (32)..(135): Pfam Name: Cu-oxidase_3 Pfam Description: Multicopper oxidase
  misc_feature: SWISSPROT Homolog: EC 1.10.3.3 L-ascorbate oxidase
  misc_feature (152)..(152): Xaa is any aa, unknown, or other
MQRLLALVAALLVLLESRPALATDPYAFFDWDVSYGTAVPLGVKQQVIGINGKFPGPVVNVSTNWNVVVNVLNDLDEPLLITWNGIQHRKNCWQDGVLGTNCPIPPGWNWTYEFQVKDQIGSFFYFPICSAPPAASAESSSTSATSSASPSXAPTETSPSSSG

SEQ ID NO: 25889 - DNA, 712 bp, Zea mays
  misc_feature: Ceres CLONE 1398022-F
  misc_feature (416)..(416): n is a, c, t, g, unknown, or other
  misc_feature (544)..(544): n is a, c, t, g, unknown, or other
  misc_feature (606)..(606): n is a, c, t, g, unknown, or other
aagctggagctccccgcggtggcggccgctctagaactagtggatcccccgggctgcaggaattcgcacgagaccattacctagaacatcctaatcgaaaaaaaggtacacatcatctcttccaaatcccaccagcaaatccccaattcctccgagttcgagcgaccatgtcggggcgtggcaagggcgggaagggtctgggcaaaggcggcgcctagcgtcaccgcaaggttctccgcgacaacatccagggcatcacgaagccggcgatccggaggctggcgaggaggggcggcgtgaagcgcatctcggggctcatctacgaggagacccgcggcgtgctcaagatcttcctcgagaacgtcatccgcgacgccgtaacctacacggagcacgcccgccgcaagaccgtcacngccatggacgtcgtctacgccctcaagcgccagggtcgcaccctctacggattcggcggctgagaggcgctaccgccgctggtggccgtggcaaaagtctttgggtcgcggtcaagaaatcgagagtnattctggatgacgtgctttagtttcgtagtattattatcactagtgtttattggtagcgggnttggttgggttcgaccactctaagccactgtcaaacagtaatatgagtaccgccattttccgtgtttcgaacttctaacaaaaaaaaaaaaaaaaagttatcgtcc

SEQ ID NO: 25890 - DNA, 762 bp, Zea mays
  misc_feature: Ceres CLONE 1398023-F
  misc_feature: Encodes the peptide sequence at SEQ ID NO. 25891
  misc_feature (409)..(409): n is a, c, t, g, unknown, or other
  misc_feature (453)..(453): n is a, c, t, g, unknown, or other
  misc_feature (483)..(483): n is a, c, t, g, unknown, or other
  misc_feature (536)..(536): n is a, c, t, g, unknown, or other
  misc_feature (592)..(592): n is a, c, t, g, unknown, or other
  misc_feature (593)..(593): n is a, c, t, g, unknown, or other
  misc_feature (624)..(624): n is a, c, t, g, unknown, or other
  misc_feature (625)..(625): n is a, c, t, g, unknown, or other
  misc_feature (639)..(639): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (658)..(658): n is a, c, t, g, unknown, or other
aaagctggagctccccgcggtggcggccgctctagaactagtggatcccccgggctgcaggaattcgcacgagaccattacctagaacatcctaatcgaaaagtgagaaacaaagaccatgacgcaggagaagacggtggtgctgtacccctccctgggcgttggccatctgaaccccatggcgcagctggccaaggccatcctccgccacggcagcgtcgccgtcaccatcgccgtcgtcgacccgcccgagaagcacgccgtgctagctgctgcgctggcccgcctggcagcggtcagtccctccatcacggtccacctcctccccatcccgccctgcgccaccagcaagcagcattcccaccccatcatgcccattcctggatgcgctccgcgccgcgaaccccgngtctccgtggcgttccttgccgcgcgagtccctgccgtcgccgnccctcgtggtcgacatgttctgcaccacgncgctcgacggtcgccggggaagctcgcgatcccccgcgcacttcttctaccgntccgcggcgggggaaacccctcgcgtcttacctccaaggttccaggatctctgcgnnggccgcgccgtcccccgctaagggacatggnncaaaggcggcgttnaacctttcgcgnnnnnggncccggcggtcgggggcttctcgacatgcccgacaccatgcaacgactgggaaaaagcgcacgtgggcaagcgtacggctgcggcagctttcgccgggatgcccg

SEQ ID NO: 25891 - protein, 214 aa, Zea mays
  misc_feature: Ceres CLONE 1398023-F
  misc_feature (112)..(112): Xaa is any aa, unknown, or other
  misc_feature (122)..(122): Xaa is any aa, unknown, or other
  misc_feature (140)..(140): Xaa is any aa, unknown, or other
  misc_feature (159)..(159): Xaa is any aa, unknown, or other
  misc_feature (169)..(169): Xaa is any aa, unknown, or other
  misc_feature (174)..(174): Xaa is any aa, unknown, or other
  misc_feature (178)..(178): Xaa is any aa, unknown, or other
  misc_feature (179)..(179): Xaa is any aa, unknown, or other
MTQEKTVVLYPSLGVGHLNPMAQLAKAILRHGSVAVTIAVVDPPEKHAVLAAALARLAAVSPSITVHLLPIPPCATSKQHSHPIMPIPGCAPRREPRVSVAFLAARVPAVAXPRGRHVLHHXARRSPGKLAIPRALLLPXRGGGNPSRLTSKVPGSLRXPRRPPLRDMXQRRRXTFRXXGPGGRGLLDMPDTMQRLGKSARGQAYGCGSFRRDA

SEQ ID NO: 25892 - DNA, 840 bp, Zea mays
  misc_feature: Ceres CLONE 1398025-R
attgggtaccgggccccccctcgaggtcgacggtatcgataagcttttttttttttttttttcctgcagaggaatgagctcttattctaggatgattggcaatgaacaaagtcatgcgatatcattacaatttacaagaataaatttgaccaaccattacattacatctatatgtataacagctctacgagaagttacggtattcgaccttgtgatagacatcccaggtagtataaaaagttgaaaaaaataatgattcaggagcctggaccatgattatttgctgggaaacacttctaatttgctcagtttccaagaaaatggttatttggtcttggaaattcttgtaaatttctggtggaacttgtggaatcagtccatctctttacttttgcaaaagaaaatcctttttccactgataaaaatttatgaaatgacaatgggctgtaccacttaaaagcagcccttttattttacaatccactcacatgaagtacgccagaattttggttaagatcaatgtgtagaagatagataggacaggaccaactggaattgtgaccaaccaggacgccacaatttcgcgaactgtctctgccctgactctattgagccctcttgcaaacccgaggcccatgaccgctccaacaagtgtatgcgtggcagatataggcaacccgagctttgatgcgaacaagactactgaagctgctgaaaactctgcggcaaagcccctggtaggtgttacgtcagtgatcttcttagcaattgatgctatcaccctgtatccctcacattgtgagcccagcaacaaatccgaaaacacccccagcaagaact

SEQ ID NO: 25893 - DNA, 638 bp, Zea mays
  misc_feature: Ceres CLONE 1398028-F
  misc_feature: Encodes the peptide sequence at SEQ ID NO. 25894
  misc_feature (487)..(487): n is a, c, t, g, unknown, or other
tccccgcggtggcggccgctctagaactagtggatcccccgggctgcaggaattcgcacgagaccattacctagaacatcctaatcgaaaaagcggagcactgtgcaggcgaccgcggcgcgctatcacttacggggggatacggcggcatcgtccccctcggcccctcctccatccctggtgcggcggcgccagcctgcaggtgttgaatgctgatttgttgtggctgattaatcgggttgatcgtcgattaatcgtgattagtcggctgatcgcccttctggcgatcagaaacgataaggcaatctgaaaacattggccgccaaacctccagagcgactcctgcgagccgtgaccaccatagctaaatcaacgcaccagaagctttcacggagctgtctcgtccacgagtgttccagctgactcctattccctgcgtcaatggcgagctctggcaatgaagggcgtggtggtggtggaccttggnctccgcggcggagtcggtggctggctgacgaggaggcgcacgccacgcctctccacgagattgagtccctttgcatgcgctgcggcgagaacggcatcacgaggcttttggctgacgttgacccgacttccccgggaagggtggttctgat

SEQ ID NO: 25894 - protein, 65 aa, Zea mays
  misc_feature: Ceres CLONE 1398028-F
  misc_feature (16)..(16): Xaa is any aa, unknown, or other
MASSGNEGRGGGGPWXPRRSRWLADEEAHATPLHEIESLCMRCGENGITRLLADVDPTSPGRVVL

SEQ ID NO: 25895 - DNA, 743 bp, Zea mays
  misc_feature: Ceres CLONE 1398030-F
  misc_feature: Encodes the peptide sequence at SEQ ID NO. 25896
aagctggagctccccgcggtggcggccgctctagaactagtggatcccccgggctgcaggaattcgcacgagaccattacctagaacatcctaatcgaaaaacactacaatactgctgcgcgctagcggtagcgctcgcgctcccactcgcaccacagcacgccaccgctgctgccggctcctccccgcgctcgcattgcgatttgcgacctagcgcgagggtaccgggggtggtgcgcgtgctccgtgatccgggaagcgccgcgagatggccgggggcggaggcggcggtgccgcgccgaagcacgacgacttcacgccgcaccccgtcaaggaccagctccctggggtctcctactgcatcaccagccctcccccgtggcctgaagccgttcttcttgggttccaacattatctggtcatgcttggtaccactgtgatcataccaactgcacttggtccacaaatgggaggaaacaatgaggacaaagcagtggttatccagacattgctgttcgttgcaggtatcaacaccctcctgcagagtttctttggtacatgttgcctgcagtgatcggcgggtcatacacctttggtctgcctacatttcgatcatccttgctggacggtatgctaatgaacctaatcacatattaaattctcggcatcatgcgtgggacacaggtgcgttgatggtggcttcagcctacaggatatagttggctcagtggcccttggcggaa

SEQ ID NO: 25896 - protein, 101 aa, Zea mays
  misc_feature: Ceres CLONE 1398030-F
MAGGGGGGAAPKHDDFTPHPVKDQLPGVSYCITSPPPWPEAVLLGFQHYLVMLGTTVIIPTALGPQMGGNNEDKAVVIQTLLFVAGINTLLQSFFGTCCLQ

SEQ ID NO: 25897 - DNA, 729 bp, Zea mays
  misc_feature: Ceres CLONE 1398036-F
  misc_feature: Encodes the peptide sequence at SEQ ID NO. 25898
  misc_feature (1)..(1): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (54)..(54): n is a, c, t, g, unknown, or other
nttttccccggccccccccnnnccccccttgggggtatttgctnnngggaattnttcaaagctggagctccaccgcggtggcggccgctctagaactagtggatcccccgggctgcaggaattcgcacgagaccattacctagaacatcctaatcgaaaaaccaacgcggtcttcggcgcgaccccctccccatctccctcctccctaccatgcgcgagggcgaggcccacgcccacgccctcccgacgaaaacccagctactcccgtgcctcaaagatgacgagccgcgacaaggtggggtgctcctcgatcccgctgcccctcgaccgtgtgcttgccgcgctggtcgccaggacccagcaactcgggagggggtgcgaggcggacttccgcgtccgatgcgggaaggtagcttggagcgctgctcgggggaggcggaggggaaaggagaggttatagagatgcacacgccgctgttctacgctacctgcgcccttcggcggggttctcagcacccggggctccctcacctcggctgtaacgccgctctaccctcgtcaagggcataaagggcaggggggatcccagcaaggtaccggggaacattaccatctggccccttggggggcatggcccccatggaggcaagggaccccccggggggtttggatcccaggggagaaggcgaggggaccacacccgggggttgggagtaaacagactgggcc

SEQ ID NO: 25898 - protein, 60 aa, Zea mays
  misc_feature: Ceres CLONE 1398036-F
MTSRDKVGCSSIPLPLDRVLAALVARTQQLGRGCEADFRVRCGKVAWSAARGRRRGKERL

SEQ ID NO: 25899 - DNA, 675 bp, Zea mays
  misc_feature: Ceres CLONE 1398037-F
  misc_feature: Encodes the peptide sequence at SEQ ID NO. 25900
  misc_feature (537)..(537): n is a, c, t, g, unknown, or other
  misc_feature (655)..(655): n is a, c, t, g, unknown, or other
aaagctggagctccccgcggtggcggccgctctagaactagtggatcccccgggctgcaggaattcgcacgagaccattacctagaacatcctaatcgaaaaacgctcgtctgtgtctgcctactccctcctccggctcccgcgaagcgactccaagaagcagcaggagcgtcgagctcgagcagcagccatggatggcgaggaggttggcaggaggggtattcctactctgctgaagccgtcttcctcctccagcgatggcagtgccggggaacaagagcacatcgcttctgacgtcactcaggtgctaccctctcttgccacccaacctttttggctctaatctcctccctgctcccgtttgttgctgctgctactagtggttgaattagagatttgactgttcttgcgcaacggtttccctcagctcataggatggacgccgctggtcgaattgaagcgaatcgccagcgaggctgggatcgatgcgcggatcgtcggcaagatggaggcttaccagccactttgctccatcanggaccgctctgctttgagaatgatagaggatgccaggagaggggattgatttcgcctggagtcacaacgctggtggagccgacgagtggtacatggggttaggggtggtcctcttcgnctatcagagaggttacaggt

SEQ ID NO: 25900 - protein, 50 aa, Zea mays
  misc_feature: Ceres CLONE 1398037-F
MDGEEVGRRGIPTLLKPSSSSSDGSAGEQEHIASDVTQVLPSLATQPFWL

SEQ ID NO: 25901 - DNA, 633 bp, Zea mays
  misc_feature: Ceres CLONE 1398040-F
  misc_feature: Encodes the peptide sequence at SEQ ID NO. 25902
aaagctggagctccccgcggtggcggccgctctagaactagtggatcccccgggctgcaggaattcgcacgagaccattacctagaacatcctaatcgaaaaatcacacactaatcaacaagcaggaccagctagctagctcctctcactgctatcacccgcccagccatctcgctgaaagagaaaagcgcacccatgaagactactagctcgggcattgcagtcgtcctactggtggccatgctggcagtccattccgcgttggccgaatctcgtgctccgacgtgctcacgacctgtcgcgtgcctgcccttcctgcagggcaaggagccaaaccagggagagcaacacccaggcttgaacgggggggaggccctggaaccgggggggggaaccccggcccgaaagggagggccaggggccggggccccagggcgggctccgtttagggcccccgtggggtattcccgcggggaccgaagccttccccgggactatggggtttttttttgtgtttcacacttccccccccccccccgcctttggtcccaatatgtaaaaaaagggagcgtgttgtggtcctctccctgcgtgccttcacctcacgccgcgaggcccctctgcaccccaccg

SEQ ID NO: 25902 - protein, 146 aa, Zea mays
  misc_feature: Ceres CLONE 1398040-F
MKTTSSGIAVVLLVAMLAVHSALAESRAPTCSRPVACLPFLQGKEPNQGEQHPGLNGGEALEPGGGTPARKGGPGAGAPGRAPFRAPVGYSRGDRSLPRDYGVFFCVSHFPPPPRLWSQYVKKGSVLWSSPCVPSPHAARPLCTPP

SEQ ID NO: 25903 - DNA, 1687 bp, Zea mays
  misc_feature: Ceres CLONE 1398048
  misc_feature: Encodes the peptide sequence at SEQ ID NO. 25904
gaggaagttcagttccgtgccgtgctcgcgcgcacccaccccgcacgccgcatgccgccttactccgcgctgctgctgctgctgggacgaagaaaatcttttccttcacctttctctcctctttcccagttcatgcacgggctctgattgacgccatgggggatgccgccgccgccgcaacggcctccacgtccgctcccgccacgcccacctccatcctcatctgcctggaggacggcagcgaccttctctccgacgcctacgatggcgccggcgccaccgacttcgtcgtcgcccgcgacgagcatctgcttgtcgaggaccaggacgaggagtacgtcgcgctgctcctgtccaaggagagcgcggcagtatgcgccccggcggaggaggaaacggaggagtggatgaagaccgcacgctccggatgcgtccgctggatcatcaagaccacggcgatgttcgggttcggcgggaagaccgcgtacgtcgcagtgacttacctcgatcgcttcctggttcaacggcgagtcaatagggggaacgagtgggctttgcggctgctcacggtggcgtgcctgtcgctggcgatcaagctggaggaggagcacgcgccgcggctgtcggagttcccgctagacgaggacgagttcgacagcgcgtccatcctgcggatggagctcctcgtcctgggcaccctcgagtggcggatgatcgccgtcacccccttcccctacatcagctacttcgcggcgcggttccgggaggacgagcgccgggcgatcctcatgcgcgccgtggagtgcgtcttcgcggcgatcaaagtgataagctcggtggagtaccggccgtcgaccatcgccgtggcatccatcctcgtcgcgcgcggccgggaggagactcccgccggcagcctggacgcgctcaaggcgatcctggggtcatcgtgcccgcaactagacaccgggcacgtgtactcctgctacagagcgatggttcgggaggacgacaagtcgccgacgcactcgacgtcgacgggggtggcgtcctcgggcgtctctgtcgccgggaacgggagccccagcccgggcgccaataatgccgctggctccggcccgcctgcaaccctggatagccacaagcacaaccacaaccagaggagacggttgcgctcacctcagcgacagtaggaggctataggagctgctgggcagtgcagttgcagtccagctgcatttttcagctcaccattttctttttgctaccgattgtttgtttcttcaggggtggccagaatgcccgaatccaagcgggggcgagatctgattcttcgggttagtgcggtgtcgcagggtgatctggtgatttagtgtcggaaagatcttttgttttgtggagatcttttcccgggatcaaagtgggagggcagtgtaaagactagaccaaagctgaaacagagcaaagctcttgctcaaagcgccaaggcctcagacggtcagacctcacagggtacctaccgaggtgaaagtgatgtcaggagtcggaagtcaattttttttttttgtgtgtgtgaatgccgtctgtaccagctagtccgtctgtctgtcctctatctttctctgattattaaatagcctgtctgtcactgcatcagtggcaaccgttaaccaaaaaaaaaaaaaaaaaa

SEQ ID NO: 25904 - protein, 344 aa, Zea mays
  misc_feature: Ceres CLONE 1398048
  misc_feature (60)..(187): Pfam Name: Cyclin_N Pfam Description: Cyclin, N-terminal domain
MGDAAAAATASTSAPATPTSILICLEDGSDLLSDAYDGAGATDFVVARDEHLLVEDQDEEYVALLLSKESAAVCAPAEEETEEWMKTARSGCVRWIIKTTAMFGFGGKTAYVAVTYLDRFLVQRRVNRGNEWALRLLTVACLSLAIKLEEEHAPRLSEFPLDEDEFDSASILRMELLVLGTLEWRMIAVTPFPYISYFAARFREDERRAILMRAVECVFAAIKVISSVEYRPSTIAVASILVARGREETPAGSLDALKAILGSSCPQLDTGHVYSCYRAMVREDDKSPTHSTSTGVASSGVSVAGNGSPSPGANNAAGSGPPATLDSHKHNHNQRRRLRSPQRQ

SEQ ID NO: 25905 - DNA, 739 bp, Zea mays
  misc_feature: Ceres CLONE 1398049-F
  misc_feature: Encodes the peptide sequence at SEQ ID NO. 25906
  misc_feature (468)..(468): n is a, c, t, g, unknown, or other
  misc_feature (636)..(636): n is a, c, t, g, unknown, or other
  misc_feature (661)..(661): n is a, c, t, g, unknown, or other
  misc_feature (679)..(679): n is a, c, t, g, unknown, or other
  misc_feature (712)..(712): n is a, c, t, g, unknown, or other
aaagctggagctccccgcggtggcggccgctctagaactagtggatcccccgggctgcaggaattcgcacgagaccattacctagaacatcctaatcgaaaaccatatatcccttcctcgtatatcctttcctgagtaggagagagagttgagttaggagttgttgtgctgatcatctcggtcgaccgagagatggaccaccacctcactgagatagaggggaagatggcgcacgagccactggcacacagctccaccttctccgatgagacgaaagacaaaatggagcacgattcactggtgtacagtccacgcagcatcgcgagggccacaaccaccggcatccctgtcggcgatcaaggcgtggccgtgctacgtgggccgcttatcgtgggtgcagggccgcgcgggtctggcatggcgcggcgttgctcaccatgttatacattccctacgtgctcctagagncgcgacgtgtgcgtagcctcaatgtggcaccgccgacgtacccggcagggttgtgtctgcacctacccaagcgctactgtgagctcccgctcatgcacttcccacgcacctaccccaatatccaccccggcagcagttccttgtctacctcaatgagtacatgcgcgncatttggcatccgcccattttcagnccctcgaggttgtcgtgncgaaagtacacggtgaaaaaactcgtgtgtcgnccacaaagatgtcatccccactggcac

SEQ ID NO: 25906 - protein, 90 aa, Zea mays
  misc_feature: Ceres CLONE 1398049-F
MDHHLTEIEGKMAHEPLAHSSTFSDETKDKMEHDSLVYSPRSIARATTTGIPVGDQGVAVLRGPLIVGAGPRGSGMARRCSPCYTFPTCS

SEQ ID NO: 25907 - DNA, 735 bp, Zea mays
  misc_feature: Ceres CLONE 1398054-F
  misc_feature: Encodes the peptide sequence at SEQ ID NO. 25908
  misc_feature (1)..(1): n is a, c, t, g, unknown, or other
  misc_feature (20)..(20): n is a, c, t, g, unknown, or other
  misc_feature (21)..(21): n is a, c, t, g, unknown, or other
  misc_feature (26)..(26): n is a, c, t, g, unknown, or other
  misc_feature (27)..(27): n is a, c, t, g, unknown, or other
  misc_feature (31)..(31): n is a, c, t, g, unknown, or other
  misc_feature (33)..(33): n is a, c, t, g, unknown, or other
  misc_feature (37)..(37): n is a, c, t, g, unknown, or other
ntttcccccccccccccccnnccccnntaanantatnaggagtgtggggcaaagctggagctccaccgcggtggcggccgctctagaactagtggatcccccgggctgcaggaattcgcacgagaccattacctagaacatcctaatcgaaaaatctagtcatctcgtctcaggttgcggccgaaccagagccccgtcccaactccaccacctctcttctctacggcgcgagcaagggcggcgccggccgcggcgtcggcgggaaccgggcctcgctctccccatctctccgatcacttctgtcctgtgaaaatggcggatgaactacgctcaacgtctgtgggtcagaagttccatgggcagtccgtgctgttgagcagaatctcttcctattccgccatgaacaaccctgtattcaacaatgcctattctgcttacaatgtgccccagaggtcatatcatgggatgaatgcaactgctggactctcatctgtcatggcaccatctcctgtctttgcttctgccccaaaagagaaaggcttttctggatttatgatcgactttatgatgggtggagtttctgctgctgtctccaagacagctgcagctccgattgagggtgtcaagcttttgattcacaacccagaatgaaatgctccagacttggcaggcctttcctgaacccgtacaaggggtattgggggactggctttgggccggaacaatcaggaggag

SEQ ID NO: 25908 - protein, 112 aa, Zea mays
  misc_feature: Ceres CLONE 1398054-F
MADELRSTSVGQKFHGQSVLLSRISSYSAMNNPVFNNAYSAYNVPQRSYHGMNATAGLSSVMAPSPVFASAPKEKGFSGFMIDFMMGGVSAAVSKTAAAPIEGVKLLIHNPE

SEQ ID NO: 25909 - DNA, 781 bp, Zea mays
  misc_feature: Ceres CLONE 1398057-F
  misc_feature (1)..(1): n is a, c, t, g, unknown, or other
nttccccccccccccccccccccccccctatttataataatatttaacaaaaagctggtgctcaccgcggtggcggccgctctagaactagtggatcccccgggctgcaggaattcgcacgagaccattacctagaacatcctaatcgaaaactctcatccgaattcccaggcaggcaggtcggcgaggagggcaggaagaccgaagaccgagccgtgcgggggctcgggacgggaacgggacaggaccccaaaatctcagatccttcctgcccgcccgcccgtgcccgtcgacgcgtcgttcttgccggccgagccccacctccgccctctcctcctccagggggatcggatacgccacaggctgcgcgatggtgctgtgggtcttcggctacgagctccctcatctggaaccccggcttcgacttcgacgcacgaaatcctcggcttcatcaagggctacaagcgcacctttattctcgcttgcattgaccaccgaggcaccccgcacaacttggcgaggaccttgcacgcttgaaaccgacgacgagggccatatgcctgcgggaatggcaaaccgcggccaaggccgggtccctgcatatagaagctaccgcgctacacccgccacttgggaacagaaacacgcaacggggattaacgaccgagataagatatacccattggcatctccccaccaaggggaagagacgactcccctatggaaaccccaggctggtggaagggggcgggtcctctaggaggtctttctattccccccc

SEQ ID NO: 25910 - DNA, 755 bp, Zea mays
  misc_feature: Ceres CLONE 1398059-F
  misc_feature: Encodes the peptide sequence at SEQ ID NO. 25911
ggagctccccgcggtggcggccgctctagaactagtggatcccccgggctgcaggaattcgcacgagaccattacctagaacatcctaatcgaaaaacatcccagttggaagggcagccaataaggtaaggggtgacgaaaatggttcctacgaccgccaccaaggacgacagtggttacggcgacgagcgccggcgcgagctgcaggcgttccacaactcgaagctggtggtgaaaggtctggtggactccggggccaagaccatcccgtccatcttccaccacccgccggaagccctgaacgacataatttctccggcgcctcttgcggcgtggccaccctccggtgccgccatcccggtggctggacctctcggtggagcgcgggccaggacctaatccgagcaaggaaaaggaccccggcccgggaaggggggggttcccttccgggctgggtgcaaccaggccctgggggaaaagaaatttaatggggcggctttggttcccccggggggggccccctttttcaaacaagggccccccggggagaggcaaaggcaagccctctttctcccccggggccccgggttccccaaccggggggttttcccctcccaatttctcaacctttttaaaggcccctttgggccacacggggggaaaaccccctctctttgggaggagggtcccccaaccccccccccccgtaaaaaaaactccttcccccctataaaacaatgttcctttcatccccc

SEQ ID NO: 25911 - protein, 85 aa, Zea mays
  misc_feature: Ceres CLONE 1398059-F
  misc_feature: SWISSPROT Homolog: EC 1.14.11.20 Desacetoxyvindoline 4-hydroxylase
MVPTTATKDDSGYGDERRRELQAFHNSKLVVKGLVDSGAKTIPSIFHHPPEALNDIISPAPLAAWPPSGAAIPVAGPLGGARART

SEQ ID NO: 25912 - DNA, 658 bp, Zea mays
  misc_feature: Ceres CLONE 1398060-F
  misc_feature: Encodes the peptide sequence at SEQ ID NO. 25913
  misc_feature (299)..(299): n is a, c, t, g, unknown, or other
ggagctccccgcggtggcggccgctctagaactagtggatcccccgggctgcaggaattcgcacgagaccattacctagaacatcctaatcgaaaagacttcatactgctcgcctcgccgtctttcccccaatctgttgctcctccaagctgcgggcgatcgccgtaccccggccgccgcagggaaccccctcgccatggccttgcaggggaagaagctcatcaacaaccccgacgatgtggtgacggagttcatcgaagggttggtggagacttacccgggtctgcagtacctcgacnggttccctcagattaaggtcgttcttcgtgctgatgtccagcgcggttcctatgacaaagtgcagtcatctcgggtgggggaagtgccatgaacttcccatgctgaatttgtttggccaggaagttgacactgctggttctggaaatgttttcgcctctccccctgttgaatccatttaagctggcatttcaaggtggactggggccccggggggggcctttcaaaagaaaaaaaacaccctggggggaaaaaacccaatttttggaaaaagcggggggggaagggaaaaattttgggagggtttaaagaaaggggagtgggtcctttgtggggagaaaaaatttggggcccctttccc

SEQ ID NO: 25913 - protein, 64 aa, Zea mays
  misc_feature: Ceres CLONE 1398060-F
  misc_feature (35)..(35): Xaa is any aa, unknown, or other
MALQGKKLINNPDDVVTEFIEGLVETYPGLQYLDXFPQIKVVLRADVQRGSYDKVQSSRVGEVP

SEQ ID NO: 25914 - DNA, 671 bp, Zea mays
  misc_feature: Ceres CLONE 1398061-F
  misc_feature (565)..(565): n is a, c, t, g, unknown, or other
  misc_feature (583)..(583): n is a, c, t, g, unknown, or other
  misc_feature (630)..(630): n is a, c, t, g, unknown, or other
tggagctccccgcggtggcggccgctctagaactagtggatcccccgggctgcaggaattcgcacgagaccattacctagaacatcctaatcgaaaaatcgatcgtccttcctgtcgtttcgttttctcgccggcagggcactgggtacgccgccgccgcctcaacgccaccacgctgccgccgcgccagttcgtcaccgcgagacacaagacacgtgcctcgcttccctcgggccggttggccgtggccggccgtcgctgttctgttcctatttcttggcaactccgcccgtttcacctccggaggaccgacagcgacggcgccagtagatagatgcactactgacgccactggccacctcgagttcgagtgccaagggacgccacgagaccaaccgtgaggacaggacaacggtcgcctttgcccgcggatccgcggatttcgtcttcttgggtgccatggatccagtcgccggcacggcggagcatcggggccccgttggaagtgcgcgcccgcgcgcccggcagacaaatcctcgcgggcgagcacgccgtcgtccacggnttccgccgccgtcgccgnctgccatcgatctctacaccaactcctccctcctctcccgccccgangcccaaggagatggggggcggcgctgctttccggcgcgggg

SEQ ID NO: 25915 - DNA, 601 bp, Zea mays
  misc_feature: Ceres CLONE 1398068-F
tggagctccccgcggtggcggccgctctagaactagtggatcccccgggctgcaggaattcgcacgagaccattacctagaacatcctaatcgaaaaatatctatatctggattgttccggccctcccccttcttcgattttgtgggcggcttctctctctttttttcttcttcctgttgatgtgcgaatttagaggggataagagcttttggggggaatctgatggaatccgatcgattttctcgccgttcttggtcgatctgtcggggaaggtaggatttgttcatggtttgtgggggatttggttggatttcgaaggtttggggcggccatggtggtgactggtgagcggatatggggattttttggtgatcgagtgggggaaccgggctggttgggagggtttttaaaacgggattttgggaacggaggaattttttgggggaaccataacttttgggggggaaaacccgttttgggcccccggacccccgggtttaaaacttttttttttcccccaaaaagggggggataataaggggggtaaaacccccccccaaagggggggttcgcgggggccacatttttttttccgggggg

SEQ ID NO: 25916 - DNA, 648 bp, Zea mays
  misc_feature: Ceres CLONE 1398069-F
  misc_feature: Translation starting site: 237
gctctagaactagtggatcccccgggctgcaggaattcgcacgagaccattacctagaacatcctaatcgaaaaatataggggccatcagatccaagaagagggaagagcaccaaggaccttcggcgcccgttcaggatccacatcttcccgagcgagttcttggttgacctcttcctcttcggaccacctccaaggctcttggtgtagcttgccactctcaccaatcaagttttcatgtctgatctcgacattcagatcccaactgccttcgatcccttcgctgaggccaatgctggggactctggtgcggcagcagggtcaaaggactacgtacacgtgcgcatccagcagcgtaatggtcgcaagagcctgaccacccgtccaggattgaagaaggagttcagctacagcaagatccctcaaagatctcaagaaagagttctgctgcaatggtacagtggtccaggacccagaacttggacaggtcattcagctcccaggtgatcaaaggaagaacgtctcgaatttcctcgtccaggcccggcattgtgaaaaagggagcacaatcaagattcttggttttctgagcaacccgccgggttccataacaaaaccaacccctgcatgcagggcccagctttaataa

SEQ ID NO: 25917 - DNA, 710 bp, Zea mays
  misc_feature: Ceres CLONE 1398072-F
  misc_feature (523)..(523): n is a, c, t, g, unknown, or other
aaagctggagctccccgcggtggcggccgctctagaactagtggatcccccgggctgcaggaattcgcacgagaccattacctagaacatcctaatcgaaaaagtcagttcctcctactcccgatccatttgcagagggcagcagccacctcctctccccgcggccgagctcgcgcctcgcccgccgcctgaactcgtcttgcctgcggccgatctcccccctccgttcttcgccgcaacccggagaggagaccgcgctcggtcgagcaccccctggggcagcgtcctcgcgaccagctccggcgcggcgtccgccctcagcagcccgggtgtccccgggaacgtctccggctcggccggcacacagctcgacaggcttttcagttcagtgcagtgtaccaagattctctgttaatttgtgtatgagatcagttaactgataaagacatgtgaagaaccagtgatcagtaatctgtacgcttcagattgtagtatccttgagatggagggaagagaatcaggnttatggtaaatcctggtgaatattcatgggaggtcagcaagttctggcctgactaaaacaagaaaaaaacggtgcttcctctccgaatctcaatggggggaatgaggtcccgaaacgtcacataaaaagatggtgcccctcccccgccccaatgttcgccactccgccgggggggattccaatttct

SEQ ID NO: 25918 - DNA, 647 bp, Zea mays
  misc_feature: Ceres CLONE 1398073-F
tccccgcggtggcggccgctctagaactagtggatcccccgggctgcaggaattcgcacgagaccattacctagaacatcctaatcgaaaaaaaatagcaatttttccccctgggagcccgagacgcagcgcgaggtgcggccccgtcccctcgccaccggaggagcaggacgacgaggtggcgtcggcgcgaggtagtcgcgcgcctggaagagcggcggcatcggagtcgcaggcggaggcgaggaagtgaggggagagccctatagccaccgccgcggggcgtcgtgctcgctgcacgcactcccaccattttgtccccactcgaagctcagactcgtgctgtcgtgctgtgcacgacccctcccctagcatccccagctcctaactgagaaaacaggagatgggaaagagacgggaacagacttaggcgcggagccgcaagagatcccgcgacgcctccccctctcgtcggatttcgattcttcgaattcccatcctcttcgaacattacccctgaacgacggacccccagcataaacggaataaataattccttttggaccgccaaggcgaaaaaaaaggaccgtgccgggaaatcccccaaaaaggaccgccggggggggaaaaaaacgggccaggaaaaa

SEQ ID NO: 25919 - DNA, 721 bp, Zea mays
  misc_feature: Ceres CLONE 1398077-F
  misc_feature (703)..(703): n is a, c, t, g, unknown, or other
  misc_feature (704)..(704): n is a, c, t, g, unknown, or other
  misc_feature (706)..(706): n is a, c, t, g, unknown, or other
  misc_feature (708)..(708): n is a, c, t, g, unknown, or other
aaagctggagctccccgcggtggcggccgctctagaactagtggatcccccgggctgcaggaattcgcacgagaccattacctagaacatcctaatcgaaaaagactctagtgtaccccagtcccggggtctagtctgagggccgttcccatggccaaccgggcgaggccactccacgccatctacatgaccagcagctcccatgaccctgacaagtgggcgcacctcgtcaaggagtacgcctcgcaatccttgctccgggaagccgccctcgtctacgccaggaacctgccccgccggacgcaccaccagcccctcctccccgtcctcctcaaggccgccgctgcctcctccccgaccgagctaggtctcggcaagtccctccatgcggaggccctcaagtccgcttttgcccgcgatctgctcgtcggcacacgatcgtgtcgatgtactgcaagtgtggcgcactcgccgacgcgcggaggccgttcgacgaaatggccggacggaaacgtatccgataacacggcttttcccccggaaaccccgggggggggaaaaggaagggggccggggttctggtccggggaaggggcccctggaccacaccccggggggaaccttaaccccgggtttctcgaaaaaggcacatggggaggatctcggggaggttaaaggccccccccccccattaattgacatnnancnaaggacaagggga

SEQ ID NO: 25920 - DNA, 709 bp, Zea mays
  misc_feature: Ceres CLONE 1398078-F
aaagctggagctccccgcggtggcggccgctctagaactagtggatcccccgggctgcaggaattcgcacgagaccattacctagaacatcctaatcgaaaagtctagtgtcttccgtctcgatcccgcgggtgggactcgccggcgacaaaaacgaaaagcgacttgccctccgcggcctccggccttcccactccactcgccctcctctcctagcgtcggtgagccggtgcgctgcagtccccgctccccttccgcgtcgccgcgatggaggtcttccgggagcacgggcacgacggagtgccctaggattccatcacgccgccaagcatcagtcccgcagccagtgatttcttctccgaccccgaccttcatgtgagtcgcggccttcctcctcgaagcggatccggcggattggaggggccaaccatagcagattcgaaattttctagctcagcaccataaaagggcagacccagtgtcggaggatctcacatgagtggtttctgggtaagggataaaccaagggaaagtctttcccccacaaatgcggagaggctgttttgaacccgtgacctggtacttcttgcgggtgtaagcatttcgctgcacttggagacgcttatttggagtatttgaaggctttggagactgcccagatgaagaggaaatttcttgttctctgtgccattgcctgcgtaatggctca

SEQ ID NO: 25921 - DNA, 639 bp, Zea mays
  misc_feature: Ceres CLONE 1398084-F
  misc_feature: Encodes the peptide sequence at SEQ ID NO. 25922
  misc_feature (347)..(347): n is a, c, t, g, unknown, or other
  misc_feature (351)..(351): n is a, c, t, g, unknown, or other
  misc_feature (354)..(354): n is a, c, t, g, unknown, or other
  misc_feature (356)..(356): n is a, c, t, g, unknown, or other
  misc_feature (360)..(360): n is a, c, t, g, unknown, or other
  misc_feature (362)..(362): n is a, c, t, g, unknown, or other
  misc_feature (363)..(363): n is a, c, t, g, unknown, or other
  misc_feature (490)..(490): n is a, c, t, g, unknown, or other
  misc_feature (491)..(491): n is a, c, t, g, unknown, or other
  misc_feature (600)..(600): n is a, c, t, g, unknown, or other
cgctcagaactagtggatcccccgggctgcaggaattcgcacgagaccattacctagaacatcctaatcgaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactancctncantncaangnnccccaaaccgggggccgggtggggtaaccccttgggggcccaacccaattccccccgtcatcgtggtttgggggggcgggggcccaaagctggggaagccttccaacccgcgaaccaagttttgggnngccaaggggggtgggggggggaagggccaccttaagaaaccctcccccccccggggggttcgcgttttcccttggcggggggcctccgcctttttaccaaatttcccgntgttaaaatttatgggccgggggcccccaaggccccggg

SEQ ID NO: 25922 - protein, 153 aa, Zea mays
  misc_feature: Ceres CLONE 1398084-F
  misc_feature: SWISSPROT Homolog: EC 2.3.1.119 Icosanoyl-CoA synthase
  misc_feature (56)..(56): Xaa is any aa, unknown, or other
  misc_feature (58)..(58): Xaa is any aa, unknown, or other
  misc_feature (59)..(59): Xaa is any aa, unknown, or other
  misc_feature (61)..(61): Xaa is any aa, unknown, or other
  misc_feature (62)..(62): Xaa is any aa, unknown, or other
  misc_feature (104)..(104): Xaa is any aa, unknown, or other
  misc_feature (141)..(141): Xaa is any aa, unknown, or other
MAREEQALLSTEIVNRGVEPSGPDAGSPAFSVRVRRRLPDFLQSVNLKYVRLGYHXPXXQXXPNRGPGGVTPWGPNPIPPVIVVWGGGGPKLGKPSNPRTKFWXAKGGGGGKGHLKKPSPPRGVRVFPWRGASAFLPNFPXLKFMGRGPPRPR

SEQ ID NO: 25923 - DNA, 675 bp, Zea mays
  misc_feature: Ceres CLONE 1398085-F
  misc_feature: Encodes the peptide sequence at SEQ ID NO. 25924
  misc_feature (479)..(479): n is a, c, t, g, unknown, or other
  misc_feature (579)..(579): n is a, c, t, g, unknown, or other
  misc_feature (580)..(580): n is a, c, t, g, unknown, or other
  misc_feature (586)..(586): n is a, c, t, g, unknown, or other
  misc_feature (622)..(622): n is a, c, t, g, unknown, or other
  misc_feature (623)..(623): n is a, c, t, g, unknown, or other
tggagctccccgcggtggcggccgctctagaactagtggatcccccgggctgcaggaattcgcacgagaccattacctagaacatcctaatcgaacaagcaatactcactcctagtcctggagtatagtcactactacccctagaagggaagcgcatccgctcgatacggggggtggcaggttggcgaggagacgaaaggcacggcgagcgagagcccaacgaccgtccagttccagttccagcggtccgagcgagatcgatcgcccctccgcaaggccgcaacaacagacgcggcaagcgggtacaagggagttcttctggaggcgcgggagatcacgcgagtgtgttgcgcttgaaaagaaaaaaaaaacaggcagggaggagggagtcccgttcccgaacccgaactacaagcccacgcaactgctgctgccgccgcccgcccaggaggagcgagggcattgcccggccccatcgncgtcgcggccgtcgccgtcgccgcgctgcaggcagaggaggacggcgccggccagcatgggcgggtcgagctcggaggcggcccccccccccgggggggnncccccngggcccccccccccccgcccgggcgcgggcgcccgnngggggcgccggcgccccggccgcccccgggcgggccccgccgggcgccgccc

SEQ ID NO: 25924 - protein, 46 aa, Zea mays
  misc_feature: Ceres CLONE 1398085-F
  misc_feature (15)..(15): Xaa is any aa, unknown, or other
  misc_feature (30)..(30): Xaa is any aa, unknown, or other
MGGSSSEAAPPPGGXPPGPPPPRPGAGARXGRRRPGRPRAGPAGRR

SEQ ID NO: 25925 - DNA, 642 bp, Zea mays
  misc_feature: Ceres CLONE 1398087-F
  misc_feature: Encodes the peptide sequence at SEQ ID NO. 25926
  misc_feature (546)..(546): n is a, c, t, g, unknown, or other
ggagctccccgcggtggcggccgctctagaactagtggatcccccgggctgcaggaattcgcacgagaccattacctagaacatcctaaaaaaaaatctgaagcaaaatgtaccgggaatgttgaagagcgggactcttaagcagtagtgagatgcggcggtggtggtcgccggcgttggcggctgtggagccgcggtccgtgcagctcctgctcctgggcgtcgctctcgtcgcagcttctttctacgccggcaccctcttcggctcctccgcgtcccctgcgctcgtactgccctcttcgcgcccccgatcgcccgattccttcagggccaaagttacagatgttccagtgtttaccaacagagtttctcgtacgtaccgggcaaaatcattgacagttccagatcacggagttgatgtgtgtcctttggaatacaatgagtatgtcccctgccatgatggagcctatataagcagcttgaagagcctggatacatctaggcatgaggatcttgaaagtatttgtccctcatggggagagcggntggtttgtttggtgccccctcccaatgactaccagataccaataagatggcccacaagccgagactacgtatggcgaagtaatggcacccattact

SEQ ID NO: 25926 - protein, 163 aa, Zea mays
  misc_feature: Ceres CLONE 1398087-F
  misc_feature (132)..(132): Xaa is any aa, unknown, or other
MRRWWSPALAAVEPRSVQLLLLGVALVAASFYAGTLFGSSASPALVLPSSRPRSPDSFRAKVTDVPVFTNRVSRTYRAKSLTVPDHGVDVCPLEYNEYVPCHDGAYISSLKSLDTSRHEDLESICPSWGERXVCLVPPPNDYQIPIRWPTSRDYVWRSNGTHY

SEQ ID NO: 25927 - DNA, 662 bp, Zea mays
  misc_feature: Ceres CLONE 1398089-F
  misc_feature: Encodes the peptide sequence at SEQ ID NO. 25928
tccccgcggtggcggccgctctagaactagtggatcccccgggctgcaggaattcgcacgagaccattacctagaacatcctaatcgaaaaaaacacgcaaaacgtgcttctgtccctctcctgttataatttcgtcttcttccctctcccaccggtgtcctcgcctcgcctatccgatctgccacctcgccgtctcgcacgttcctttccccaactccccagcgcctctccgcgccgcgatccagatccaggttgttcagcatgggtctggtgaaggaaggcgtcgacatggaggagggaaccctagagatcggcatggagtacaggactgtatctggtgtggccgggcctctggttatcttggataaagtaaagggcccaaagtaccaagaaattgtaaacatccgacttggagatggcaccactcgccgtggtcaagtccttgaagttgatggagaaaaagctgttgtgcaggtttttgaaggaacttctggaatagacaacaaatacacaaccgtgcagtttacaggcgaggttttgaaaactcctgtctcactcgatatgcttgggcgcatttttaatggttctggaaacctattgacaatggccccccgatattacctgaagcctacttggatatctctggaagttctattaatcc

SEQ ID NO: 25928 - protein, 133 aa, Zea mays
  misc_feature: Ceres CLONE 1398089-F
  misc_feature (24)..(90): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MGLVKEGVDMEEGTLEIGMEYRTVSGVAGPLVILDKVKGPKYQEIVNIRLGDGTTRRGQVLEVDGEKAVVQVFEGTSGIDNKYTTVQFTGEVLKTPVSLDMLGRIFNGSGNLLTMAPRYYLKPTWISLEVLLI

SEQ ID NO: 25929 - DNA, 613 bp, Zea mays
  misc_feature: Ceres CLONE 1398091-F
  misc_feature: Encodes the peptide sequence at SEQ ID NO. 25930
  misc_feature (47)..(47): n is a, c, t, g, unknown, or other
  misc_feature (233)..(233): n is a, c, t, g, unknown, or other
  misc_feature (290)..(290): n is a, c, t, g, unknown, or other
  misc_feature (303)..(303): n is a, c, t, g, unknown, or other
  misc_feature (384)..(384): n is a, c, t, g, unknown, or other
  misc_feature (417)..(417): n is a, c, t, g, unknown, or other
  misc_feature (418)..(418): n is a, c, t, g, unknown, or other
  misc_feature (420)..(420): n is a, c, t, g, unknown, or other
  misc_feature (421)..(421): n is a, c, t, g, unknown, or other
tggagctccccgcggtggcggccgctctagaactagtggatcccccngggctgcaggaattcgcacgagaccattacctagaacatcctaatcgaaaaacactcgtccactcaccccctctttgctctgcctcgccgcgccgcagagcagagcatggcgcccccacgccctctcctcgccgccgtcttcctcgccgcggcggttctgctcctcctttctccggcagaggcggngacggtgggcgtgaactacggccgcgtggcgaacaacctgcccaacccagcggcggntgtgcagctgctncagcagcagggcgtcgcgcaggtgaagctgtacgacgccgaccccaccgtgctgcgcgccctcgcgaacaccgcatcaggntggtggtgccgctgcccaacgagcagtcgcggnngnngggtcccgcgcgtcctaccgcttgttggggggggcccgaacggggggggtaccacccggcacccaaatacggggtatcccccgggggcaacaagggggttcccggcggccaaaaagggacggggaaattgggccccggctttggcaaaggggaacccccgtttggcaattttgccctcaaggggggccaaaa

SEQ ID NO: 25930 - protein, 153 aa, Zea mays
  misc_feature: Ceres CLONE 1398091-F
  misc_feature (27)..(27): Xaa is any aa, unknown, or other
  misc_feature (46)..(46): Xaa is any aa, unknown, or other
  misc_feature (89)..(89): Xaa is any aa, unknown, or other
  misc_feature (90)..(90): Xaa is any aa, unknown, or other
MAPPRPLLAAVFLAAAVLLLLSPAEAXTVGVNYGRVANNLPNPAAXVQLLQQQGVAQVKLYDADPTVLRALANTASGWWCRCPTSSRGXXVPRVLPLVGGGPNGGGTTRHPNTGYPPGATRGFPAAKKGRGNWAPALAKGNPRLAILPSRGAK

SEQ ID NO: 25931 - DNA, 526 bp, Zea mays
  misc_feature: Ceres CLONE 1398098-F
  misc_feature (240)..(240): n is a, c, t, g, unknown, or other
  misc_feature (360)..(360): n is a, c, t, g, unknown, or other
cgcggtggcggccgctctagaatagtggatcccccgggctgcaggaattcgcacgagacattacctagaaatcctaatcgaaaaatcgacctgttctacaaatttttcaacatctgcttgatcgatcttactggcgaagcgcttttggggccttcccctcctcttctttgcaggcacgacttcttcgcgctgctactttgtcgcccctcctcttctccgccactgcgcacaaggcgacgncatggctgtgctgcacattgtgagcagtcaccgtcaccgatctccactcagacactgtcgtcgtctccatctccagggccaaacattccctgggggccactgcgagatccacggtagggnccgttctccttccaggccgaaaattcaagtgtgggggagggccaagggtggccccccaaaggaaaggttttctgggacaaaaaagccgggggccaaggtgccggcaatgaacgcccgaaaaccgccccagggatccccccctccaccccccttgggaacaaaaaaa

SEQ ID NO: 25932 - DNA, 677 bp, Zea mays
  misc_feature: Ceres CLONE 1398099-F
  misc_feature: Encodes the peptide sequence at SEQ ID NO. 25933
  misc_feature (31)..(31): n is a, c, t, g, unknown, or other
cgcggtggcggccgctctagactagtggatnccccgggctgcaggaattcgcacgagaccattacctagaacatcctaatcgaaaacccttcatcctccacttcttcctcttggtctggttcgggcagagcatccgcacctgctcggccgattaccccggcgttttctgctccctttcaccccgcgtgcgggcgctatccttcccgtggcgacgtctgggtgaccgctgccgcagccctacactaggttcctaggtattcgccgggcccttccccggcgacgagcacccaccatcttaggctacctctgtggggatcttctgtgaagcaagagatgttacctaggacactactccccgctccggggggtattggggatcaccttctcagccatctggacggcacgccccatgagggcccgacgccaacatcctggttacaaaaatagaacctctttggtcttacatatgcgagtggccccttcggctctccagcccccgcgggccccgtggctcctccccgtgatcgatcggggaccgaatacgcccgcggcagaggccgctccgcggacagcagtctccgcacctcgggaggtttgcttccgtcgctctctacccccaccgcacgcccccctacgtccccccgccgttcgcccccgctcctctcctcttctctcct

SEQ ID NO: 25933 - protein, 37 aa, Zea mays
  misc_feature: Ceres CLONE 1398099-F
MLPRTLLPAPGGIGDHLLSHLDGTPHEGPTPTSWLQK

SEQ ID NO: 25934 - DNA, 614 bp, Zea mays
  misc_feature: Ceres CLONE 1398102-F
  misc_feature: Encodes the peptide sequence at SEQ ID NO. 25935
  misc_feature (252)..(252): n is a, c, t, g, unknown, or other
  misc_feature (327)..(327): n is a, c, t, g, unknown, or other
ccccgcggtggcggccgctctagaactagtggatcccccgggctgcaggaattcgcacgagaccattacctagaacatcctaatcgaaaacttcctcgtgccgacgaccgggcgaccgccgtgccccggcccgcgcccccttgtctcgtgccactcgccggcaacgagcagccaccaggaaatgttgtgaggactgatgcaataactaagcttgctggatggacggatgtgattgcatcgagccactatggnctaacgatggatctcttggcaagtatcagtacatctcaaacttcttcataagcctcgggggactctctattccgntggagctctatattttcgtgaagaaagccgccttcctccgtacagatggggcttgattccaatttgggggattaaaagttttctgggggggcaaccctctgataacctggggggcggttaccaaacatacaagaccggttgggaggggcatgacctaaaaaaggtttctaaacaaaatgtgggcccggggaaaggcttttaatggtggaaaaatcatcccccaccatttaggggagaaaaaaaaaagggggtggcccgaaaaaaaaaatcataagttttccaaaaaa

SEQ ID NO: 25935 - protein, 54 aa, Zea mays
  misc_feature: Ceres CLONE 1398102-F
  misc_feature: SWISSPROT Homolog: EC 2.7.13.3 Histidine kinase
  misc_feature (12)..(12): Xaa is any aa, unknown, or other
  misc_feature (37)..(37): Xaa is any aa, unknown, or other
MDGCDCIEPLWXNDGSLGKYQYISNFFISLGGLSIPXELYIFVKKAAFLRTDGA

SEQ ID NO: 25936 - DNA, 677 bp, Zea mays
  misc_feature: Ceres CLONE 1398104-F
  misc_feature: Encodes the peptide sequence at SEQ ID NO. 25937
  misc_feature (266)..(266): n is a, c, t, g, unknown, or other
  misc_feature (301)..(301): n is a, c, t, g, unknown, or other
  misc_feature (383)..(383): n is a, c, t, g, unknown, or other
  misc_feature (441)..(441): n is a, c, t, g, unknown, or other
  misc_feature (442)..(442): n is a, c, t, g, unknown, or other
  misc_feature (480)..(480): n is a, c, t, g, unknown, or other
  misc_feature (482)..(482): n is a, c, t, g, unknown, or other
  misc_feature (585)..(585): n is a, c, t, g, unknown, or other
  misc_feature (592)..(592): n is a, c, t, g, unknown, or other
  misc_feature (677)..(677): n is a, c, t, g, unknown, or other
cgcggtggcggccgctctagaactagtggatcccccgggctgcaggaattcgcacgagaccattacctagaacatcctaatcaaaaaaaccaagcccagaccgatcgaccctgtccaaagcttatctaggttttcggttcctccacaggatggccgatcccgccgccggaggcgccatggtccccgctgccggaggcggcagcgtgtgggcgaacggcgccccccgcttcggcgacatggtctgggccaaggtgaagtcgcacccngtggtggccgggccacatctacagcgtcagcctcnaccgacgacgaggaggtgcaccgcggctaccgctacgggctgggtcctggtcgccttcttcggcgacaaagggttacggggntggttcgagcccagcgagctcgccccccttcgaggagcactttcaccgagaaggcggnnccagggcggaagcacccccgcagtaagttcccccgggngncccggggggggaggccccccccaacgagggtacccccgtcgcaagcgcgcttagcgctggctctggcccgtgcaaggagcccccgaacgcctttccgccccanccccagnggacggcacctccttccccggtgggcgatggtccccggcattcgaacactggacggctgactacccaccccgaccagatccagcn

SEQ ID NO: 25937 - protein, 128 aa, Zea mays
  misc_feature: Ceres CLONE 1398104-F
  misc_feature (24)..(99): Pfam Name: PWWP Pfam Description: PWWP domain
  misc_feature (51)..(51): Xaa is any aa, unknown, or other
  misc_feature (98)..(98): Xaa is any aa, unknown, or other
  misc_feature (111)..(111): Xaa is any aa, unknown, or other
MADPAAGGAMVPAAGGGSVWANGAPRFGDMVWAKVKSHPVVAGPHLQRQPXPTTRRCTAATATGWVLVAFFGDKGLRGWFEPSELAPLRGALSPRRRXQGGSTPAVSSPGXPGGGGPPQRGYPRRKRA

SEQ ID NO: 25938 - DNA, 667 bp, Zea mays
  misc_feature: Ceres CLONE 1398105-F
  misc_feature: Translation starting site: 154
tggagctccccgcggtggcggccgctctagaactagtggatcccccgggctgcaggaattcgcacgagaccattacctagaacatcctaaaaaaaaatctgaagcaaaatgtaccgggaatgttgaagagcgggactcttaagcagtagtgagatgcggcggtggtggtcgccggcgttggcggctgtggagccgcggtccgtgcagctcctgctcctgggcgtcgctctcgtcgcagcttctttctacgccggcaccctcttcggctcctccgcgtcccctgcgctcgtactgccctcttcgcgcccccgatcgcccgattccttcagggccaaggttacagatggttccagtgtttaccaacagagtttctcgtacgtaccgggcaaaatcattgacagttccagatcacggaggttgatgtgtgtcctttggaaacaaatgagtatgtcccctgccatgatggagcctatataagcagcttgaagagcctggatacatctaggcatgagggatcttggaaagtatttgtcctcctgggaagaaaggggtgggttttttgtttggggcccccctccaaatgactaccaagataccaataagatgggccaacaagccgagactacggtatgggcggtagtaaatgtcaaccattcacatctttgtg

SEQ ID NO: 25939 - DNA, 732 bp, Zea mays
  misc_feature: Ceres CLONE 1398107-F
  misc_feature: Encodes the peptide sequence at SEQ ID NO. 25940
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (35)..(35): n is a, c, t, g, unknown, or other
  misc_feature (37)..(37): n is a, c, t, g, unknown, or other
  misc_feature (38)..(38): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (48)..(48): n is a, c, t, g, unknown, or other
  misc_feature (53)..(53): n is a, c, t, g, unknown, or other
nnnnnnnnnnnnnnnnnnnnaaagggggggtgggngnnggnnnnttanacctntttcaagctggagctccccgcggtggcggccgctctagaactagtggatcccccgggctgcaggaattcgcacgagaccattacctagaacatcctaatcgaaaagaagccacagcagctgcaagtttttgcttcgtccgtccgtccgcccgcccgtccccgcatcattcccgaagtcccagcatggatttggaggggccgtgggcgcgggtgctgcacctgcacgatgcgtgagagtggggccgggcggtgcgggcgcgcgcggtggcgccggcgctggaggccgcggagtgagcgtgcctcgccatgacggacatgctcgtgctcgaggtgtgctacatgagcgtctacagcttcgtcgtcgtcaacctgctgcgccggaccccacagcggcggtacaggtgggagaccatgccctccgagaccgcccgggggaaccatgaggaggtcaccgcgggcgaaggaggcgacaaggcgcaccccgaggccacctcatgcagaatccccatgtacaactgaggagggagggcctaaaaggaactctcactggaaggcgaaatgcggccctcccaaagtgggccgcgccggacccggcattaataataccaacgggaattggggagcgaattcccaccggacccccatttctaatcaaagggaaacgctgggtgggacacgt

SEQ ID NO: 25940 - protein, 70 aa, Zea mays
  misc_feature: Ceres CLONE 1398107-F
MTDMLVLEVCYMSVYSFVVVNLLRRTPQRRYRWETMPSETARGNHEEVTAGEGGDKAHPEATSCRIPMYN

SEQ ID NO: 25941 - DNA, 619 bp, Zea mays
  misc_feature: Ceres CLONE 1398109-F
  misc_feature (174)..(174): n is a, c, t, g, unknown, or other
  misc_feature (177)..(177): n is a, c, t, g, unknown, or other
aagctggagctccccgcggtggcggccgctctagaatagtggatcccccgggctgcaggaattcgcacgagaccattacctagaacatcctaatcgaaaagttcctttcttccccactacaacatctgtcaccgtgaaatctcggctacctccttctgacttctggtacctcgncgncggggacccaactccgatccccaccccaccataacaaagccaccgcggctgcggctggcgcttccgcatcatcaatggggctgattactctcggtcgggactacttcgaccgcatgctccacgaatccctggaatgaagggcccgtccctcaacccaaaaccgttggaagggaaaaggggggtaaaacccatccgatctgtggggaaaaaggggttttcccccggaaaaaaagggaaaacccccccgttccgggggagccaggggggaccttaagggggggtaatttttcccgaacctccggtaaaaaaagccaaaaaaaccccgggaaacctccccatgggggggttttccaaaaaaaaacaaaattttttcccaaaaaaaaaaaagagggccccccaaaaaaaaaaaatttgtttacccaaaaaaaaaagaggggggggt

SEQ ID NO: 25942 - DNA, 656 bp, Zea mays
  misc_feature: Ceres CLONE 1398110-F
  misc_feature: Encodes the peptide sequence at SEQ ID NO. 25943
  misc_feature (310)..(310): n is a, c, t, g, unknown, or other
  misc_feature (311)..(311): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (338)..(338): n is a, c, t, g, unknown, or other
  misc_feature (343)..(343): n is a, c, t, g, unknown, or other
  misc_feature (461)..(461): n is a, c, t, g, unknown, or other
  misc_feature (656)..(656): n is a, c, t, g, unknown, or other
tggagctccccgcggtggcggccgctctagaactagtggatcccccgggctgcaggaattcgcacgagaccattacctagaacatcctaatcgaaaagtcgcatcgcacgccatcagcagctagcgcgctcctcgagcccagcagagaaaggccggcagcgctaatcgtaatagccatgggctccaccgccggcgacgtggccgcggtggtggacgaggaggcgtgcatgtacgcgatgcagctggcgtcgtcgtccatcctgcccatgacgctgaagaacgccatcgagctggccctgctggaggtgannaaaaggggggggccggcnnnnnnaaanggggngctggcgccccgaggagggggggggcccggaaggcccgcggcgcccaaggaacccggccgccggcggggacaaggggggacccgcacggccccggccggcccggcacccaaagaaggncggccgggggccaaaagggaaaaaacggggacgggcggggaaccgacggccgccaccccccgccggggccggacggggaaggggcccgcccccccacggaggagggagggggaccaggggcgccccccccgggcccgggggagcaagaaaaaggggcccggcggggagggaggacccgggccccacggcgcaacn

SEQ ID NO: 25943 - protein, 160 aa, Zea mays
  misc_feature: Ceres CLONE 1398110-F
  misc_feature (1)..(44): SWISSPROT Homolog: EC 2.1.1.68 Caffeate O-methyltransferase
  misc_feature (18)..(44): SWISSPROT Homolog: EC 2.1.1.146 (Iso)eugenol O-methyltransferase
  misc_feature (45)..(45): Xaa is any aa, unknown, or other
  misc_feature (52)..(52): Xaa is any aa, unknown, or other
  misc_feature (53)..(53): Xaa is any aa, unknown, or other
  misc_feature (54)..(54): Xaa is any aa, unknown, or other
  misc_feature (56)..(56): Xaa is any aa, unknown, or other
MGSTAGDVAAVVDEEACMYAMQLASSSILPMTLKNAIELALLEVXKRGGPAXXXGXLAPRGGGGPGRPAAPKEPGRRRGQGGTRTAPAGPAPKEGRPGAKREKTGTGGEPTAATPRRGRTGKGPAPPRRREGDQGRPPRARGSKKKGPGGEGGPGPHGAT

SEQ ID NO: 25944 - DNA, 622 bp, Zea mays
  misc_feature: Ceres CLONE 1398111-F
  misc_feature (416)..(416): n is a, c, t, g, unknown, or other
  misc_feature (419)..(419): n is a, c, t, g, unknown, or other
  misc_feature (431)..(431): n is a, c, t, g, unknown, or other
  misc_feature (435)..(435): n is a, c, t, g, unknown, or other
  misc_feature (436)..(436): n is a, c, t, g, unknown, or other
tggcggccgctctagaactagtggatcccccgggctgcaggaattcgcacgagaccattacctagaacatcctaatcgaaaaagttccccaaattcccaacgccgccgcgacggcgctgctagctagtctttggtgttgtaggtgttcgattcctgattccaaattccagactccaaactcggttcttcaatcgacagattccgatttacatcccaaagctcttcggattgaaatccagccgcgacccaagagataagagtatttgggattagtagataggatagtagaatagaagaggacactttcgctgatgattacggcggaggaaaaaaacccccccaaaaggggaggaggaaggaggagccgaaccccgcgcgcggaggctttttctggagatcatctgccgcgtcccggnggngggagaggtggngagnnggccgctgttcggctggcgggatccgccccacgggccggagtcgaaggaacggggtgctcaaggccccgcgaatggtacaggcgcccttaaagtccggccgggcggtttcttccggtgggggggggggaaatccccggggtcccaaacccgcccctacagggggggaacccctctttggccaaatg

SEQ ID NO: 25945 - DNA, 653 bp, Zea mays
  misc_feature: Ceres CLONE 1398113-F
  misc_feature: Encodes the peptide sequence at SEQ ID NO. 25946
  misc_feature (373)..(373): n is a, c, t, g, unknown, or other
  misc_feature (401)..(401): n is a, c, t, g, unknown, or other
  misc_feature (460)..(460): n is a, c, t, g, unknown, or other
  misc_feature (569)..(569): n is a, c, t, g, unknown, or other
  misc_feature (619)..(619): n is a, c, t, g, unknown, or other
  misc_feature (621)..(621): n is a, c, t, g, unknown, or other
  misc_feature (636)..(636): n is a, c, t, g, unknown, or other
  misc_feature (639)..(639): n is a, c, t, g, unknown, or other
cgctctagaactagtggatcccccgggctgcaggaattcgcacgagaccattacctagaacatcctaattgaaaacttccaatttttctcccaaataaaaaccagccgcagcgggaggtggcgcgacgcgaacccacccaccctgcgaacccggccgcaaaattctcctctcggattccgccgccgcgaaccgtcccctcgacgaggctgctgcgatagatttttcttaccattcgaatagttgatgagcgagaatacagagcaagaatcttgatggtgcgtgtggtacaacttggttaaggaaagctgactgcttgaagtgaccatgttggaccatcttgctatcattgcgtctgagttaggggacgacgcnacggattttgaggttgatggcatcgacnacctcagcgagaacgatgtcagcgactaggagatcgatgctgacgagctcgcccgacgnaatgtggaaggacaaggtcagctaaagaggatcagggagaggcagcagaagcttgccctgcaggggctggaagctggagaagacaagacaaggaagatttcagaccagncctccggaagaaagatgacaggccccaagacgggatcctcagtactgtangnttttaatgagggggnaangcccccacaggttt

SEQ ID NO: 25946 - protein, 34 aa, Zea mays
  misc_feature: Ceres CLONE 1398113-F
  misc_feature (26)..(26): Xaa is any aa, unknown, or other
MLDHLAIIASELGDDATDFEVDGIDXLSENDVSD

SEQ ID NO: 25947 - DNA, 554 bp, Zea mays
  misc_feature: Ceres CLONE 1398116-F
  misc_feature: Encodes the peptide sequence at SEQ ID NO. 25948
  misc_feature (94)..(94): n is a, c, t, g, unknown, or other
ggagctccccgcggtggcggccgctctagaatagtggatcccccgggctgcaggaattcgcacgagaccattacctagaacatcctaatcgaanaaacaagaacaaaccattgttggacgcgttcccctcctgcacgcaacctcatctcgtcctccagatcctggatggccgtcctccttgaacctttgcttcgggagtgtctcggggactactttggtttgatttatcagaaatccgtttgtttctggtatgcaggtccaaatggatggtggattcgcatcttaacggtttaaaaaaactaggcctgggaaaaaaaaaaacccccgtgtaatccggtttcaattggaaaaatttttaaggggggcgccccccccctttttttgtgggggggtttttgggggaattggttgggggggggggaatttttttgggggggagccctttttccccaaaaggaaaagagtccccccccccaaaaattatggggccccccccccaaaaatttaaaaaaccttctaaaaaaaacccccccgcgaaaaaagagagttttcct

SEQ ID NO: 25948 - protein, 42 aa, Zea mays
  misc_feature: Ceres CLONE 1398116-F
MAVLLEPLLRECLGDYFGLIYQKSVCFWYAGPNGWWIRILTV

SEQ ID NO: 25949 - DNA, 658 bp, Zea mays
  misc_feature: Ceres CLONE 1398118-F
  misc_feature: Encodes the peptide sequence at SEQ ID NO. 25950
tccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcggtgtcgacggcctcccgccggggcctccgggttggccggtggtggggaacctgttccaggtgatcctgcagcgacggcccttcatgtacgtggtgcgcgacctccggaaaaagtacgggcccatcttcaccatgcgggatggggcagcgcacccctcctcgggggcaccctcggtggagctcatccacgaggcgctgggtgaagcaggggccccatggttcgcgaggccggcccgaaggacaggccccccccgcctcctcttcaaggcgtcggaaaaaggacccgtcctactcgggcgccctacgggccccccgggggggggtgctactcgcctcgcaactttcccccccccaggtg

SEQ ID NO: 25950 - protein, 146 aa, Zea mays
  misc_feature: Ceres CLONE 1398118-F
MDVNDVLLVVLAAALAAMWWRRCSKTGGVDGLPPGPPGWPVVGNLFQVILQRRPFMYVVRDLRKKYGPIFTMRDGAAHPSSGAPSVELIHEALGEAGAPWFARPARRTGPPRLLFKASEKGPVLLGRPTGPPGGGATRLATFPPPG

SEQ ID NO: 25951 - DNA, 623 bp, Zea mays
  misc_feature: Ceres CLONE 1398119-F
  misc_feature: Encodes the peptide sequence at SEQ ID NO. 25952
  misc_feature (406)..(406): n is a, c, t, g, unknown, or other
  misc_feature (562)..(562): n is a, c, t, g, unknown, or other
gctctagaactagtggatcccccgggctgcaggaattcgcacgagaccattacctagaacatcctaatccaaaagaaggggaggaatcccttcctccgcgagtcgcgagccgtggagatccgtcccactccacccctccgctccgccccagacctcgctacaaacctgccgcgaaaatagcagccgcccgtttgctctctcccgtctccgcactcctcccgcgatgagcgacccgcggggccgcgccgccggtcccgaccgctacggggacgaaccgcacgacctcccgctcgccgaggacgcaaacggcgaggaagcgtggcagacgcccgagaaagaggcggttgccgtgtcggaaggggccgctgcgcggagtggtgatacgaccccggacgctgaacagganagcgatgacggagaaggaaggagtggcctccccggatcaggcggaacccaatggaagcgggggggagggcgtaccgcccgtgggcgcgactgtggagcccgggatgggaattgttagcggcgcaaagggtggagacgaacagcgaggacgctcacnttttattacccccacaaaggagagaaagaggaccaacgaacattgactcccccccaggatg

SEQ ID NO: 25952 - protein, 99 aa, Zea mays
  misc_feature: Ceres CLONE 1398119-F
  misc_feature (61)..(61): Xaa is any aa, unknown, or other
MSDPRGRAAGPDRYGDEPHDLPLAEDANGEEAWQTPEKEAVAVSEGAAARSGDTTPDAEQXSDDGEGRSGLPGSGGTQWKRGGGRTARGRDCGARDGNC

SEQ ID NO: 25953 - DNA, 606 bp, Zea mays
  misc_feature: Ceres CLONE 1398121-F
  misc_feature: Encodes the peptide sequence at SEQ ID NO. 25954
  misc_feature (288)..(288): n is a, c, t, g, unknown, or other
  misc_feature (289)..(289): n is a, c, t, g, unknown, or other
aagctggagctccccgcggtggcggccgctctagaactagtggatcccccgggctgcaggaattcgcacgagaccattacctagaacatcctaatcgaaaactgctcctctaccccttcctctcccggcgaccagctggcctctcctttgttgaggcgagagacccccacccgatccggcgatggacgccgcgtccaggccgcctccgccccacggagcaggggtccgcgtccgcgccccgctggtggagtctgtctcctgctactgcagattagatacaggccttannactgttgttgaggcccaggaagtttgttcctggcgcgaaaatgtgcatgcaaccctgaagtcaaacaaaacaagcgcaagtcaaggggctcaaaaaaaggaaagggtgcagggactcaagcaccacttttacctgggctttcctggatgaacttggctattggctggcctttaaaacacagtccctccgacttggacaggcaaaatctcgggggtgggtttggaaaaaaaaaggaaacccgcttttttggctggggaaatatatttttatccccttggggaaaaaaaattggggggggaaaaacaaaaagagggggt

SEQ ID NO: 25954 - protein, 85 aa, Zea mays
  misc_feature: Ceres CLONE 1398121-F
  misc_feature (36)..(36): Xaa is any aa, unknown, or other
MDAASRPPPPHGAGVRVRAPLVESVSCYCRLDTGLXTVVEAQEVCSWRENVHATLKSNKTSASQGAQKKERVQGLKHHFYLGFPG

SEQ ID NO: 25955 - DNA, 681 bp, Zea mays
  misc_feature: Ceres CLONE 1398123-F
  misc_feature: Encodes the peptide sequence at SEQ ID NO. 25956
  misc_feature (372)..(372): n is a, c, t, g, unknown, or other
  misc_feature (518)..(518): n is a, c, t, g, unknown, or other
tccccgcggtggcggccgctctagaactagtggatcccccgggctgcaggaattcgcacgagaccattacctagaacatcctaatcgaaaaaatcaactcgtttctctccgattgctcctccgagtccgagactccgttctctcccgcatccaccgccgtctcatccccaatccgagcaacgcctcccctcgcctccaaaaccctacccctcctgtcaccggcgggggcatgaaccggtgatcgcttacctggtctcgtctgtctgcgcacgcgcgaggtcagtgagtgagcattgcggtggtccgatcgcccgcggggggccatggcgtctgtggcgggatcgggcggcgggcaaagcgcggggggccggnggggttgaagacttacttcaagacccccgaggggcggcacaagctgcagtacgagaagacgacctccccccgccgtcgtgcactacaaccacacgggcaagacgtcgcccaggatgacggtggcatattttgaaggagaagcagcnagggccagggttccacgccttcacaccaagtgggtgggaaatggggaatggggtcctgcagctgcgagactgcttggcaactggggaaaagggaaccggacacttaagctccggggagcaggggaccccagcaggggctgtctcaggaaacacccccatgggg

SEQ ID NO: 25956 - protein, 65 aa, Zea mays
  misc_feature: Ceres CLONE 1398123-F
MTVAYFEGEAARARVPRLHTKWVGNGEWGPAAARLLGNWGKGNRTLKLRGAGDPSRGCLRKHPHG

SEQ ID NO: 25957 - DNA, 672 bp, Zea mays
  misc_feature: Ceres CLONE 1398126-F
  misc_feature: Encodes the peptide sequence at SEQ ID NO. 25958
  misc_feature (366)..(366): n is a, c, t, g, unknown, or other
  misc_feature (425)..(425): n is a, c, t, g, unknown, or other
  misc_feature (476)..(476): n is a, c, t, g, unknown, or other
tggagctccccgcggtggcggccgctctagaactagtggatcccccgggctgcaggaattcgcacgagaccattacctagaacatcctaatcgaaaagccgccaccgtcaccgtggcccgccgccatataagtaaaccctcgcctcgtcctcctcccaggctcgccaccctccgcctccgacacatggcccacccgcacctcgtgctcccctccccgaagtccctcctccccgccgccgcaactccatcgcgccgcgccgtcgccatccgcgcggcgctctccaccactttgtctccggccaaggcggcagctggagcagaggcggtgcgatcgatccgcgcgcggcagatcgtggacagccgcgnaaaccccaccgtcgaggtcgacctcgtcgccggggacggacgccctcaccgctccgcgntgcccagcggggcgtccacggggatctacgaggcgctggagctccgcgacngtgacaagggcgtataccggcgggaaagggcgtactcaaagctgtgcgcaacatcaacgaggttatcgcgcctaagctcataggcggcgaatgggaggaacccaagcgatggttgatgcagtcttgctaaacattgatggaactccaaaaaaatcccaaagtggggggccaagggtatttctcggaggccccttgg

SEQ ID NO: 25958 - protein, 124 aa, Zea mays
  misc_feature: Ceres CLONE 1398126-F
  misc_feature: SWISSPROT Homolog: EC 4.2.1.11 Phosphopyruvate hydratase
  misc_feature (61)..(61): Xaa is any aa, unknown, or other
  misc_feature (81)..(81): Xaa is any aa, unknown, or other
  misc_feature (98)..(98): Xaa is any aa, unknown, or other
MAHPHLVLPSPKSLLPAAATPSRRAVAIRAALSTTLSPAKAAAGAEAVRSIRARQIVDSRXNPTVEVDLVAGDGRPHRSAXPSGASTGIYEALELRDXDKGVYRRERAYSKLCATSTRLSRLSS

SEQ ID NO: 25959 - DNA, 655 bp, Zea mays
  misc_feature: Ceres CLONE 1398127-F
  misc_feature: SWISSPROT Homolog: EC 4.99.1.1 Ferrochelatase
aaagctggagctccccgcggtggcggccgctctagaactagtggatcccccgggctgcaggaattcgcacgagaccattacctagaacatcctaatcgaaaaagtcccgtccgtcttcacctgcgttccccgggtcccgacaagccgctgtaccagtcccgcccgcctgcgcacttctcccacccccgcgccgccttcggcgccggcgagccctcccgacgctcctcgagcgatccgtccctctcgcggcccttctctcagccgttccagcccccaaggggaggagagggagaggatgtggtcgtcgagccaggcgagcacgaggggcgtcgtggagatggggaagggtggaggccgggccgtcgcatttccctaagagacccgcgcctcagaactccgccagggtcaatctgtcaaggacacacacagttaaacctacctctgctggcaaccgttcagggaatttctgttaaatgcaagcttgggggtggtcttctcaaccatcgccttgacttggggcatcactttagaggatactcatcagcatcagaggcagttcttacttcccaatctgatgggagaaaaactgtttgttggcatagaaaaaatcggggttctcttgcgagaatcttgggggcccaaagaccgcttgagg

SEQ ID NO: 25960 - DNA, 680 bp, Zea mays
  misc_feature: Ceres CLONE 1398130-F
  misc_feature (297)..(297): n is a, c, t, g, unknown, or other
  misc_feature (378)..(378): n is a, c, t, g, unknown, or other
  misc_feature (407)..(407): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (680)..(680): n is a, c, t, g, unknown, or other
aagctggagctccccgcggtggcggccgctctagaactagtggatcccccgggctgcaggaattcgcacgagaccattacctagaacatcctaatcgaaaaaagcttttgctttggtttaggtgcttcttttccacccctttactgttccccccacttttgcttgctttgtcacgcacacgaaaagctcctgcctttaccttatctccgcacccgtagtgggatttggtgggagctgcgctgctcgcccctcgcgtttctttgctcaattgggggtcacggtccacggcccgcgggntgctgcgcgtgctcgtgggcggcggaaaaattcgggtttcttggcgcggtcccggtccccctcgggcgattgcggacgctnctctgcagatcttcgcgtaactccgggancgcggccggagaattgaactgcgggccgcccgacagttggcccccccggggtccnnnggccccgtcgttgctttcctcaacctgaaactgggaaccagtcttatgggccgccgaccagctccgaccggcgcttcaagtttggatggtccccctcccccggcgtccaaactcgacggccggcccgccggcggttaactggacggccgcgtccttccagggggatctctccgcaggaggcaagacgggaggaacctcggttcaggtccgcccccn

SEQ ID NO: 25961 - DNA, 653 bp, Zea mays
  misc_feature: Ceres CLONE 1398132-F2
  misc_feature (247)..(247): n is a, c, t, g, unknown, or other
  misc_feature (265)..(265): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (404)..(404): n is a, c, t, g, unknown, or other
  misc_feature (600)..(600): n is a, c, t, g, unknown, or other
tggagctccccgcggtggcggccgctctagaactagtggatcccccgggctgcaggaattcgcacgagaccattacctagaacatcctaatcgaaaaagagcagccgacaactctctaccgtccgagaccccaagcaccagcgcggcggcggcggcggcggcgaccatggctgtcgggaagaacaagaggatctccaagggaaagaagtttaagatctgttccacagatcacgcgtgcgcgctcgcngaatcgggggttccacancatagcttcgtcgttttgaatttgatgtactaatggagtctaagggtggcaagaagtctaagcagtagtcgttccatgatgtatgaagctccccttggctacagccattgaggacgttcgacctgccgagnnnncgaanaaagttccagtctgctgcttactccaactgcgcaaagaagccatcctgatatcccttttggcttcctcggtctaagaagtttaagggatttcttttctgacacttcgattcttaccaatccccctggcctgctgctttcctgacaatcgcccagttccccagtctgggctccctggagtcctcctcctcttttccngggggggggggttctgactcactgcccccaaggggtggtctttccggctgctg

SEQ ID NO: 25962 - DNA, 653 bp, Zea mays; identical to SEQ ID NO: 25961
  misc_feature: Ceres CLONE 1398132-F
  misc_feature: Encodes the peptide sequence at SEQ ID NO. 25963
  misc_feature (247)..(247): n is a, c, t, g, unknown, or other
  misc_feature (265)..(265): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (404)..(404): n is a, c, t, g, unknown, or other
  misc_feature (600)..(600): n is a, c, t, g, unknown, or other

SEQ ID NO: 25963 - protein, 98 aa, Zea mays
  misc_feature: Ceres CLONE 1398132-F
  misc_feature (88)..(88): Xaa is any aa, unknown, or other
GAPRGGGRSRTSGSPGLQEFARDHYLEHPNRKRAADNSLPSETPSTSAAAAAAATMAVGKNKRISKGKKFKICSTDHACALAESGVPXHSFVVLNLMY

SEQ ID NO: 25964 - DNA, 659 bp, Zea mays
  misc_feature: Ceres CLONE 1398136-F
  misc_feature: Encodes the peptide sequence at SEQ ID NO. 25965
  misc_feature (494)..(494): n is a, c, t, g, unknown, or other
  misc_feature (495)..(495): n is a, c, t, g, unknown, or other
ggagctccccgcggtggcggccgctctagaactagtggatcccccgggctgcaggaattcgcacgagaccattacctagaacatcctaatcgaaaaatccgctccccgccttccgcttccctaccccccgcatcacctaccaacgccgacaccatgggggccttcgcgaaggaggagcaccagttcctagccgagctcggcctcgcgcagcgcaacccaggcgcgttcgcatgcggtgcgtggggcggctcaggtcccaccgtcacctccacgagcccgaccaacaatcaggtcatcgcagaggtcgtggaggcgtccgtgcacgactacgaggagggcatgcgcgcctgcttcgatgccgccaagacatggatggcgattcctgctccaaagcgaggagagatcgttaggcaaatcggtgatgcactgagagcaaagctccatcaccttggcaggcttgtgtcacttgagatggggaaattcttcctgaaggnnatcggtgagggtcaggaaatcatcgacatgtgtgattatgctggtggggctaagtcgccaactaaatggatccattataccatctgaacgaccaacataggaggggttggaggtgtgatccccttgggggggggggggggtggtatacgggattaaattccctg

SEQ ID NO: 25965 - protein, 142 aa, Zea mays
  misc_feature: Ceres CLONE 1398136-F
  misc_feature: SWISSPROT Homolog: EC 1.2.1.3 Aldehyde dehydrogenase (NAD(+))
  misc_feature (114)..(114): Xaa is any aa, unknown, or other
MGAFAKEEHQFLAELGLAQRNPGAFACGAWGGSGPTVTSTSPTNNQVIAEVVEASVHDYEEGMRACFDAAKTWMAIPAPKRGEIVRQIGDALRAKLHHLGRLVSLEMGKFFLKXIGEGQEIIDMCDYAGGAKSPTKWIHYTI

SEQ ID NO: 25966 - DNA, 677 bp, Zea mays
  misc_feature: Ceres CLONE 1398137-F
  misc_feature (422)..(422): n is a, c, t, g, unknown, or other
  misc_feature (427)..(427): n is a, c, t, g, unknown, or other
  misc_feature (470)..(470): n is a, c, t, g, unknown, or other
  misc_feature (537)..(537): n is a, c, t, g, unknown, or other
  misc_feature (540)..(540): n is a, c, t, g, unknown, or other
  misc_feature (572)..(572): n is a, c, t, g, unknown, or other
  misc_feature (596)..(596): n is a, c, t, g, unknown, or other
  misc_feature (677)..(677): n is a, c, t, g, unknown, or other
ggagctccccgcggtggcggccgctctagaactagtggatcccccgggctgcaggaattcgcacgagaccattacctagaacatcctaatcgaaaaatcttcaaaaactacccacggcccgtctcctcgacctccccgaaaccccacttctcggatcgagactagggttagggtttcgtcactcccgccccgattcgaaccaatccgcctaggcccccgccgcgccatggccgccggttccattgtggtggacttcccctccatgggcgccgccctctgcttccccaacctcgaatcactcctccgagactgccgcctcgggtttcctctccgccgtctccgccgcccgggcccccggcgccgccgacctcaccaacttccaccgcgtcgttctcgcgcgtcctcagcacctactcagacgnccggntcgaaggggcggtctggttcttctccgcgctctccttccacgnaccgccctgacgacctccgctcactgctccagctcctctccgccttcgcgcttcctcgggctggggncgncaagccgctcgcctcttcgggccccgtcggtnttcgagcttttcactcgaaaaacngcgcagggggaccggggggcggtcccccagggggtgccctcagctacatcagaattcggcagcagccgccccgcccctctn

SEQ ID NO: 25967 - DNA, 663 bp, Zea mays
  misc_feature: Ceres CLONE 1398139-F
  misc_feature (90)..(90): n is a, c, t, g, unknown, or other
  misc_feature (193)..(193): n is a, c, t, g, unknown, or other
  misc_feature (263)..(263): n is a, c, t, g, unknown, or other
  misc_feature (663)..(663): n is a, c, t, g, unknown, or other
tcaccgcggtggcggccgctctagaactagtggatcccccgggctgcaggaattcgcacgagaccattacctagaacatcctaatcgaanagtgagtcgtgagtagtgactcgtctggtctcccctctctcgtccgtctggtcctcccgtccagagggcgtctctctccctccccctttcctctggtcatcgnacccgtctccccgttctggatccgccgggccgccgaatcccggaacggccccgggttttattttcggcgncggggcgccttggttccgattgacccccaaaaggccggaaaaccggggctttccggaggggggattttttgggcccggcctgaaatttaatttagttttctgaaaaagggcctaggtttgtaaatttttacccgcggtttcccctctttttccccaggggggaaaaaaaaataaaaaggggggaaagggggaatttttaaaaaaaaaagggggggtttttttcccccctttatagaggggggaaaaaccccccctttctctttgaggaattgtggggcacgacaaaagggggggggggttttttcggggggagggaaaaaaccggagggaggggggggggggggaaaaaagggggtgggaaaaccctcttatagaggggcgcccccccccaaaggggggn

SEQ ID NO: 25968 - DNA, 675 bp, Zea mays
  misc_feature: Ceres CLONE 1398142-F
ggagctccccgcggtggcggccgctctagaactagtggatcccccgggctgcaggaattcgcacgagaccattacctagaacatcctaatcaaaaaaaattcatcttcttcgtcttcatcgcagcatcggcgctccatcttctgctccctcccccacttcgtgctcgggttccatcttccgctccttcccccactcgcggtcggcacgcaggctcggccggcgtcagcggctccccatcccgccagtacaggaagagggccgccgcttggagctcgcgggaggtagcgtcgccgccgccgcatggaggtcccgaatggctgaatcctgaccgctgcctggagagtctcgcgcctaaatcacatcatattgagcttctcgcctttggatccgtcttattatttgctcacactgaagaattagtttgcactttggaggaaaatgagtggcgctccaaagaggttgctcgaggaaggtagtcactccacaccaacaaaacgccctttggatgacagcagtttcgtattcgagtcctggaaaatttattcagtccggtggcagaggattcccatgggtcctctgaacatgggaggggagatttgcgaaactcaaccgggggggaagtctcgtgaatgataagaaggcatctggacatccgagaggcctggtgctcaccc

SEQ ID NO: 25969 - DNA, 644 bp, Zea mays
  misc_feature: Ceres CLONE 1398144-F
  misc_feature: Encodes the peptide sequence at SEQ ID NO. 25970
  misc_feature (621)..(621): n is a, c, t, g, unknown, or other
tcaccgcggtggcggccgctctagaactagtggatcccccgggctgcaggaattcgcacgagaccattacctagaacatcctaatcaaaaaggcagccgccgcaaccttctttctacgatgcctcgcaagcccaaacggaaggctccggcctcaccggcgaggcacgacccttcgccggagccctacccttcccatgcctccccctgctcggcacaatgcctggtagtccgcgatgccctcctcgcgttccacgggttccccgaagagttcgcggccttccgcgtcctccgcctcggtggcctctcgcctaaccgtgaccctcggccttcgtcccccacagtgcttgacggcctcgtcaccacgctcctctcccagaacactaccgacgccatctcccgccgcgccttcgcctcgctcaaggccgctttcccctcctgggaccaggttggtggatgaggaagggaaagaggttggaggacgccatcccggtgcggcggcctggcggcgacgaaggcggccaggatacggtccatgcctgagggacgtgagggaagccgaggggcaagatttgcctcgagtacctgcgggaaactggcgggtggatgaaagtgagaagaaanctctcgcggttcccaagggattg

SEQ ID NO: 25970 - protein, 112 aa, Zea mays
  misc_feature: Ceres CLONE 1398144-F
MPRKPKRKAPASPARHDPSPEPYPSHASPCSAQCLVVRDALLAFHGFPEEFAAFRVLRLGGLSPNRDPRPSSPTVLDGLVTTLLSQNTTDAISRRAFASLKAAFPSWDQVGG

SEQ ID NO: 25971 - DNA, 652 bp, Zea mays
  misc_feature: Ceres CLONE 1398149-F
  misc_feature: Encodes the peptide sequence at SEQ ID NO. 25972
  misc_feature (443)..(443): n is a, c, t, g, unknown, or other
tccccgcggtggcggccgctctagaactagtggatcccccgggctgcaggaattcgcacgagaccattacctaaaacatcctaatcgaaaaaagtagacaacccagctctccagcggtccagcggtccagcctctcctagccgaggccaaaacccccataccaacacacacttcgcttctcgctgcctccgcggcggcgcgccgctccgctccgagccctcttcctcctcctcctctgcccgttcggtcgagaatgttctactcgcatcagcttctcgcgcggaaggcgccgctcggccagatatggatggcggcgacgctccactcgaagatcaaccgcaaacggctcgacaagctcgacatcatcaaaatctgtgaggaaattttgaacccctcggtgcccatggctctgaggctctctggaatcctcatgggtggcgtgntgatcgtgtacgagaggaaggtgagcttctctacactgatgtctctcggcttctgactgagatcaacgaggcatggcggatcaaaccggtcacagaccccaccgtcttccccaagggtaaactcaagccaagtatgaagcagtacactgccagagatcaaatatggtggtggaacagcccatggttttctcagagctggaatgtgcaag

SEQ ID NO: 25972 - protein, 81 aa, Zea mays
  misc_feature: Ceres CLONE 1398149-F
  misc_feature (1)..(81): Pfam Name: Rad21_Rec8_N Pfam Description: N terminus of Rad21 / Rec8 like protein
  misc_feature (64)..(64): Xaa is any aa, unknown, or other
MFYSHQLLARKAPLGQIWMAATLHSKINRKRLDKLDIIKICEEILNPSVPMALRLSGILMGGVXIVYERKVSFSTLMSLGF

SEQ ID NO: 25973 - DNA, 676 bp, Zea mays
  misc_feature: Ceres CLONE 1398150-F
  misc_feature: Encodes the peptide sequence at SEQ ID NO. 25974
  misc_feature (445)..(445): n is a, c, t, g, unknown, or other
  misc_feature (446)..(446): n is a, c, t, g, unknown, or other
  misc_feature (642)..(642): n is a, c, t, g, unknown, or other
tccccgcggtggcggccgctctagaactagtggatcccccgggctgcaggaattcgcacgagaccattacctagaacatcctaatcgaaaagtcgagttaacaaagtcacctcatccaatcttgcatccccatctctgtctttgctcctccatggccatggccatggcccgaccttgtgctttccttctcttcttcctagttcttttctcctacgacggatccggtcctgggagcagcagcaggaggagtggcgtcgctcaggccacgcagagagtcttcctgtatccacaggctcccaaggtctcctccatcgtgagcagcaagtacaggaccgcgtaccacttccagcctcccaagaactggatcaacgatccaaatggaccaatgtactacaatggtatctaccaccagttctaccagtacaacccaaacggctcgctctgnngcaacatagtctgggcgcactcggtctccacagatctcgtgaaactgggatccggctcgcgccggcggatagagcggacgactccgagcgacatcaatgctttgcttgggaacagttcagccacatccctccaagaagcggccggcctggcatcatataccaaccggcgccgacacgaagaaagcgtcaggtcccnaaaaaatattggcgtccccaaaaaaccttgtcga

SEQ ID NO: 25974 - protein, 175 aa, Zea mays
  misc_feature: Ceres CLONE 1398150-F
  misc_feature: SWISSPROT Homolog: EC 3.2.1.26 Beta-fructofuranosidase
  misc_feature (98)..(98): Xaa is any aa, unknown, or other
  misc_feature (99)..(99): Xaa is any aa, unknown, or other
  misc_feature (164)..(164): Xaa is any aa, unknown, or other
MAMAMARPCAFLLFFLVLFSYDGSGPGSSSRRSGVAQATQRVFLYPQAPKVSSIVSSKYRTAYHFQPPKNWINDPNGPMYYNGIYHQFYQYNPNGSLXXNIVWAHSVSTDLVKLGSGSRRRIERTTPSDINALLGNSSATSLQEAAGLASYTNRRRHEESVRSXKNIGVPKKPCR

SEQ ID NO: 25975 - DNA, 701 bp, Zea mays
  misc_feature: Ceres CLONE 1398155-F
  misc_feature: Encodes the peptide sequence at SEQ ID NO. 25976
  misc_feature (571)..(571): n is a, c, t, g, unknown, or other
  misc_feature (588)..(588): n is a, c, t, g, unknown, or other
  misc_feature (596)..(596): n is a, c, t, g, unknown, or other
  misc_feature (660)..(660): n is a, c, t, g, unknown, or other
  misc_feature (661)..(661): n is a, c, t, g, unknown, or other
  misc_feature (665)..(665): n is a, c, t, g, unknown, or other
  misc_feature (683)..(683): n is a, c, t, g, unknown, or other
aagctggagctccccgcggtggcggccgctctagaactagtggatcccccgggctgcaggaattcgcacgagaccattacctagaacatcctaatcgaaaaagatttggatgtggactagatgcttaaggtgtgaacgtgaaagtggggtccccagatcatcacgaagggtgataatgtcagctgaagcacactacctttcatttgggaagttccttgaacttagtttttcaagccactcaaccgctagaaggctgccaatatgcgggcattcactcaatacggattgtctgcgctttttttgggttgggctccaaagttgcaatgttccagtattcctcagtcgaaatttacaatgcctgcaaaccacagcctactcttgagattcacaaccccgatatgcacaaagatgccccaaggttgctgccctcgtgtttcgtgctctgattgttgagtcttcaatgagagctgattccagttatatagaggtgaacaagcttttgattatttcttttgttaatttggtgcaacatatagaggtgaacaagcttattaaaggaagatccttgtancatcaagagttcatacnatagatgnaacgatattgtgattctctcagtggtggcttcatgagcaagcaatcattcaccttggtcactannattncagactgtagctcagatnaggctttgagcattcctg

SEQ ID NO: 25976 - protein, 90 aa, Zea mays; identical to SEQ ID NO: 11994
  misc_feature: Ceres CLONE 1398155-F

SEQ ID NO: 25977 - DNA, 598 bp, Zea mays
  misc_feature: Ceres CLONE 1398161-F
  misc_feature (172)..(172): n is a, c, t, g, unknown, or other
  misc_feature (173)..(173): n is a, c, t, g, unknown, or other
  misc_feature (233)..(233): n is a, c, t, g, unknown, or other
  misc_feature (242)..(242): n is a, c, t, g, unknown, or other
  misc_feature (565)..(565): n is a, c, t, g, unknown, or other
ggagctcaccgcggtggcggccgctctagaactagtggatcccccgggctgcaggaattcgcacgagaccattacctagaacatcctaatcgaaaaactaacttctagggtttcaggactaacctccctcccttcgcgccatctcccgcggtgctgcctcctctggcgccgnnatcgcgctgggagccccaatctataaccccctctgtcgatctgggatccgctagaatccntggggcggnaattaaggccaatggccaaagttaatccaaaaggggtgggtgggaaaaaaccgcgaccccatggggggtttaaaattcccccccggggaaaaggggaaaaatttgggggcgaaaaaaaaaggggggggaaaacccccccccccgggggagaaaaccccccaaaaattatttttctcctctttttaaaaaaaaaaaaggggggggcccaaaaaaaaaaaaaaaaaaggggggggggggggctcccccccacaagaaaaaagaaaaaaaaaacccccccggcggggggggggggttaaatttatcttttttctgggggggggggntgtttttaaaaaaaaaaaaaaaaaaattttttt

SEQ ID NO: 25978 - DNA, 637 bp, Zea mays
  misc_feature: Ceres CLONE 1398167-F
  misc_feature: Encodes the peptide sequence at SEQ ID NO. 25979
ggagctccccgcggtggcggccgctctagaactagtggatcccccgggctgcaggaattcgcacgagaccattacctagaacatcctaatcgaaaaatcttcgccgccgctaaacgttccccccacgccccaacctatccacgcgaaaccttctttcccccgggagacgattcgtcagggagaggaaagaggcaagaggggccatggacgctgccaagttggtgacgccggtcgctgtgtctcacattctggcgcacccgtcggcgggctccgacggcgcagtgaccgatctcgtcgttcaggtcctcgacctgaagtccgtcggcacgggcagccggttcagtttcacagcaactgacgggaggataagatcaagcgatgcttcccaccacttcggtcggaggtccgctctggcaactgaagaactcggctcatccgatatcgactacacttgcacgtcgtcaaaggcaagatgacaagtcttggtgtcatcaaatgcgagcttgtgggccaggcgttgacgccgagatcaacggcgaggcaaaaaagaggagcctccaattggctgaaccctaaggaccaatggatgggcgggcaactcccccctccctatgaacgcccaagcgggaggggaagg

SEQ ID NO: 25979 - protein, 90 aa, Zea mays
  misc_feature: Ceres CLONE 1398167-F
MDAAKLVTPVAVSHILAHPSAGSDGAVTDLVVQVLDLKSVGTGSRFSFTATDGRIRSSDASHHFGRRSALATEELGSSDIDYTCTSSKAR

SEQ ID NO: 25980 - DNA, 556 bp, Zea mays
  misc_feature: Ceres CLONE 1398176-F
  misc_feature: SWISSPROT Homolog: EC 2.7.10.1 Receptor protein-tyrosine kinase
  misc_feature (331)..(331): n is a, c, t, g, unknown, or other
  misc_feature (335)..(335): n is a, c, t, g, unknown, or other
  misc_feature (399)..(399): n is a, c, t, g, unknown, or other
  misc_feature (527)..(527): n is a, c, t, g, unknown, or other
tggagctccccgcggtggcggccgctctagaactagtggatcccccgggctgcaggaattcgcacgagaccattacctagaacatcctaatcgaaaaaagtccagacccgcagcgcccgccggaggcggagggaaccgagccggcgaccggcagaccgcagagaagaggcctggagccgaccgcagagaagaggccaggagccgaccgcaggcagccgccaccgcaccagaacccgaggtctcgaggcaatcgagcgcacgcgggtcgggggctgcggccatgtcggtgagttgcgggctcgagtgggtggtgtgccttggctgcacgcgntggncgtgggaaacgggttccaactaacttgggggcccaaaaaaagaaaaaaagggggccccccgggntccccccccccaaaaaatttaagaggccccctcccccgcggtcttttttggggggcggggggggggggaaaaaaaaaaaggagggggagtttcccccccccccccccattttccccccccccccccgnggggggggttttttttttttttttgccgc

SEQ ID NO: 25981 - DNA, 751 bp, Zea mays
  misc_feature: Ceres CLONE 1398178-F
  misc_feature (321)..(321): n is a, c, t, g, unknown, or other
  misc_feature (322)..(322): n is a, c, t, g, unknown, or other
  misc_feature (355)..(355): n is a, c, t, g, unknown, or other
  misc_feature (444)..(444): n is a, c, t, g, unknown, or other
tggagctccccgcggtggcggccgctctagaactagtggatcccccgggctgcaggaattcgcacgagaccattacctagaacatcctaatcgaaaagacgacacacctgacacgtgggtctatcagtcatcctggtccttttattttctttcttctctcacccggttcttcctcctcccgagtcccgaactctcgatccactcatccgctgagggcgtcggccttctggcccttctccccccggccgacctcgcccctccggcgctccgtccgcttcctgaactcgtctccctcacggacgttctcctccctccgctcgnncgcgcgcaacccggagaggagaccgccgctcgntcgagcaccacctgggggccagcgtcctcgcgaccagctctagcgcggcgtccgccctctgcagccctggtgtccccgcgactgggttncggccggaaaacacttcacaagttagtttccgtctgccagggggggggatcttctcctctccttcccgccctttgaaggccctctcagccccctttccggtggttggttttggctcaacctcaaaataaccttggtttggaaaaggccttaaccccccccaagggctttggaaattgtaagtttgaaacccaaaattgggccgggtttttttcaaaaaccccaaaaaggggggggaaccccccctcccaaaaaaaaggggccccgaggccccccccccttttttttttctcccaccgccctcttttt

SEQ ID NO: 25982 - DNA, 770 bp, Zea mays
  misc_feature: Ceres CLONE 1398179-F
  misc_feature: Encodes the peptide sequence at SEQ ID NO. 25983
  misc_feature (293)..(293): n is a, c, t, g, unknown, or other
  misc_feature (359)..(359): n is a, c, t, g, unknown, or other
  misc_feature (624)..(624): n is a, c, t, g, unknown, or other
aaagctggagctccccgcggtggcggccgctctagaactagtggatcccccgggctgcaggaattcgcacgagaccattacctagaacatcctaatcgaaaagtcccacccggcttcggcctctccctcctcctcgctcgctcgatcgctcccacgtcctcgcctccctccacaaaccaccaccaccatccaggatcgcagcgcggcgcgcgagagaggggtgagcaggtcgggcaagatgagggagatcctgcacatccagggcggccagtgcggcaaccagatcggcgccnagttctgggaggtgatctggcgcgagcactgcgttgactccacgggccgctactcggggacctccntcgcagcagctcgagctcgaggggatcaacggctaactacacgagggctgggggtggcccgttagtgcccccgggcccgggctctgggacctggagccccgaaccaatgaaatccaatcggggcggggcccttttgggggggttctttccggccccaaaaatttttgtataaggccaaatccggggcccgggaaaaaattggggcacaagggccctcaaacccgggggggggccaagatttcacaacctccccctttaaaccccngggcaaaagggggccaaaaaattcgccctggccccccaaggggtcccaaaaaagccccccccccggggggggggcactttgtttttgggagggggcacccctttttttttttcaaaaaatccgggggggaaaacccccgcgccccg

SEQ ID NO: 25983 - protein, 61 aa, Zea mays
  misc_feature: Ceres CLONE 1398179-F
  misc_feature (19)..(19): Xaa is any aa, unknown, or other
  misc_feature (41)..(41): Xaa is any aa, unknown, or other
MREILHIQGGQCGNQIGAXFWEVIWREHCVDSTGRYSGTSXAAARARGDQRLTTRGLGVAR

SEQ ID NO: 25984 - DNA, 696 bp, Zea mays
  misc_feature: Ceres CLONE 1398185-F
  misc_feature: Encodes the peptide sequence at SEQ ID NO. 25985
  misc_feature (628)..(628): n is a, c, t, g, unknown, or other
  misc_feature (629)..(629): n is a, c, t, g, unknown, or other
  misc_feature (646)..(646): n is a, c, t, g, unknown, or other
cagagctggagctccccgcggtggcggccgctctagaactagtggatcccccgggctgcaggaattcgcacgagaccattacctagaacatcctaatcaaaagtttatacgttcagggctactattgaagcagactccacccggcgcgtcctcgtctcgtctcgtctcgcacgcacccctcactttccttgtcaatcgactcgcgatcgaatccgccccgagtcgattccgccgcggaccgcccggttcacttcccttttctcccgagatctcgactctcgagcaagtatgggtgaggcgaaggacaacgaggtgtacgaggaggacctagtcgactatgaggaggaggtggagaatgtcattgatggcgcccccaccaacggctcctcagatgtcgtcaagaaggggtacgtagggatccacagctcggggttcagagacttcctgctcaagccagagcttcttcgcgccattcaggattgcgggtttgagcatccttctgaagtgcaacatgagtgcatccctcaagctattcttggaatggatgtcatctgtcaagcaaaatctggaatgggtaagactgcagtttttgtcctgtcactcttcagcagattgatccctgtgctgnncagtagctgcacttgtngtgtgcacacaagagaatagcttaccagatttgcatgaatttgagagttt

SEQ ID NO: 25985 - protein, 125 aa, Zea mays
  misc_feature: Ceres CLONE 1398185-F
  misc_feature (114)..(114): Xaa is any aa, unknown, or other
  misc_feature (120)..(120): Xaa is any aa, unknown, or other
MGEAKDNEVYEEDLVDYEEEVENVIDGAPTNGSSDVVKKGYVGIHSSGFRDFLLKPELLRAIQDCGFEHPSEVQHECIPQAILGMDVICQAKSGMGKTAVFVLSLFSRLIPVLXSSCTCXVHTRE

SEQ ID NO: 25986 - DNA, 661 bp, Zea mays
  misc_feature: Ceres CLONE 1398190-F
  misc_feature: Encodes the peptide sequence at SEQ ID NO. 25987
  misc_feature (411)..(411): n is a, c, t, g, unknown, or other
  misc_feature (488)..(488): n is a, c, t, g, unknown, or other
  misc_feature (618)..(618): n is a, c, t, g, unknown, or other
aagctggagctccaccgcggtggcggccgctctagaactagtggatcccccgggctgcaggaattcgcacgagaccattacctagaacatcctaatcgaaaacggatagaaaacgaattaccctcggcgccctccctctcggcggggggggggcaagcccccttcatctcaggagagaaaaatggcaggcgccaggattgcacatgataccctcaaggtgctcagaggggtgaaggaaatctacattggactgacactgggactgatcgctgcacgtatgcggaagatgcaccactgaaacgatcacaggaaaactagatgcttctacgacatgcttgacaagggccacagcgcctgtcgccgaggagtagtccccacgagtcacctcagaatgttttatttgcaggtgtnattgagaatgcactctgtagacgacgacaaagtgaatgctgtgaagatttgcattgagaataagcataaccatctgngactctacgacggcgatgtgaacccgcccaggtggaaggctgtcagctcctgcagcagggctacttcgcaaggggcaagcccaggtcagggtaaaggctttcgccacggccttcctcgaggggagaaggncacccgtaccaccttaaaggaaggcagatacccccggcccccg

SEQ ID NO: 25987 - protein, 38 aa, Zea mays
  misc_feature: Ceres CLONE 1398190-F
  misc_feature: SWISSPROT Homolog: EC 1.9.3.1 Cytochrome-c oxidase
MAGARIAHDTLKVLRGVKEIYIGLTLGLIAARMRKMHH

SEQ ID NO: 25988 - DNA, 2350 bp, Zea mays
  misc_feature: Ceres CLONE 1398193
  misc_feature: Encodes the peptide sequence at SEQ ID NO. 25989
aggcaacagcaccagcgctcgaacgccgcgtccaggcaacccatccttccgaccccgagcggtcggtacctcgcaagcaaaactacaagctcgcttttaaattctgttgctgcaattatctcctctgtttcccactcgtagatcccgccgcctcccgcgtctagccgtcgacgagcaccgcagcctgacacagccgcgggcgaaccatcgcgtgcggcctcgcccgggatggcgaccatggagagcctgatcgggctggtgaaccgtatccagcgcgcgtgcaccgtcctcggcgaccacggcggcggcggcggcgagggctccctctgggaggcactcccctccgtcgctgtcgttggtgggcagagttccgggaagtcgtcggtgctcgagagcatagtggggagggacttcctgccccgtggatctggcattgtcacgaggcggcctttagtgctgcagctccacaagacagatggtgggcacgagtatgctgagttcctccacgccccgcggaagcgtttcaccgactttgctgctgtgaggaaagagattgctgatgaaacagatcgcataactgggaaaactaaagctatttcaaacgttcccatccatttgagtatatattcaccacatgttgttaacttgacacttatcgatcttcctggactgacaaaggtcgctgtagaggggcaaccggaatctattgttcaagatattgaaaacatggttcgagcttatgttgacaagccaaattgcatcatcttggctatctccccagctaaccaagatattgcaacgtcagatgctatcaagcttgctagggatgttgatccttcaggtgacaggacttttggagtcttaacaaagcttgatttaatggacaagggtaccaatgctgttgatgtgcttgaagggaggcaatatcgcttacaacacccgtgggttggaattgtcaatcgctcacaagctgatatcaacaagaatgtcgatatgctctcagcaagacgcaaagaaaaagagtactttgagagtagtcctgaatatggtcacttggcacataaaatgggtgcagagtatcttgccaagcttctgtcacagcatttagaggctgtgatcagggcaaaaattccaagtattatagctatgattaacaaaacaattgatgaaatagaagcccagttggatcgacttggtaggccaattggaggtgacgctggggctcagttgtacacaatcttggatatgtgtcgggcatttgaccgtgtctttaaagagcacttagatggcgggcggccaggtggagatcggatttatggtgtctttgacaaccagttacctgcagcactgaaaaagcttccatttgaccggcatctttcaatgcaaaatgttcgcaaagttatttcagaggctgatggttaccagccccacttgattgcccctgagcaaggatacagaaggcttatagatagttctctaagctactttaagggtccagctgaagcatctgttgatgcggtccatttggtattgaaggagcttgttcggagatctattgcagcaacagaggaattgaagcgattcccaacacttcaatcagatatagctgctgctgcaaatgatagcttggaaagattccgtgaggatggacgaaagactgttcttcgtctagttgagatggaagccagctacctaacagtagagtttttccgtaaacttcctactgaaccagagaaagcagctgataagaacactccagtgagtgataggtatcaggacaatcatctcagaagaatcggatcgaatgtgtcatcttatattaacatggtctgtgagactctaaggaacacggttccgaaagccatcgtgcattgccaagtgaaagaagcaaaaagaaatttgcttaaccgtttctatgctcatgtgggaagcaaggagaagaaacagctgagcgcgatgttggatgaggaccccgctttgatggagaagagggatgccttggtcaagaggctagagctgtacaaatctgcaaggaatgagatcgactcggtcgcatggaaatgattggcttgtgacagctacatctggaatgtatgtaaaatgtacaaccgcagcagcacacgtgtgattgcagtagaatgttcaattcttttttacatttgaatttactctggaggccttgtacgcagttttcactcgagtctttgccggacatgcttatttggccgtcttggccttaacacgattgtgttatgcgtggatgatctggtctccggttgatataagagtgatatatgtattcttttgttgattttaaaaaaaaaaaaaaaagaaaaaaaaaaaaaaaaaa

SEQ ID NO: 25989 - protein, 611 aa, Zea mays
  misc_feature: Ceres CLONE 1398193
  misc_feature (40)..(215): Pfam Name: Dynamin_N Pfam Description: Dynamin family
  misc_feature (224)..(510): Pfam Name: Dynamin_M Pfam Description: Dynamin central region
  misc_feature (515)..(608): Pfam Name: GED Pfam Description: Dynamin GTPase effector domain
  misc_feature: SWISSPROT Homolog: EC 3.6.5.5 Dynamin GTPase
MATMESLIGLVNRIQRACTVLGDHGGGGGEGSLWEALPSVAVVGGQSSGKSSVLESIVGRDFLPRGSGIVTRRPLVLQLHKTDGGHEYAEFLHAPRKRFTDFAAVRKEIADETDRITGKTKAISNVPIHLSIYSPHVVNLTLIDLPGLTKVAVEGQPESIVQDIENMVRAYVDKPNCIILAISPANQDIATSDAIKLARDVDPSGDRTFGVLTKLDLMDKGTNAVDVLEGRQYRLQHPWVGIVNRSQADINKNVDMLSARRKEKEYFESSPEYGHLAHKMGAEYLAKLLSQHLEAVIRAKIPSIIAMINKTIDEIEAQLDRLGRPIGGDAGAQLYTILDMCRAFDRVFKEHLDGGRPGGDRIYGVFDNQLPAALKKLPFDRHLSMQNVRKVISEADGYQPHLIAPEQGYRRLIDSSLSYFKGPAEASVDAVHLVLKELVRRSIAATEELKRFPTLQSDIAAAANDSLERFREDGRKTVLRLVEMEASYLTVEFFRKLPTEPEKAADKNTPVSDRYQDNHLRRIGSNVSSYINMVCETLRNTVPKAIVHCQVKEAKRNLLNRFYAHVGSKEKKQLSAMLDEDPALMEKRDALVKRLELYKSARNEIDSVAWK

SEQ ID NO: 25990 - DNA, 693 bp, Zea mays
  misc_feature: Ceres CLONE 1398195-F
  misc_feature: Encodes the peptide sequence at SEQ ID NO. 25991
  misc_feature (535)..(535): n is a, c, t, g, unknown, or other
aaagctggagctccccgcggtggcggccgctctagaactagtggatcccccgggctgcaggaattcgcacgagaccattacctagaacatcctaatcgaaaaagcaaatcactacacacaccttgtctctaatcagatatcaaagaagtagccattaagttaacgatggcttccgccgacctcgcagaggccatcgagcccagcaggaagaagaagagcaacgtcaagtatgcctccatctgcgccatcctcgcctccatggcctccgtcatccttggctacgatattggggtgatgagcggagcggccatgtacatcaagaaggacctgaagatcacggacgtgcagctggagatcctgatagggatcctcagcctctactcgctcatcgggtccttcgcgggcgcgcggacgtccgacaggatcggccgccgcctgactgtcgtcttcgccgccgtcatcttcttcgcgggcgcgctgctcatggggttcgccgtcactactccatgctcatggggggccgcttcgtggccgnaggttggcgtgggctacgggggcatgatcccgcccgtgtacacggccgaaatctcgcccgcgggggtcccgggggtttcctcacgcctttcccggaaggttcatcaacggtcggattctggtcgtgtacctggaaactttggggttggggcgctacgc

SEQ ID NO: 25991 - protein, 176 aa, Zea mays
  misc_feature: Ceres CLONE 1398195-F
  misc_feature (124)..(124): Xaa is any aa, unknown, or other
MASADLAEAIEPSRKKKSNVKYASICAILASMASVILGYDIGVMSGAAMYIKKDLKITDVQLEILIGILSLYSLIGSFAGARTSDRIGRRLTVVFAAVIFFAGALLMGFAVTTPCSWGAASWPXVGVGYGGMIPPVYTAEISPAGVPGVSSRLSRKVHQRSDSGRVPGNFGVGALR

SEQ ID NO: 25992 - DNA, 703 bp, Zea mays
  misc_feature: Ceres CLONE 1398197-R
  misc_feature (1)..(1): n is a, c, t, g, unknown, or other
ncgattgggtaccgggccccccctcgaggtcgacggtatcgataagcttttttttttttttttttattttaatgaaatgaaatggttgattctttttttgtttagcatcactggctgcaatgagatgaagtttggctgtctaacagacagtgacgcctgatgttgatagcaaattggatggacatgcctaccaactaggggacgcccaaaattcaagaatgcctactcgttggttactgccacacgaagctcaagccagatcttctccgcgaggacccttccctcctgatgaactcatttgccggcaaactccccatcctgagaacatattgccgaacataccccggagaggaaattaggtgccaaggattttcctcactctgccgctgggctggattccgccgattagtggtctgcggtcatgccaaatatccggaaattgcggtccctgtgagctagcgccatgaatgctctgctgctccgaacatgacccaagttgccctccgtggtccccacaatcagggaacgacttgaacagaatcccctgcggcctaaacataacttccccaggaaacccctaaatgggaagcgcccctggggaaagcaggttccccccaaaaatcaatttccaagagtttttggttggacctacctggacccttaaggaaagacaagggcccaaaaatttccctaattttcccag

SEQ ID NO: 25993 - DNA, 678 bp, Zea mays
  misc_feature: Ceres CLONE 1398198-F
  misc_feature: Encodes the peptide sequence at SEQ ID NO. 25994
aaagctggagctccccgcggtggcggccgctctagaactagtggatcccccgggctgcaggaattcgcacgagaccattacctagaacatcctaatcgaaaaaccagctttccccttctctccggtccgggaatcggaagctcagggcagaagtttagccatggggcagacgcatcttttgttgctcgcttgtttctgggtcctgtcaacatgctccttgctacttgatgcttcctccgatggactgttaagaatcaacctgaacaagaagagactggacaaggaagctttgactgctgcgaaattggcgaagaaggagagccaccttcgaaggtctgtgggtgctgaccagtatctcagtgcctcaactgatgacatagtcccctttggacaacctacctggacaccccagtacttttgggacaggatcaggcatcgggcacgcccaccacaagaacttccccaggggattatttcgaacacttgagaaagctccccaactttgtgggggttccccctccatcccaagggggcttaacttttttcccaataagggggggggtttacttttaccccccccccgggaaaataccccggggctccccccccccaggttcccaaaaagaatttttttctcccccccaaaaaaaagggggggaaaaaaatcttttttggtgc

SEQ ID NO: 25994 - protein, 108 aa, Zea mays
  misc_feature: Ceres CLONE 1398198-F
MGQTHLLLLACFWVLSTCSLLLDASSDGLLRINLNKKRLDKEALTAAKLAKKESHLRRSVGADQYLSASTDDIVPFGQPTWTPQYFWDRIRHRARPPQELPQGIISNT

SEQ ID NO: 25995 - DNA, 738 bp, Zea mays
  misc_feature: Ceres CLONE 1398200-F
aaagctggagctccccgcggtggcggccgctctataactagtggatcccccgggctgcaggaattcgcacgagaccattacctagaacatcctaatcgaaaaagctccactccaccacgctctctgcgtatctagttgtcaccggagtaagaatgaagaaaatccagcggcaccgatcgatcgacgactcgcgcgcgatctggtggaggagcgaaagaagaggtgcgcttttccaatccgccggacggagtgtaccgctagctagctccccaggccggagaggaggatgctggtacgaggagcgcagacggctctcttgtgggcgattgagggagctagtcgtgattgagttgtctcggatgcaacatatgcatgtgagtttatacgatatgcttcgcccggcccttgatattcccctccaagaataggctggcaaggaggcctcgggaaactctgggccactgttggtttcctgcccctccatttcaacgactggttctcccgtttcaaggggccatgttgcatattatttaacaggtttatctaagcggccttaccaaattggcccgacgcacactggttttatgcgcctttgcctttgcttcccccattttttttggccggaacgggggcataccgcgtttttttgggaccaggcttgttgtttcttcccaccggttataacttgagtgtgtatgcgcggggaattcataaggctcctgcccagaatgtaacaat

SEQ ID NO: 25996 - DNA, 792 bp, Zea mays
  misc_feature: Ceres CLONE 1398201-F
  misc_feature (470)..(470): n is a, c, t, g, unknown, or other
  misc_feature (596)..(596): n is a, c, t, g, unknown, or other
  misc_feature (597)..(597): n is a, c, t, g, unknown, or other
  misc_feature (601)..(601): n is a, c, t, g, unknown, or other
  misc_feature (691)..(691): n is a, c, t, g, unknown, or other
aaagctggagctccccgcggtggcggccgctctatactagtggatcccccgggctgcaggaattcgcacgagaccattacctagaacatcctaatcgaaaactccttcccctccctctttccacgacaccagaagaaagcgaaaaccatcgacgcgctccgtccaccctcccctaccccgcgtcctcctcccctacgcctgctgggcgagcggcagaaggtaaccgtagatgggcgccgtgacctctacgggcgcggcgcggtgtgcatgtttcccgccgaggccgccgtctgacaggtgctagcaaccggcgccgtttccggcccctgcgacatcccgatcctccggttccggcccaattcgaagtccgccgtctggggggcccgggtttttgtttagccggcgcctttgggggcgggggtcaccaccaaacattttcccgcgtggccggggtgaaagttgaggggccnggtggcgcgaatacttccggtcccttccccaactggggaaggatccttctttcccgaggcggggtttttttcacacgggagtcaaaggttgtgtcccgcgggggccctccatgccttgggtggggnntaangcccggcgcaatcccttttacggccttgggggggcgcaaccacttttggcccgcgaaggggcacccccgcgcgtcttttgcgtcccgccntttcgactttgtccgacgggtgttatgttgcgcggtaggatgggccactaacaaaagcgggccgccaataatctaaattgcgcggggaggaatgtcaaaga

SEQ ID NO: 25997 - DNA, 741 bp, Zea mays
  misc_feature: Ceres CLONE 1398202-F
  misc_feature: Encodes the peptide sequence at SEQ ID NO. 25998
  misc_feature (570)..(570): n is a, c, t, g, unknown, or other
  misc_feature (604)..(604): n is a, c, t, g, unknown, or other
  misc_feature (610)..(610): n is a, c, t, g, unknown, or other
aaagctggagctccccgcggtggcggccgctctagaactagtggatcccccgggctgcaggaattcgcacgagaccattacctagaacatcctaatcgaaaaaaccgcgccgctctctctctctctctcgcacgagccgcgccggcgccgccaccacgcgcgcgggagacagagaccacagccgcagccaccggcgggcggaataggaatggtggcgccggggggaggagcaggaggaggtccgtcgcggtggccggcggcggaggaggaaggatgcgtgcatattagtttccgatgaccccacctgatcatgtacctagctgaacaaatgggactggaactgatcttgtcaaagttgcatgatctcaaatgggaaaccccatcttgacactgtacggaagaaggtggtggagattagtggaagggatgaaacagaggttatggttgctgcttgcccctacagaatttgccctttgggggctcatattgatcatcagggtggagtagtcacagctatgaccataaattatggagtactccctgggtttcgttccctctaatgggtctganggtttacttcattctggtcagtttgaagtgctantagatncagagttgatgacttgcaaaagcctattgataaacctgagacataaactggggaagtatgcaaaaaggtgctgtagtgcactgcagaatattggtatgatctaagggaggtatcataggatatatttctgt

SEQ ID NO: 25998 - protein, 66 aa, Zea mays
  misc_feature: Ceres CLONE 1398202-F
MISNGKPHLDTVRKKVVEISGRDETEVMVAACPYRICPLGAHIDHQGGVVTAMTINYGVLPGFRSL

SEQ ID NO: 25999 - DNA, 702 bp, Zea mays
  misc_feature: Ceres CLONE 1398208-F
  misc_feature (546)..(546): n is a, c, t, g, unknown, or other
  misc_feature (577)..(577): n is a, c, t, g, unknown, or other
  misc_feature (611)..(611): n is a, c, t, g, unknown, or other
  misc_feature (621)..(621): n is a, c, t, g, unknown, or other
gctctagaactagtggatcccccgggctgcaggaattcgcacgagaccattacctagaacatcctaatcgaaaaaaatccacccgcgtcggcacgagcacccacagcagttggcgcgcaccaaaaccctaccctccctctgctctcagccgccaacgccatgggctccaccgccgctgcctccgtgctccggtgtccgccggctcggggagaactcgtcctcatcctcaatacgggtcgaagtacagcacctcattccccgcggggtgggcagctcgggggctctcccctttgggggtccggacggggcccctccccccctgaggggctcccccaccgcccgtattctctttccggggggccccactaaaaccaacccccgggggggcccccctctccccaaggaattccggggttttcgggtttgccggggccccacaagggtccccgggcctctaatgggaaagacccccccccggggcccctccaggaggacccctttttttcccgggggcccccccctggccccgaaaaagagcttccgggntgcgaaggcgcccccggggcgcgcacccccntcaccgctcccgcccccgtcctctcctcccccgnaacacccccngggcggcccaccaccccgggcgcgagccgccccccccgcgcacaggggcgcggcgggcgtgcgctcgccccgccgcgcccc

SEQ ID NO: 26000 - DNA, 719 bp, Zea mays
  misc_feature: Ceres CLONE 1398211-F
  misc_feature (418)..(418): n is a, c, t, g, unknown, or other
aagctggagctccccgcggtggcggccgctctagaactagtggatcccccgggctgcaggaattcgcacgagaccattacctagaacatcctaatcgaaaaaaacgaccccccacctctctaccatacgaaatcccccgcaccctgctcttcgcttcgcttccaatcaccatggtctgacagccagagcaagaccctatccatgcaaattaaataaaagatctgatcgacacatatgcgcttgcgaagatcccgactcccaacaaccacatcgtaagttccccattcctgatgaactgcactgatgcaacctaatgttccttctcatcctacaactaccctattcccgatggatgagcctccccaccgatactcgaagatggacctactacctgcctgacgtttcaagaagtccatgncagatgcgtactccaactgactacagaggcatcctgataccacattgagatcctcgcctagcccatacgagatcttctgaatgtagcatagtacaccctcttgcatgtgcttggcaggaattaacatttgccagtttgaaccaggggacttccaactcctaccagagaagcccaccaccccccccaaaaaagggcggccttacattaaagactttcccccgggacaaataagggtttggaaggccccaaatcccccttgaaaacctttttcggaataaccgggattttgggcccccccgcc

SEQ ID NO: 26001 - DNA, 704 bp, Zea mays
  misc_feature: Ceres CLONE 1398212-F
  misc_feature: Translation starting site: 152
  misc_feature: SWISSPROT Homolog: EC 1.11.1.15 Peroxiredoxin
  misc_feature (275)..(275): n is a, c, t, g, unknown, or other
  misc_feature (393)..(393): n is a, c, t, g, unknown, or other
  misc_feature (556)..(556): n is a, c, t, g, unknown, or other
ggagctccccgcggtggcggccgctctagactagtggatcccccgggctgcaggaattcgcacgagaccattacctagaacatcctaatcgaaaaaaactaaccccaaaccccaatccaccccatcccctcctcatccactccgggcggccatggcctgctccttctccgccgccatcaccgtctcttccgcccctaccccggccgccagacccctcgctgctgccccgcagtccgtctgcatcgctcgctccgcggtcgccaccacttgcaggncgctccgcctcgccgcctcaaggtccgcgcgggctaccagactcgttgcccgcgccagcgtagtcgatgacttgccgctggtccggaccaaggcgcagacttagaaagcgaggctgtngtcgaccaggaagtcatcaacgtgaagctctctgattacattgggaagaagtacgtcattctggtcttctacccctggaatttcaccttcgtctgcccgaccgagatactgcgtttagtgacagatacgaggattttgagaagttgacactgagggttcttgntgttccattgacagggtgttctcccaccttgcatggttgcaaacaaacagaatgccgggggggctcggcgatcttaaatacccacttgtttctgatgggaacaaatcattttcaaaggcctttggggttctgatccctaacaaggtat

SEQ ID NO: 26002 - DNA, 722 bp, Zea mays
  misc_feature: Ceres CLONE 1398213-F
  misc_feature: Encodes the peptide sequence at SEQ ID NO. 26003
  misc_feature (118)..(118): n is a, c, t, g, unknown, or other
  misc_feature (387)..(387): n is a, c, t, g, unknown, or other
  misc_feature (426)..(426): n is a, c, t, g, unknown, or other
  misc_feature (455)..(455): n is a, c, t, g, unknown, or other
  misc_feature (467)..(467): n is a, c, t, g, unknown, or other
  misc_feature (470)..(470): n is a, c, t, g, unknown, or other
  misc_feature (523)..(523): n is a, c, t, g, unknown, or other
caaagctggagctccccgcggtggcggccgctctagaactagtggatcccccgggctgcaggaattcgcacgagaccattacctagaacatcctaatcgaaaaatccgaactccgggnaaaagccccccagcggcctcccctccgccccgcagccatggccgccaccggcgtggtcgccgagccgaagaccaagtacgatcgccagctcaggatatggggtgatcaaggccaggctgcactggagaaggctagcatatgcttgcttaactgtggtcctaccggaaccgaagcattgaagaatctcgtgcttggaggcataggaagtgtgactgttgttgatggctccaaagttgaatcatctgacctggggaaacattttctgttgnatgaaggatgtttggggcaccaagagctaaatctatatngtctttccctacagagcttaatgacgctngtaaggcccagnttntgtgagagtctccagcgcatttgaagatactaaatccttcatcttttcccagnttactgttggtattgctacccagcttccaaagagttttttactgaagctagataattctgcaggaaagcaaaatactttttggttgctggaccgtcaaatggcctacccgggttggccaaggttaccgaaaaggaacatttgggttataaaacaaacccaaacccttttggaagatttggcatttccaaaccctggatg

SEQ ID NO: 26003 - protein, 112 aa, Zea mays
  misc_feature: Ceres CLONE 1398213-F
  misc_feature (78)..(78): Xaa is any aa, unknown, or other
  misc_feature (91)..(91): Xaa is any aa, unknown, or other
  misc_feature (104)..(104): Xaa is any aa, unknown, or other
  misc_feature (105)..(105): Xaa is any aa, unknown, or other
MAATGVVAEPKTKYDRQLRIWGDQGQAALEKASICLLNCGPTGTEALKNLVLGGIGSVTVVDGSKVESSDLGKHFLLXEGCLGHQELNLYXLSLQSLMTLVRPXXCESLQRI

SEQ ID NO: 26004 - DNA, 711 bp, Zea mays
  misc_feature: Ceres CLONE 1398218-F
  misc_feature: Encodes the peptide sequence at SEQ ID NO. 26005
ggagctccccgcggtggcggccgctctagaactagtggatcccccgggctgcaggaattcgcacgagaccattacctagaacatcctaatcgaaaaaaaacccggtttcacactagttctgtattcgtgtcctctggtctctcgcaggccaaacaaaagcgccgctgccgccggcaatgttccgccgcctcctcccccaccgtcgctacatctccacctcgcccgcctccaactccaacccgaccctctactctgacggaaccatcccattctctatcctctcgtggggccgtggcgcttccggacagctcggcggtggcaaggagggagcgcgcctctacccatcccccgtcgcccacctacttctcccgaatcagacccacgccttgctccacccccggacgccttccctctgcaaaggagacttctggattgaagttggaatccctgggggtttttcaatcctcgttcctctccaaggagcccctgggggggggcaaaggccacggagcccccccggccccgggaaaaatttttcccctttggggcccgtttaaacccaaattcccggaattccgccccctttgggtttgggggaatcccccccgcgcggtgaaaacatttccgggggaggcctctcccccggggattggggagattttagaactttgggccccccattattacaaaaaagggttttttcacaaaaaa

SEQ ID NO: 26005 - protein, 126 aa, Zea mays
  misc_feature: Ceres CLONE 1398218-F
MFRRLLPHRRYISTSPASNSNPTLYSDGTIPFSILSWGRGASGQLGGGKEGARLYPSPVAHLLLPNQTHALLHPRTPSLCKGDFWIEVGIPGGFSILVPLQGAPGGGQRPRSPPGPGKNFSPLGPV

SEQ ID NO: 26006 - DNA, 738 bp, Zea mays
  misc_feature: Ceres CLONE 1398220-F
  misc_feature: Encodes the peptide sequence at SEQ ID NO. 26007
  misc_feature (449)..(449): n is a, c, t, g, unknown, or other
  misc_feature (480)..(480): n is a, c, t, g, unknown, or other
  misc_feature (481)..(481): n is a, c, t, g, unknown, or other
  misc_feature (517)..(517): n is a, c, t, g, unknown, or other
  misc_feature (558)..(558): n is a, c, t, g, unknown, or other
  misc_feature (561)..(561): n is a, c, t, g, unknown, or other
  misc_feature (566)..(566): n is a, c, t, g, unknown, or other
tggagctccccgcggtggcggccgctctagaactagtggatcccccgggctgcaggaattcgcacgagaccattacctagaacatcctaatcgaaaaatctcaccacacaccgcagccccagcaagatcgcgcggaggccatggcgaagcccaagccttcctccgccggcgccaagccgaccgcgcctgcgccgccggttacagtgcactcggcgctggtcacctacacctccatgctcgcgctcctgtccctctgcccgcccttcgtcatcctcctgtggtacacgatggtgcacgcggacggatcggtggtgcggacttacgagcacctcagggatcacggcgtgctcgaggggctaaaggccatctggcccatgcccaccctcgtcgcgtgaaagatcatcttcggcttcggcctctttcgaggcgtcctacagctgctgctcccntggaagcgcttcgaaagggccatctcgcctnngcggaacgtgccggtctacaaggcaaatggcttacnagcatatgcagggaccttgataacttacctgggtttggggnggntccgnaatattaacccctgcatagggtatgatcacttgggggagatatactctgctcttggtttttggaggctttgaattctgtatttttccccaacataaaggcccatggattttccatctccatctggactctgaatcctctggggaatgggaaaatttgacttcttactggggt

SEQ ID NO: 26007 - protein, 84 aa, Zea mays
  misc_feature: Ceres CLONE 1398220-F
  misc_feature: SWISSPROT Homolog: EC 1.3.1.21 7-dehydrocholesterol reductase
MAKPKPSSAGAKPTAPAPPVTVHSALVTYTSMLALLSLCPPFVILLWYTMVHADGSVVRTYEHLRDHGVLEGLKAIWPMPTLVA

SEQ ID NO: 26008 - DNA, 670 bp, Zea mays
  misc_feature: Ceres CLONE 1398221-F
  misc_feature: Encodes the peptide sequence at SEQ ID NO. 26009
  misc_feature (474)..(474): n is a, c, t, g, unknown, or other
  misc_feature (625)..(625): n is a, c, t, g, unknown, or other
  misc_feature (628)..(628): n is a, c, t, g, unknown, or other
  misc_feature (666)..(666): n is a, c, t, g, unknown, or other
aaagctggagctccccgcggtggcggccgctctagaactagtggatcccccgggctgcaggaattcgcacgagaccattacctagaacatcctaatcgaaaaatcccacgctgccctcggcgctgcgcctggacccggcacctacctcccccctccccacctcgccgccggcgggtggagtcgggctggagcagccgctctcctctgttacccccctaaccccctataaagaaaaagaaaaaaaaacagagagagagagcgagcgaccggcggctcggcagccatggggcacggcgtcagctgcgcccgcaccggcgacgagcacgactacttccgcgcggcgcaggtcggggacctcgaggccctggacgcgctcctcgacgccgacccctctctcgccccgcgcgccacgctctacgaccggctctccgcgctccacatcgccgccgcgaatggccgcctcgaggtgctgtncatggtcttggatcacggggtgccgccggacgtggtgaatcggcacaagcagacgccgctgatgctcgcggcgatgcacggcaagactgactgcgtgctgaagctccctgcagccgggcgccatatcctcatgggtcgatcccagcacggnggnacctgggctgcacacgcgtcctatttcggccacgtcgntggc

SEQ ID NO: 26009 - protein, 129 aa, Zea mays
  misc_feature: Ceres CLONE 1398221-F
  misc_feature (46)..(78): Pfam Name: Ank Pfam Description: Ankyrin repeat
  misc_feature: SWISSPROT Homolog: EC 2.7.11.1 Non-specific serine/threonine protein kinase
  misc_feature (64)..(64): Xaa is any aa, unknown, or other
  misc_feature (128)..(128): Xaa is any aa, unknown, or other
MGHGVSCARTGDEHDYFRAAQVGDLEALDALLDADPSLAPRATLYDRLSALHIAAANGRLEVLXMVLDHGVPPDVVNRHKQTPLMLAAMHGKTDCVLKLPAAGRHILMGRSQHGGTWAAHASYFGHVXG

SEQ ID NO: 26010 - DNA, 721 bp, Zea mays
  misc_feature: Ceres CLONE 1398229-F
  misc_feature (452)..(452): n is a, c, t, g, unknown, or other
  misc_feature (453)..(453): n is a, c, t, g, unknown, or other
  misc_feature (585)..(585): n is a, c, t, g, unknown, or other
  misc_feature (587)..(587): n is a, c, t, g, unknown, or other
  misc_feature (597)..(597): n is a, c, t, g, unknown, or other
  misc_feature (598)..(598): n is a, c, t, g, unknown, or other
  misc_feature (610)..(610): n is a, c, t, g, unknown, or other
aagctggagctccccgcggtggcggccgctctagaactagtggatcccccgggctgcaggaattcgcacgagaccattacctagaacatcctaatcgaaaaactagtcccaactcccaaccaccgccagccgtccgctctccgcaagcgcgaccttccggccagatccgccgcgtcgcgccgacgagcggtccttctgcctagtttctccgcccagcgagcggcgggttcctcggagattcccgctggccgcggggatccatttgtgactgctcgcgttgcgcctggatctggtttgggacggaggagtgaaacgcgacggtgatcgtgcgaggtgggacgccatcagtgctctgtctggggttcggtctcttcttcggctgcagatctggaaagggttcgtggtatccgtcgctacgatctgtcccagtcagagcacctgcatcatctcgnngtcggccatggagactctgctcatctcggaggagcgcaaccaccagctccaccactttctcgggtcgcggaagaggcgttaacagcgtcgcctcagtccactcgcagctaccatgcggggcactggcgggcngntccactcggnnatcacccgtcgnatcctgccgtccccgcccgcgcaaaaggtttgcactgaccccctcctctcctgagccaagaaacggaacatcagtttcccatgggaaaagggcagccgacatttttataac

SEQ ID NO: 26011 - DNA, 646 bp, Zea mays
  misc_feature: Ceres CLONE 1398230-F
  misc_feature: Encodes the peptide sequence at SEQ ID NO. 26012
  misc_feature (646)..(646): n is a, c, t, g, unknown, or other
ggcttcactagtggattccccgggctgcaggatccctcacgagaccattacctagaacatcctaatcgaaaatccacgagcccaaccggctagcttcttcttcgtccgctgttacccacaccgcgggaagcctccatgcgatcccctgggcggcgcctaccagcgccggcgcggctcgtcgcggctgccctcctcctcgcagctctcaccgggggagccgtcggcgccgatgggtacgggcgggcgaggagggtgtacatgaagaacaaggtcctggagatgtgagtactcagctgccacgtgcttcatccctcccgtcttcggctcttcgccgttcataatctttcttctgtcggatcttgttgtgtgcgcctgggttgtgtatccaacgttgtctagagatgttgtaaacacgaagcctagctcttctaatttgacgagttctgaactgaagttgtaaaacgaatccttacaatgctaatctttttgatttgttgggtcaaatgccaacatttcgagctcacttgtctctggcctaggattggaccattggagtgatacagatacacctcgcaagtcgcaacaaaatttccatgccaacgtgggtggcaaagtctgataagactttgagcttaacttctagtan

SEQ ID NO: 26012 - protein, 49 aa, Zea mays
  misc_feature: Ceres CLONE 1398230-F
MRSPGRRLPAPARLVAAALLLAALTGGAVGADGYGRARRVYMKNKVLEM

SEQ ID NO: 26013 - DNA, 695 bp, Zea mays
  misc_feature: Ceres CLONE 1398237-F
  misc_feature: Encodes the peptide sequence at SEQ ID NO. 26014
  misc_feature (602)..(602): n is a, c, t, g, unknown, or other
aagctggagctccccgcggtggcggccgctctagaactagtggatcccccgggctgcaggaattcgcacgagaccattacctagaacatcctaatcgaaaatgagcactgctgctgctgaaaatggcgcctgcgattgcaaactggctcgcgctggctctgaccgtcctccttggtctctcgtgcctcgtcatcgcgctcacggaggatgaaacactggacaagctgcggttcgtgcgccacgcacaggacgcacccctggagtcgcaatacaactacatcatgatcgagcggcggcatcgacggggtgcccgatggcggggaggctgtctgagcgctcgtgcgagatgatactggagtgaggtgcgctcagatcgcgcatgatgctcgagcatgattaattcatgaactccctggagaagacataaccaaactcaccgccacttggggaactgattgcagaaggcaaggtcaaaacggtgtctatatagcgttactggtgatgatgatgccattacccgtactgggtatgggtctgaaaatacaaagtttgctccataggacatggatgaccaccaaaggaaattattgcataaagctagntggttttcaagaaaaccctttatatcgaccccaccccttggaaaacactttttgaccccctaaccctgccagggcaaggaccccagctaagga

SEQ ID NO: 26014 - protein, 75 aa, Zea mays
  misc_feature: Ceres CLONE 1398237-F
MAPAIANWLALALTVLLGLSCLVIALTEDETLDKLRFVRHAQDAPLESQYNYIMIERRHRRGARWRGGCLSARAR

SEQ ID NO: 26015 - DNA, 666 bp, Zea mays
  misc_feature: Ceres CLONE 1398238-F
  misc_feature (427)..(427): n is a, c, t, g, unknown, or other
aaagctggagctccccgcggtggcggccgctctagaactagtggatcccccgggctgcaggaattcgcacgagaccattacctagaacatcctaatcgaaaaaattccccattcaccaatccccaggattgtaataggggggaaaaacgagagagaagaaacagcagtaggggaggcaatacgaaatggtggtcgccgtcgcgtcgccttcgtcggcggtaccctccgccggccgtccccatccgacatacaaggagatgatcatgcatgtgctgacggagctgcgggaccctagcgggtcgagccgcagagtcatcgccagctacatcggcgaccacttctccggcctccactcgcgccacgatgccctcctctccgtccatctccgcagcctcaagtcccatggccaacttcgcctcgtctctgngaactacttcgtctccaccgccgctcagcggcaggtgcgaggctccaacatcccgcccaaccccaaccctgctccgggtgacaagtgtggtcgggggcggcctcgcaagtacgcagattcagccccttccgcttcgacccctgcgtttcagagcgccaagcgagggcgtggacgcccacgcaatacgcagagcgcccaggacccggtgggttcctccccctccccttctcgttacaggt

SEQ ID NO: 26016 - DNA, 718 bp, Zea mays
  misc_feature: Ceres CLONE 1398245-F
  misc_feature: Encodes the peptide sequence at SEQ ID NO. 26017
  misc_feature (242)..(242): n is a, c, t, g, unknown, or other
  misc_feature (262)..(262): n is a, c, t, g, unknown, or other
  misc_feature (342)..(342): n is a, c, t, g, unknown, or other
  misc_feature (343)..(343): n is a, c, t, g, unknown, or other
  misc_feature (381)..(381): n is a, c, t, g, unknown, or other
  misc_feature (405)..(405): n is a, c, t, g, unknown, or other
  misc_feature (636)..(636): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (684)..(684): n is a, c, t, g, unknown, or other
  misc_feature (694)..(694): n is a, c, t, g, unknown, or other
aaagctggagctccccgcggtggcggccgctctagaactagtggatcccccgggctgcaggaattcgcacgagaccattacctagaacatcctaatcgaaaaccggaatggtatcgtgcgacctgtagtcgtcgccagccacctcgctccctcctagacgacacccagctagtgctcccttccacacccaggaaccagccacctaaccccgcccgccatgccgggcctcgccgcctccgaanactcgcccccgggcgccggngccgccgccgcgccggctctcgtcgccgctaccccgtcgcgcgccgtcgtccccgtcgccgtccgcctcctcgcgcgccnngcctcggaagccctcgccctctcccgcggccttccccnccgacgccgacgactcgctcgacnacccggatctggggcccttcctcctcaagcaggcgcgcgacgccatggtgtcgagcgagggcggtggcgccgcgcgcgcactcgagttcgccgagcgcgccgccatggcgctcgagcgacgcggcgagggcgccgagctcgagctcgccatgagcctccccgtcgccgccgccatccactggcgcctcggccgccacggtgacgccatccccgtcctcgagcgcgccgttncaagtcgtaaggcgcctggtagaatgacttgtcgagggaaagnnnaanccgagggcgntgcaagcggtagggaggaactgca

SEQ ID NO: 26017 - protein, 89 aa, Zea mays
  misc_feature: Ceres CLONE 1398245-F
  misc_feature (63)..(63): Xaa is any aa, unknown, or other
  misc_feature (77)..(77): Xaa is any aa, unknown, or other
  misc_feature (78)..(78): Xaa is any aa, unknown, or other
  misc_feature (79)..(79): Xaa is any aa, unknown, or other
  misc_feature (82)..(82): Xaa is any aa, unknown, or other
MVSSEGGGAARALEFAERAAMALERRGEGAELELAMSLPVAAAIHWRLGRHGDAIPVLERAVXSRKAPGRMTCRGKXXXEGXASGREEL

SEQ ID NO: 26018 - DNA, 774 bp, Zea mays
  misc_feature: Ceres CLONE 1398247-F
  misc_feature: Encodes the peptide sequence at SEQ ID NO. 26019
  misc_feature (292)..(292): n is a, c, t, g, unknown, or other
  misc_feature (376)..(376): n is a, c, t, g, unknown, or other
  misc_feature (460)..(460): n is a, c, t, g, unknown, or other
  misc_feature (495)..(495): n is a, c, t, g, unknown, or other
  misc_feature (544)..(544): n is a, c, t, g, unknown, or other
  misc_feature (583)..(583): n is a, c, t, g, unknown, or other
aaagctggagctccccgcggtggcggccgcttctagaacaagtggatcccccgggctgcaggaattcgcacgagaccatttaacctaagaacatcttaatcgaaaaataaactaagaacgagaagagagagagagggagagaggggaaagttgattctctctctgacccgcccactccctccttccctgctccggtcgcactccgtcgttcctccgcgcacgtacgtacagcagccagacacgagatcgagtggtacagggcccgccagaaacctcacgagctagctggttncctgatcggcggcctgtgccgcgcgccgatccacgcatggcgccgccgctcctgcccgcgcgcttcgtcgccgcctccgtcggnctgctcgccgtcgccttctcctcctctctaacgcgtccgtcaggtgcatacgatccgctcgatccgaacgggaacataacaatncaagtgggacgtgatacagtggactgcggatggcntatgtggccgtcgtttcgctatacaactaccagcagtaccgccaatccngggcgccggggtggaggctaaggctgggtgtgggcgaanaaaggaggtgatctgggcgatgaccggcggccaggccaccgagcagggcgactgctcccggttcaaggccagcgtcctcccccactgctgcagaggggaaccgggaagtggtggacctgctgcccgggaatccctacaacaagcaaaacggccactgcttgcaggggaagagtgctcccctcgtgggcgcc

SEQ ID NO: 26019 - protein, 57 aa, Zea mays
  misc_feature: Ceres CLONE 1398247-F
MTGGQATEQGDCSRFKASVLPHCCRGEPGSGGPAARESLQQAKRPLLAGEECSPRGR

SEQ ID NO: 26020 - DNA, 781 bp, Zea mays
  misc_feature: Ceres CLONE 1398248-F
  misc_feature (296)..(296): n is a, c, t, g, unknown, or other
  misc_feature (297)..(297): n is a, c, t, g, unknown, or other
  misc_feature (298)..(298): n is a, c, t, g, unknown, or other
  misc_feature (299)..(299): n is a, c, t, g, unknown, or other
  misc_feature (300)..(300): n is a, c, t, g, unknown, or other
  misc_feature (301)..(301): n is a, c, t, g, unknown, or other
  misc_feature (302)..(302): n is a, c, t, g, unknown, or other
  misc_feature (304)..(304): n is a, c, t, g, unknown, or other
  misc_feature (305)..(305): n is a, c, t, g, unknown, or other
  misc_feature (307)..(307): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (316)..(316): n is a, c, t, g, unknown, or other
  misc_feature (317)..(317): n is a, c, t, g, unknown, or other
  misc_feature (319)..(319): n is a, c, t, g, unknown, or other
  misc_feature (320)..(320): n is a, c, t, g, unknown, or other
  misc_feature (323)..(323): n is a, c, t, g, unknown, or other
  misc_feature (551)..(551): n is a, c, t, g, unknown, or other
  misc_feature (573)..(573): n is a, c, t, g, unknown, or other
  misc_feature (621)..(621): n is a, c, t, g, unknown, or other
  misc_feature (635)..(635): n is a, c, t, g, unknown, or other
  misc_feature (636)..(636): n is a, c, t, g, unknown, or other
  misc_feature (673)..(673): n is a, c, t, g, unknown, or other
  misc_feature (682)..(682): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (704)..(704): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (725)..(725): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
aaagctggagcttccccgcggtggcggccgcttctaaaactaagtgggattcccccgggctgcaggaattcgcacgaagaccatttaacctaagaacttcctaatcgaaaaaaacaatcgacctagctaggcacaagaagcgctagacgccgcagcgcagcacgcaccacccaccgagcggcggcggaggcagggcaatccgcagggagcagaaggccgcgcgcgaaagcatggggcgcgccggtgcacggcgccctcgccttgttcctcctgctctggggggggacaagggccgnnnnnnnannanaaannnnannannaanccaccacgaccgccaccggcccccgagcaacaggcgcgcccggggaagcgggaccaccgccagcccgagcgggggggcaacacccgaaaccacaccaacgcgaaacggcccaaagcgggaaaaaaaaaccccccaaaacagccaacaaccgacaggaagccaaaaggaaaggggcccacgaaaacgaacaccgggaccccggaaaaaaaggccaaagaacgggaaacnggaacccgggaaacaaggggcnccaggaggggggggcccccaaaaccgaaaaaagcgcccagaaaggggnaaaaaaaaaaaaanncgcccccccccggggggaaccccagaaggcccggggnccccggggnaacaccacccccannnnnnncnggggaagagggnnnnnncccncccgccnnnnnannnnnnnnnnnnnnnnnnnnnnnnnnnnnnncnnnnnnnnnnnt

SEQ ID NO: 26021 - DNA, 763 bp, Zea mays
  misc_feature: Ceres CLONE 1398251-F
  misc_feature: Encodes the peptide sequence at SEQ ID NO. 26022
  misc_feature (570)..(570): n is a, c, t, g, unknown, or other
  misc_feature (594)..(594): n is a, c, t, g, unknown, or other
  misc_feature (616)..(616): n is a, c, t, g, unknown, or other
  misc_feature (701)..(701): n is a, c, t, g, unknown, or other
aaagctggagctccccgcggtggcggccgctctagaactagtggatcccccgggctgcaggaattcgcacgagaccattacctagaacatcctaatcgaaaactagctgatcgcgcgcgcacagggcgagcggacaagaaagcttgctttgtgctcaccggcggcacggaccccctgcgatggaagccgtcggcgtcactcctgcccccgtggcggcgccggacaagaagaagctgcttgacctcaaggaccccttccccgccgccgcgaacggcggcgccgaggcgtcccccgtcggcgaagtgggcgatgaagaagaagctggtggggggcgacgccggcacgtgcctcgaggacgtgccgcacctcacggattacatgccccagctcccgacatacccaaatcctctccaagacaaccctggcgtattcaagtcgtcaacgcagtatttcgtctaacccagacgacaccgtcacgcaaaaaaagattggttgttcataagaccagtgccaggggcaccacaccttccgggcgtgccgggccacggggcagcgggtgtacttccaggnccccaatgaagttgaacgccgccnttgtcaaccctgtggaggcctnttggcccgggaattgaacacggtcatcccgccgagctttgtttgccggcttgaaaggaattatgtatggcgtctcccagcgtccncgggatttaagaggggggaaatacaaggggtttctattctaaaaaataactgttgcgttgaa

SEQ ID NO: 26022 - protein, 49 aa, Zea mays
  misc_feature: Ceres CLONE 1398251-F
MKKKLVGGDAGTCLEDVPHLTDYMPQLPTYPNPLQDNPGVFKSSTQYFV

SEQ ID NO: 26023 - DNA, 691 bp, Zea mays
  misc_feature: Ceres CLONE 1398253-F
  misc_feature: Encodes the peptide sequence at SEQ ID NO. 26024
  misc_feature (504)..(504): n is a, c, t, g, unknown, or other
  misc_feature (543)..(543): n is a, c, t, g, unknown, or other
  misc_feature (562)..(562): n is a, c, t, g, unknown, or other
  misc_feature (577)..(577): n is a, c, t, g, unknown, or other
  misc_feature (578)..(578): n is a, c, t, g, unknown, or other
  misc_feature (598)..(598): n is a, c, t, g, unknown, or other
gctctagaactagtggatcccccgggctgcaggaattcgcacgagaccattacctagaacatcctaatcaaaaattcctctctccttttgtgcccctaactagctagaactactgctgctcctccgacttgctcttctcgcagcaggaggcataaagaagaaccatccctccccctaccggctaccgctgatactcatggacgcgcgcactgcctcctgtggtcgccgcgttatgatccagacatgaataggatgcacagcagcagctcctagctcatcaacgagaagctcgtggaacaccggatctccactgcgaagcactgcccccactgcggcgagaaaatcgacagcaaaccggattgggtggagctgccggcaggcgtcaagttcgatccaactgaccaggagctgatcgagcacctcgaggcgaaagtgaaggatgaaggctcgagatctcccttctcatcgacgagttcataccccacatagatgggggaggacggnatatggtacacccaccccgagaaacttccaggtgtgacnagggatggcctaggcaagnacttcttccacgggnncgtcaggcctacacgagggnacggaggaagaggaggagatcccgacggagtgggacgtccacagggggaagaagagggggaacaaaacggcaaaaacccggccggggaggtga

SEQ ID NO: 26024 - protein, 67 aa, Zea mays
  misc_feature: Ceres CLONE 1398253-F
  misc_feature (25)..(25): Xaa is any aa, unknown, or other
  misc_feature (30)..(30): Xaa is any aa, unknown, or other
  misc_feature (37)..(37): Xaa is any aa, unknown, or other
MGEDGIWYTHPEKLPGVTRDGLGKXFFHGXVRPTRGXGGRGGDPDGVGRPQGEEEGEQNGKNPAGEV

SEQ ID NO: 26025 - DNA, 726 bp, Zea mays
  misc_feature: Ceres CLONE 1398255-F
  misc_feature: Translation starting site: 195
  misc_feature: SWISSPROT Homolog: EC 2.3.3.1 Citrate (Si)-synthase
  misc_feature (609)..(609): n is a, c, t, g, unknown, or other
aaagctggagctccaccgcggtggcggccgctctagaactagtggatcccccgggctgcaggaattcgcacgagaccattacctagaacatccctaatcaaaaaagcaaccacttctgctctgcatcccgtctgggcctctgcatttgcttggctgctgctcccttctcccaccgaccaactcgatcccgcgccatggatcgcgccgaccccgcgcggggccgccttgccgtgctctcctcccacctccgtggtgcaggggccgaggaggcggcggggctggagaggtcgccggtatccgcgccggcgcccgggccccgcgccggcgcgcttgccgtggtggacgggaggaccgggaagcggcacgaggtcaaggtctccgaagacggcaccgtgcgcgccaccgacttcaagaagattaccactggaaaggacgacaagggtcttaagatttatgatcctggttaccttaacactgcccctgttcgctcgtccatctgctacatcggatggagatgagggaatccttccgctatagggggtatccaatcgaagaagtggctgaaagcagctcggtttgttgaggtggcctacctttttattggatggnaacttggctactcagagtcaattggcaggctgggaaattgctatttctcagcattcggctgttccccaggaatgggtggaaatcatacaatcaagggcccaggagctcccccccagg

SEQ ID NO: 26026 - DNA, 753 bp, Zea mays
  misc_feature: Ceres CLONE 1398257-F
  misc_feature (392)..(392): n is a, c, t, g, unknown, or other
  misc_feature (424)..(424): n is a, c, t, g, unknown, or other
  misc_feature (468)..(468): n is a, c, t, g, unknown, or other
  misc_feature (474)..(474): n is a, c, t, g, unknown, or other
  misc_feature (475)..(475): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (483)..(483): n is a, c, t, g, unknown, or other
  misc_feature (507)..(507): n is a, c, t, g, unknown, or other
  misc_feature (509)..(509): n is a, c, t, g, unknown, or other
  misc_feature (510)..(510): n is a, c, t, g, unknown, or other
tggagctccccgcggtggcggccgctctagaactagtggatcccccgggctgcaggaattcgcacgagaccattacctagaacatcctaaaaaaaatcttatttcactgccagccctctgaaaaaaaaattaaaaaatgaggtcccagttccacccacctagagagccaaaagagccggcggtggccggcagccaaaacccacgttggattttgccgccgccgcctggagctaggggacaaggcaacgccggccggtgcaacatttatgcgtgtaccaggcagaccagcccggcagccacgcgtacacttctgccgcaaagctaaacgcgccactccgcggcaagctgctctgctgctcccaccagcacccgcaccgagtgccaatggcgantgcagcgagttcgaacgccggcggcgcgcagncctactctgggtctgcgcgtctggacccgcgcggttgccccggnagaggnnannnnggnaggtttgcgccgctgcggcgtccngnngggcccaacggggcgaaatttccggggccggttggctcgacagttcaaagccatggagggacctgggccgggttttttggccagccccgtttgggtccccgtaatggaactaagggggggaattttggggaggggggccccaaaccccaggcaaaaattgacccccgggtttggggcggctttctaggggaaagaggggtttggaacttaaaatattggccattcccaaatttcaaggggttt

SEQ ID NO: 26027 - DNA, 748 bp, Zea mays
  misc_feature: Ceres CLONE 1398259-F
  misc_feature: Encodes the peptide sequence at SEQ ID NO. 26028
aaagctggagctccccgcggtggcggccgctctagaactagtggatcccccgggctgcaggaattcgcacgagaccattacctagaacatcctaatcgaaaactccttcccctccctctttccacgacaccaaaagaaaccgaaaaccatcgacgcgctccgtccaccctcccctaccccgcgtcctcctcccctacgcctcccagcccagcggcaaaacctaaccctagatgggcgccgtcacctctacggtcgcggtgcgctttgcctttttcccgccgagcccgccgtcgtacgggttcgagcagccggcgtcgcttccggcccctgccacacccgagcctccggacccggccacatccaagccgtcgcctccggacccggccacacccaaggcgccgcctgcggccccggccacacccaagcgcccgtcaagtggacaggagaaggacgtgcgacgtgggagcaggagctctcgggcgcaccgcggagtggtaacgtgtagggcatgggggcttgcgtgacgaaacgttgcacggcaggtgatcgcgatgaacgcgacgccagtgattggccacgctcacgctgctctactcgcacggtgacgtcgccgatctcgggcagatgtgcgagctcttcagcgagatcagtgccctcgtgacggcaacctcatggggtatgacaatgctgtttagggtaaccgaacgggaagctagcgagaaaactcttatgtgactacaagcggtag

SEQ ID NO: 26028 - protein, 97 aa, Zea mays
  misc_feature: Ceres CLONE 1398259-F
MGAVTSTVAVRFAFFPPSPPSYGFEQPASLPAPATPEPPDPATSKPSPPDPATPKAPPAAPATPKRPSSGQEKDVRRGSRSSRAHRGVVTCRAWGLA

SEQ ID NO: 26029 - DNA, 715 bp, Zea mays
  misc_feature: Ceres CLONE 1398261-F
  misc_feature: Encodes the peptide sequence at SEQ ID NO. 26030
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
aaagctggagctccccgcggtggcggccgctctagaactagtggatcccccgggctgcaggaattcgcacgagaacattacctaaaacatcctaatcgaaaaactccacccacgcctccactacaccacacagagccgcagcagactcgcaagggaaaggagatggatcgtctgcccgagtcgacccggagcatgaggaagtacgcgtcgggaggccggcgggcttcgcgcggcgcgcagggccccccacgggcggtcgctgacggcgcgcacggcgcacagcatgtccacgacggctctgcgcaccaagtccaagtcggacgcgtcgctgctgcgcagggtgcccttcgcgccgctccgccccgtcctcgccaacctgcaagaggtgttcctcgccaccaagctcgccgagctattccccgccgtgtcgctcgccatcgccgcccagtgcgcgcacttcggaaaggtgtgtgtggttacactcacgctactcggcctcatccccctcgccgagcgtgtcatcttcctcaccgagcagatcgcgatatacaccggacccaccgtgggcggactcctcaacgcgacgtgcgtcaacgccgcggagctcatcatcgcgctcttcgcgctcatgggggggcagatcgaggtcggcaagggctccctcttccggnnnnnnnnnnnnnnnnnnnnnnnnnnnnnnnnnnnnnnnnnnnnn

SEQ ID NO: 26030 - protein, 129 aa, Zea mays
  misc_feature: Ceres CLONE 1398261-F
MSTTALRTKSKSDASLLRRVPFAPLRPVLANLQEVFLATKLAELFPAVSLAIAAQCAHFGKVCVVTLTLLGLIPLAERVIFLTEQIAIYTGPTVGGLLNATCVNAAELIIALFALMGGQIEVGKGSLFR

SEQ ID NO: 26031 - DNA, 720 bp, Zea mays
  misc_feature: Ceres CLONE 1398264-F
  misc_feature: Encodes the peptide sequence at SEQ ID NO. 26032
  misc_feature (327)..(327): n is a, c, t, g, unknown, or other
  misc_feature (451)..(451): n is a, c, t, g, unknown, or other
  misc_feature (492)..(492): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (524)..(524): n is a, c, t, g, unknown, or other
aaagctggagctccccgcggtggcggccgctctagaacaagtggatcccccgggctgcaggaattcgcacgaaaccattacctagaacatcctaatcgaaaagagctcaaacacacatcaagaaagcaagaaaagaaaagctgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgaccaccgggnccggcgggtttccccagcagtgtggcactgacgaacacgcttcagcgggccgtcgtcgttctcgcgcttatccttgtcgtcgcctcggcgacgagagcccgaacaggaggtcgcccctgtgacnaattgaaaggacgtggacctcagctctcatcaggccgcggnccgacgacggggagttccgccgcgcgnnnggncggaaggtccacggcagcaaaaaatttggaaagggtctgctggaccccattcggacggcgtgctccctccaggagctcatccgcttaacgcgagttcgcccaggccacctacgacagcttcgactacgaccgcttctccccctactgcggcagctgcaagaacccggcgaagactttcttccacgacgtccggctt

SEQ ID NO: 26032 - protein, 58 aa, Zea mays
  misc_feature: Ceres CLONE 1398264-F
  misc_feature (19)..(19): Xaa is any aa, unknown, or other
MAATVSSCLSLVPTVTTGXGGFPQQCGTDEHASAGRRRSRAYPCRRLGDESPNRRSPL

SEQ ID NO: 26033 - DNA, 693 bp, Zea mays
  misc_feature: Ceres CLONE 1398265-F
  misc_feature: Pfam Name: NAD_binding_4 Pfam Description: Male sterility protein
gggagctccaccgcgggtggcggccgctctagaactagtggatcccccgggctgcaggaattcgcacgagaccattacctagaacatcctaatcgaaaagtctttctccccttcctgctttccctctccagctctcatacacaaacacacggagctagcagcacggatcgagagaacaatggaggaaacaagcaggatccctgggtactttcagaacagggcatcctgatcacgggcgcaacaggcttccttggaaagatcctcgtgagaagatactgagggtccagccggacgtaaagaaggactacctcccccggcggggggcccggaggtgcatcaccaaaaaaaggggggaaaacttgagggatcggaaaaggactttgtttggcctttccccaaaaaacccgggaaaaaagttcccccccttcctcggagggaaaaaggggccccgtttgggcgcgggaaaatttccccaaaaaaacgggggggggggggggggccccccctggggggggggaaaccccccgaaccccccaccccccccgggggggggggggccccaaaaatttttctccaagaagaccccccggcccccccccagggaaaaaagggggggggagaaaaaaaaaattttcccttggggggaaacaacggcccccccccctgggggggggggcccccccctgggggccc

SEQ ID NO: 26034 - DNA, 766 bp, Zea mays
  misc_feature: Ceres CLONE 1398267-F
  misc_feature: Encodes the peptide sequence at SEQ ID NO. 26035
  misc_feature (438)..(438): n is a, c, t, g, unknown, or other
  misc_feature (542)..(542): n is a, c, t, g, unknown, or other
  misc_feature (562)..(562): n is a, c, t, g, unknown, or other
  misc_feature (665)..(665): n is a, c, t, g, unknown, or other
  misc_feature (667)..(667): n is a, c, t, g, unknown, or other
caaagctggagctccccgcggtggcggccgctctagaactagtggatcccccgggctgcaggaattcgcacgagaccattacctagaacatcctaatcgaaaaagcacaagaacactcctagctagctaaagatctcgagtgcaacgcaacgttggcgcttggcggccagtagtagcagctaatttagcgtcgctccttcctagacgagagatcgagaaaccatggccaagctccaagtcactcctggcgccgcgttcaccgagtgcaatgaactcaacttccagggcctgtacctgtaccacacgcccctgggccccaaggccaaccaagctgcgatcgtagagagcaagggcaagatcggcatcggtgccaccgtggttaacaactgggcagtgtatgacgggccagggccaggcgctaagcctcgtcggccgtgncgcagggcttgcacatcctagcccggcaactgggtcaactcattccaccctggtgttcgaggatgaaagggtttcagtgggccaacgctttgaaagtgaggggncataacggttgaaacttgcnagtgggggcttgtttgttgggggcacccggccagttttgctatggcgaacggatctcccctccaagaagtccacgagcagaagagccgacgggaacgtcatangnagcttagtgtccatgcattctgcccgctgtcaaagggaaaaaggggccggggctgggaacaaagggtgggccatggggggggaaagcggagggtctccc

SEQ ID NO: 26035 - protein, 78 aa, Zea mays
  misc_feature: Ceres CLONE 1398267-F
  misc_feature (72)..(72): Xaa is any aa, unknown, or other
MAKLQVTPGAAFTECNELNFQGLYLYHTPLGPKANQAAIVESKGKIGIGATVVNNWAVYDGPGPGAKPRRPXRRACTS

SEQ ID NO: 26036 - DNA, 760 bp, Zea mays
  misc_feature: Ceres CLONE 1398271-F
  misc_feature: Translation starting site: 646
  misc_feature: SWISSPROT Homolog: EC 1.2.1.3 Aldehyde dehydrogenase (NAD(+))
  misc_feature (264)..(264): n is a, c, t, g, unknown, or other
  misc_feature (501)..(501): n is a, c, t, g, unknown, or other
  misc_feature (555)..(555): n is a, c, t, g, unknown, or other
  misc_feature (589)..(589): n is a, c, t, g, unknown, or other
  misc_feature (660)..(660): n is a, c, t, g, unknown, or other
  misc_feature (678)..(678): n is a, c, t, g, unknown, or other
  misc_feature (679)..(679): n is a, c, t, g, unknown, or other
  misc_feature (723)..(723): n is a, c, t, g, unknown, or other
aaagctggagctccccgcggtggcggccgctctagaactagtggatcccccgggctgcaggaattcgcacgagaccattacctagaacatcctaatcgaaaagtactcccgtccaaggcagcagagaccagagagcgaaggaggccaaggccatcgctctcctagcctcggagacttgcctttgcatacacatccccccggagggcggtggccggagctgacccctgatcggacgcgcttagcgcctgagggcatggctgcaancgtgaggagggctgcttcctccgtcctctctcgcttcctcctcacaaagccttcgccttcgcctgcttctgccgccggcaataattccgctctcctcggatcaggggctgctgctcttcacaggttcagcaccgcacggcatccgcggccggggccgcagaggagcgacccaagcccgggggtgaaggtgaagcacacccagctcctcatcaatggcaacttcgtcgacgctgctcntgtgggaagacgtttcccgacgctggaccgcgcaaaccggcgaggtccatccgncgcggtcgccgagggcggacagcgaggactccgnaccgcgccgtggcgggccgcccgcaaggcccttcgacgagggcccgtgggccgaggatgacgccctacagncggtgccgcgtgctgctnncgcttcgcggacctgatcgaggggcaccgcggaggaggtcgcgncgcctggagaagggggacaacggcagacgctggcgca

SEQ ID NO: 26037 - DNA, 704 bp, Zea mays
  misc_feature: Ceres CLONE 1398273-F
  misc_feature: Encodes the peptide sequence at SEQ ID NO. 26038
  misc_feature (408)..(408): n is a, c, t, g, unknown, or other
ggagctccccgcggtggcggccgctctagaactagtggatcccccgggctgcaggaattcgcacgagaccattacctagaacatcctaatcgaaaagtttttcctgatctcgcctcccgagccacacacgttgccgccgtgagccgccgcccacaaggctaagcaccaaccatggccttcggagctctcgtcacgtcgaggctggccaggtccggccgcacccttgcatctgccgttgcccagggtcccgttgcccagcggatagcacctcctctgctctccaggcttggagcagtagctcgtcttctcagcacaaagccagccgcaacagatgtcatcggtatcgatctaggcactacgaattcctgcgtctccgtcatggaaggaaagacaccacgggtgattganaatgcagaaggcgcgaggacgacaccctccattgttgccaagaatcagaatggtgaccctgttgattggtattacagcgatgcggcaggcagtaaccaatgccagaacccaattcgtgggtcaagcgtcttattcggtaggacttttgatgaccacagacccagaaggaagatgaagatggtgccttaacagatgtcagggcgccaatggtgatgcctgggcccaggatggtggccagaatcttcccaagccaaatgggggcattggtccccctaaaagaagaaacggcaagggtt

SEQ ID NO: 26038 - protein, 141 aa, Zea mays
  misc_feature: Ceres CLONE 1398273-F
  misc_feature (79)..(79): Xaa is any aa, unknown, or other
MAFGALVTSRLARSGRTLASAVAQGPVAQRIAPPLLSRLGAVARLLSTKPAATDVIGIDLGTTNSCVSVMEGKTPRVIXNAEGARTTPSIVAKNQNGDPVDWYYSDAAGSNQCQNPIRGSSVLFGRTFDDHRPRRKMKMVP

SEQ ID NO: 26039 - DNA, 725 bp, Zea mays
  misc_feature: Ceres CLONE 1398274-F
  misc_feature: Encodes the peptide sequence at SEQ ID NO. 26040
  misc_feature (227)..(227): n is a, c, t, g, unknown, or other
  misc_feature (325)..(325): n is a, c, t, g, unknown, or other
aagctggagctccccgcggtggcggccgctctagaactagtggatcccccgggctgcaggaattcgcacgagaccattacctagaacatcctaatcgaaaaatcacacactcgactctcctctctcgcatccgcagcctttcgagctctactccaccccctcgatctcgaagcgcagcagcagcagtcaggcggccatggacgcgagcgcagccggagccggcgganaggcgaagaagggcgcggccgggcgcaaggccggcgggaccgaggaagaagcgggtgacgaggtccgtcaaggccgggctgcagtttcccgtcggcgncatcgggcggaccctgaaagaagggccggtacgcgcagcgcgtcggcacgggcgcccccgtctacctggccgccgtcctcgagtacctggccgccgagatgctggagctggccggcaacgctgccaaggacaacaagaagacccgcatcatcccgcgccacgtgctccttgccatccgcaacgacgaggagctcggcaagctggctgtccggcgtcaccatcgccccacggcggcgtcctccccacatcaacccggtgctcttgcccagaagaccgctgagaaggcggcggccaaggaggccaagtcgcccaagaaggccgccaagtcccccagaaggcataagaggggcgggcgcctttcccgctgtgatgttgaatgctcgtgttcagtagatcttta

SEQ ID NO: 26040 - protein, 100 aa, Zea mays
  misc_feature: Ceres CLONE 1398274-F
MLELAGNAAKDNKKTRIIPRHVLLAIRNDEELGKLAVRRHHRPTAASSPHQPGALAQKTAEKAAAKEAKSPKKAAKSPRRHKRGGRLSRCDVECSCSVDL

SEQ ID NO: 26041 - DNA, 741 bp, Zea mays
  misc_feature: Ceres CLONE 1398276-F
  misc_feature: Encodes the peptide sequence at SEQ ID NO. 26042
  misc_feature (228)..(228): n is a, c, t, g, unknown, or other
  misc_feature (344)..(344): n is a, c, t, g, unknown, or other
  misc_feature (351)..(351): n is a, c, t, g, unknown, or other
  misc_feature (386)..(386): n is a, c, t, g, unknown, or other
ggagctccccgcggtggcggccgctctagaactagtggatcccccgggctgcaggaattcgcacgagaccattacctagaacatcctaatcgaaaagactcccgtgctctctctctctctctctctcggatccgaattgccagcgcaccagtcgagctcgcgggaactcgccggcaccggcgatggcctccgccctactggccggacagggcggggcgcgccaccacnggctgggggggagacgcgcgccccactcgcgcccatacctcccaaccctaaccccagccagccccacccgcgcgccgacgggtccaagtccaagccgcgggcggcagcctcctcgncggcggncggatacgtgacgtcccggcccggcgtccctgggncccgcgcgagggccgcgcgctccgggacggggctcgcgggggaagttcccccagggggcgcgccttcttctcccgcatcggaacctgggaagaaaaaggcccgccgccccggggggctcccggggggaggggcgaaacggggcggggaaatcctcaccaggtttggcagggaaaaggggaagggggggggtcaccgcgcccctcaaaggggaacccccggcccccaaaaaaaaacccccggaataaagggcccaggaacctcggacccctaaggggggcctccccccccggaggagcccccccaaaaaaaatttgggggggaggtcccccttccttatcccgcggggggggggag

SEQ ID NO: 26042 - protein, 59 aa, Zea mays
  misc_feature: Ceres CLONE 1398276-F
  misc_feature (16)..(16): Xaa is any aa, unknown, or other
  misc_feature (57)..(57): Xaa is any aa, unknown, or other
MASALLAGQGGARHHXLGGRRAPHSRPYLPTLTPASPTRAPTGPSPSRGRQPPRRRXDT

SEQ ID NO: 26043 - DNA, 735 bp, Zea mays
  misc_feature: Ceres CLONE 1398277-F
  misc_feature: Encodes the peptide sequence at SEQ ID NO. 26044
  misc_feature (392)..(392): n is a, c, t, g, unknown, or other
  misc_feature (425)..(425): n is a, c, t, g, unknown, or other
  misc_feature (463)..(463): n is a, c, t, g, unknown, or other
  misc_feature (505)..(505): n is a, c, t, g, unknown, or other
  misc_feature (507)..(507): n is a, c, t, g, unknown, or other
  misc_feature (508)..(508): n is a, c, t, g, unknown, or other
  misc_feature (513)..(513): n is a, c, t, g, unknown, or other
  misc_feature (570)..(570): n is a, c, t, g, unknown, or other
  misc_feature (618)..(618): n is a, c, t, g, unknown, or other
  misc_feature (721)..(721): n is a, c, t, g, unknown, or other
aaagctggagctccccgcggtggcggccgctctagaacaagtggatcccccgggctgcaggaattcgcacgagaccatttacctaaaacatcctaatcgaaaaaactccccaagtcgagcaacaggccaaacccccagccgccggaagccgctaccgctagcacctccgaatcgagtcggcgccatggaagacgtcatcaccgacgtgccgccgccttcccgcttttcccctgacgacctcgacaacttcgccgctccgccagcgcagcccacccccatcttcgtcgtttccccgaaccctagcccaccggcccgcgccctcctcgtcgtcttcatctcccccacctccctcgcgctcctcgcctccccgccgccgctccacgcatccctgnctcctcccggacctgcccctactcccgcacggncccatgcgcgtgtacctccacccctccggcggctcccntcgccggcgggcacggcgccttcccgcccaccgcgcgcgcgncnngccgngaaaggctcttgtctccaggctccgcccggaggaaggggctggtttttggacgcggnccgggacgggacgtaccggggccgcctcgccgcggacgagcccgtggnaagggaagttggagacccgcgcggcgcgcgcgctgggtaggccgtggaggctgccaaggtagtccaggcttctgttccacccgggcagcgggggtgggacggncatcggcgccgtta

SEQ ID NO: 26044 - protein, 157 aa, Zea mays
  misc_feature: Ceres CLONE 1398277-F
  misc_feature (70)..(70): Xaa is any aa, unknown, or other
  misc_feature (81)..(81): Xaa is any aa, unknown, or other
  misc_feature (108)..(108): Xaa is any aa, unknown, or other
  misc_feature (110)..(110): Xaa is any aa, unknown, or other
  misc_feature (129)..(129): Xaa is any aa, unknown, or other
  misc_feature (145)..(145): Xaa is any aa, unknown, or other
MEDVITDVPPPSRFSPDDLDNFAAPPAQPTPIFVVSPNPSPPARALLVVFISPTSLALLASPPPLHASLXPPGPAPTPARXHARVPPPLRRLPSPAGTAPSRPPRARXAXKGSCLQAPPGGRGWFLDAXRDGTYRGRLAADEPVXREVGDPRGARAG

SEQ ID NO: 26045 - DNA, 758 bp, Zea mays
  misc_feature: Ceres CLONE 1398280-F
  misc_feature (293)..(293): n is a, c, t, g, unknown, or other
  misc_feature (381)..(381): n is a, c, t, g, unknown, or other
  misc_feature (386)..(386): n is a, c, t, g, unknown, or other
  misc_feature (437)..(437): n is a, c, t, g, unknown, or other
  misc_feature (608)..(608): n is a, c, t, g, unknown, or other
  misc_feature (669)..(669): n is a, c, t, g, unknown, or other
  misc_feature (671)..(671): n is a, c, t, g, unknown, or other
  misc_feature (709)..(709): n is a, c, t, g, unknown, or other
  misc_feature (746)..(746): n is a, c, t, g, unknown, or other
aaagctggagctccccgcggtggcggccgctctagaactagtggatcccccgggctgcaggaattcgcacgagaccattacctagaacatcctaatcgaaaaattggcactggcagctgcactcaccggaagccatggaagacttgctctactactccctcaccatagccatctgcatcgcagtcatcgccctcctctccatccttcgttcgttcaccgctaccggaccgccgccggcgctcccgcccggcccgtcgctgctgtcgctgatcaccccgctcctcttcctcggncgaacgaacttcggcatcgagcggatcctctcccgccgcgcggtcccgctacggccccgtcttcacgctctacctgctcccgtcccgnccggncatcttcatcgccgaccacgccgtggcgcaccgcgtgctggtgcagggcgncgccccctttcgccgacgggccggcggccaagcttccctttccgccttttctcaggggaacagggaaaattaaatccggggccaagggcccgggggggggggggtcccgcaaaacctccgggggaacgtggtcccccccccgggatggggccgggtttccccccccccccncccgggggttgtggggactcctcccccgcggtcgcggggaaaccgggaagggggccccctnanggaaggggccccgcccgcggcattttccccccgccggnccaggggttggggggagaccccccccaaacagggggnccccccggagaa

SEQ ID NO: 26046 - DNA, 779 bp, Zea mays
  misc_feature: Ceres CLONE 1398282-F
  misc_feature: Encodes the peptide sequence at SEQ ID NO. 26047
  misc_feature (289)..(289): n is a, c, t, g, unknown, or other
  misc_feature (348)..(348): n is a, c, t, g, unknown, or other
  misc_feature (374)..(374): n is a, c, t, g, unknown, or other
  misc_feature (375)..(375): n is a, c, t, g, unknown, or other
  misc_feature (395)..(395): n is a, c, t, g, unknown, or other
  misc_feature (403)..(403): n is a, c, t, g, unknown, or other
  misc_feature (405)..(405): n is a, c, t, g, unknown, or other
aaagctggagctccccgcggtggcggccgctctagaactagtggatcccccgggctgcaggaattcgcacgagaccattacctagaacatcctaaaaaaaaaggaattctgccttcttctctcatcttcctgctcaacatcagtagcagctttagctgtagcagcgccaccggccaccgccacgccatggccaccacgttgcacaagcccctgggggcgatcaccgttgacgacctcgccgcggcggcgcctgggtcggacgccaccgcgctccacgcagcgctccggngcgcgctcgactcgcacggacccacccgaagtgtggggcgagctctggcggtccgtgcntctggtcgtctgtcccctttcgcgtnncacggatgctctactacggntgcttcgncngggtcccgtctcccacgccgcccgcctggacgccgaaccccaaggagctggcttgaccaatgggcgccggggcctccaggggggggggtaaggaacttcatggggggacggaaaaagaattcccttaccagtttccccagaacccccaaaggttcccccaaaaaaaaccccaaggggtatgggaaaaaggggattttggaagtaatggggaatccccattcgggggaaaaccccttccgggctcgggaggaaaaaaacttcgtatacccgggggggggggaggggtaaaaaggggccaaaattaaacaggggggggaaaatgtggtggggcgcaaacaccgcggggggggcttccccccccgcccgcccttttt

SEQ ID NO: 26047 - protein, 168 aa, Zea mays
  misc_feature: Ceres CLONE 1398282-F
  misc_feature (35)..(35): Xaa is any aa, unknown, or other
  misc_feature (63)..(63): Xaa is any aa, unknown, or other
  misc_feature (70)..(70): Xaa is any aa, unknown, or other
  misc_feature (73)..(73): Xaa is any aa, unknown, or other
MATTLHKPLGAITVDDLAAAAPGSDATALHAALRXALDSHGPTRSVGRALAVRASGRLSPFAXHGCSTTXASXGSRLPRRPPGRRTPRSWLDQWAPGPPGGGVRNFMGGRKKNSLTSFPRTPKGSPKKNPKGYGKKGILEVMGNPHSGENPFRAREEKNFVYPGGGEG

SEQ ID NO: 26048 - DNA, 776 bp, Zea mays
  misc_feature: Ceres CLONE 1398283-F
  misc_feature: Translation starting site: 182
caaagctggagctccccgcggtggcggccgctctagaactagtggatcccccgggctgcaggaattcgcacgagaccattacctagaacatcctaatcgaaaaatttcggccacaccctccttgcctccacggctccacccctgcttcaggttacctgtgccagcgacgccggtagaagccatggacagctctctcgcgagcgcggcggcgatagccgatcagcgccagaagatcgagcagtaccgccacatcctcgcctccgtcctctcgtcttccccaccggacatctctcaggccaagcgcttcctcgaccacatggtttcggacgaagttccgctcgtggtgtcgcgtcaattgctccagacgttcgcaggacctagggaagctggagtcggacgcgcagaaggaggttgcccactacgcgctcacgcagatccagccgcgtgtggtctcctttcgagagcaggtggtagtgattaaagagaaacttgcagagctatatgagtctgaaacacaatggtcaaagcagcacaatggcttaggggattgacttggatccggaatcaggatggttggatgacccacaatttacccaggggggttcaaatggccaaccttttttaaaggttatataacccggaaaggcttaggttttaaaaacaggtttccttttgtgccccacagcccccccggggggttaaattaaaaaaaagggtgttttttaaaagatttttgtgtataaaaaaaaaatttcgggaaacgcctcttcttattt

SEQ ID NO: 26049 - DNA, 738 bp, Zea mays
  misc_feature: Ceres CLONE 1398286-F
  misc_feature (385)..(385): n is a, c, t, g, unknown, or other
  misc_feature (719)..(719): n is a, c, t, g, unknown, or other
catagctggagctccccgcggtggcggccgctctagaactagtggatcccccgggctgcaggaattcgcacgagaaccattacctagaacatcctaatcaaaagatcttatgcttccatctctgaggctgccgccagccaccggccagcgtcgttcgctttgtagcagtccagctctgcgcccggcgccgcagccccgcatcgcgcacaggcacaatcttctacggttctgccgctgatcgccgcacgtggccgcgccgccgcctccctcacccgagctcgaccgcgcttctccagctcgccgcctcgacggtagatgcctcgacacctcccccgcgtgagcatcagcgcgggagcagagagccctggtccctggaggcgcgtgnggttacaggcgggttcgcggtctcaccagtggcccttagtcgatcggtcctcgcccggcagactcgtctcctcggtgttgcgctcctgggctgctgcgcgaccagagccgagtccagtgctgataacttgccgcatgctgctcccgccgacgaagccgacatgcgactcgacctgtcacacctagccgcctctgtccaggccagtgccaagtcttagcttggaggatgaaacaacacccatctatgttcgcaatatcccccgccacaaaattcttgaggcctcggggaggtgatcaggtccctggaaaggctccgactcaggaacagggacacnacggggaacggatgggggt

SEQ ID NO: 26050 - DNA, 761 bp, Zea mays
  misc_feature: Ceres CLONE 1398290-F
  misc_feature: Translation starting site: 507
  misc_feature: Pfam Name: TCTP Pfam Description: Translationally controlled tumour protein
  misc_feature (457)..(457): n is a, c, t, g, unknown, or other
  misc_feature (572)..(572): n is a, c, t, g, unknown, or other
acaagctggagctccccgcggtggcggccgctctagaacaagtggatcccccgggctgcaggaattcgcacgagaaccatttaacctagaacattcctaaatcgaaaacttgctcgctgcgccgccgcctccgacatcgtccctttcgtccccacgagcaaccgataatccgccggcgttgagatgttggtttatcaggatctccttattctggcgacgagctcctgtcggattcattcacctacaaggagctcgagaacggcgtcctgtgggaggtcgagggaaagtgggtcacccaaggtcctgttgatgtggacattggtgccaatccatccgccgagggtggtgaggacgaaagcgttgatgacacagctgtgaaggtggttgatattgttgacacattccgtctacaggagcaacctccttttgacaagaaatcatttgtgtcttacatcanaaaatacatcaagaatctcactggctgtgttggagccagagaaaagcggatgagttcaaaaaggggtgtcgagggtgcaaccaagtttctccttagcaagctgaaggactccaanttttttgttggtgagtccatgaaggatgtgatgcgtctgtggtattcgcctattacaaggatggtgccactaatccgacattcctctatttctctcatggtcttaaggagatcaagtgctaggcgtgcggcgaaataagttaccatgttgggtactatctatgtactattatatatccaaaactatagt

SEQ ID NO: 26051 - DNA, 736 bp, Zea mays
  misc_feature: Ceres CLONE 1398295-F
  misc_feature: SWISSPROT Homolog: EC 4.3.1.5 Phenylalanine ammonia-lyase
  misc_feature (467)..(467): n is a, c, t, g, unknown, or other
  misc_feature (490)..(490): n is a, c, t, g, unknown, or other
  misc_feature (503)..(503): n is a, c, t, g, unknown, or other
  misc_feature (509)..(509): n is a, c, t, g, unknown, or other
  misc_feature (668)..(668): n is a, c, t, g, unknown, or other
caaagctggagctccccgcggtggcggccgctctagaactagtggatcccccgggctgcaggaattcgcacgagaccattacctagaacatcctaatcaaaaaacgctcccgtccgaggtttcgcgtgcggccatgctcggccgcatcaacaccctcctccagggctactccggcatccgcttcgagatcctcgaggccatcaccaagctcatcaacaccggcgtcagcccgtgcctgccgctgcggggcaccatcaccgcgtcgggcgacctcgtcccgctgtcctacatcgccggcctcatcacggggcgtcccaacgcgcagggccgtcacggttgacggcaggaaggtggacgccgccgaggcgttcaaggcgaccggcatcgagggcggcttcttcaagctcacacccaaggagggcctggacatcgtcacggcacgtcccggtggcgtcggcgctcgccgnccatggtgtgcttcgactgcganggtcgtcggcgtncctgtnccgatggtcctgtccgccgccttcctggggaggtggatgaacggcaatgcccgagtacggaccaccttacccacaagctcaagcaccacccggggtccatcgaggtctctgccatcatgtagcacatccatggatggcagctccttcatgagcacctcnagggaggtgacggcatggacccgctgctgaagtcgagcaggacagtacgcgctcgcaagtcggcggag

SEQ ID NO: 26052 - DNA, 719 bp, Zea mays
  misc_feature: Ceres CLONE 1398296-F
  misc_feature: Encodes the peptide sequence at SEQ ID NO. 26053
  misc_feature (148)..(148): n is a, c, t, g, unknown, or other
  misc_feature (445)..(445): n is a, c, t, g, unknown, or other
  misc_feature (667)..(667): n is a, c, t, g, unknown, or other
tggagctccccgcggtggcggccgctctagaactagtggatcccccgggctgcaggaattcgcacgagaccattacctagaacatcctaatcgaaaaatagcctcctcgtctcctcgagaactgtagcatcacgcgccgcctttgatntgagcagggactgggagagaggagaagagagggtgaaagggggcaagaaaacgcttcttgttgcctttgtgcttcagcggatccgcggtggctgcgcacgccggcggggaagaggagtcgcgggcggcgcgcctccagtctttcttcgcctccgtgctctccgggctcttcggccaggccgaggccgaggacgaggacgaggacgaagagatgcccacgcgcaaccacaacgctgccgcggctgccgctccgcagcatcaccatcacaaaccgaggtgtgctccctctcttggaagnagcaaggccgtgcccggccgagctgatcccatgaaccggcgagcccccctcggcgatattggcaacctcgtcagcgtccgcccagccgaagggaagcctcagctgcaggagcagatcaatcgccccatcacgcgaagcttcggcgctcagctcgtgaagaacgtgcaggcgaatgccgcaatcaagaatgccgcaatcctacccgcgaggacgcgccgaggnagggaaaggaggctcctgccaagcaccgccttcctgaggaggcatagtactc

SEQ ID NO: 26053 - protein, 81 aa, Zea mays
  misc_feature: Ceres CLONE 1398296-F
MNRRAPLGDIGNLVSVRPAEGKPQLQEQINRPITRSFGAQLVKNVQANAAIKNAAILPARTRRGRERRLLPSTAFLRRHST

SEQ ID NO: 26054 - DNA, 787 bp, Zea mays
  misc_feature: Ceres CLONE 1398297-F
  misc_feature: Encodes the peptide sequence at SEQ ID NO. 26055
  misc_feature (255)..(255): n is a, c, t, g, unknown, or other
  misc_feature (348)..(348): n is a, c, t, g, unknown, or other
  misc_feature (364)..(364): n is a, c, t, g, unknown, or other
  misc_feature (370)..(370): n is a, c, t, g, unknown, or other
  misc_feature (371)..(371): n is a, c, t, g, unknown, or other
  misc_feature (375)..(375): n is a, c, t, g, unknown, or other
caaagctggagctccccgcggtggcggccgctctagaactagtggatcccccgggctgcaggaattcgcacgagaccattacctagaacatcctaatcgaaaaagctagccaagctataccactagaaccagagcacaactcaaagcaatgccgccgcctcctcctcctccgccccactcccacgcttcccatcccgcgccgcatggacgcgagcagcactagcgcgggggcacacagcacggcgagcgggcggnggcgcgacgatggacctgggcgggtcggtggtgatggacgcgggcgcctcggagctgggcctgctcgggcgcggatctagcaggctgctcaangcacggcgggggcccnatggcnngcgnggggagacgacgacgtggtggggcggcgggcaggcccaagcagcccaggaaagggacaggcgcccgtcgcccccggggaacgtggcggctgccaaccaaggggggggggggggccccttcctggtgggtctcggggaatccggggacccggggggggagaaaaaggtaattttttttttcccgccgccccccgccccggggggccccgggggcccccccacgggtggggggtgagggggggggggcccttgcccgttttaaaaaggaaccccgctctttgtgtcaaagaaaaaggcccgggggggatttaacccccaaattcgggggggaaagtgccccggggggggcccccctccccccccccccccaggggaagacgatcaaaaacacccgccggttaaaaaaaaagtgg

SEQ ID NO: 26055 - protein, 114 aa, Zea mays
  misc_feature: Ceres CLONE 1398297-F
  misc_feature (28)..(28): Xaa is any aa, unknown, or other
  misc_feature (34)..(34): Xaa is any aa, unknown, or other
  misc_feature (36)..(36): Xaa is any aa, unknown, or other
MDLGGSVVMDAGASELGLLGRGSSRLLXARRGPXGXRGETTTWWGGGQAQAAQERDRRPSPPGNVAAANQGGGGGPFLVGLGESGDPGGEKKVIFFFPPPPAPGGPGGPPTGGG

SEQ ID NO: 26056 - DNA, 746 bp, Zea mays
  misc_feature: Ceres CLONE 1398301-F
  misc_feature (502)..(502): n is a, c, t, g, unknown, or other
  misc_feature (601)..(601): n is a, c, t, g, unknown, or other
  misc_feature (613)..(613): n is a, c, t, g, unknown, or other
  misc_feature (614)..(614): n is a, c, t, g, unknown, or other
  misc_feature (647)..(647): n is a, c, t, g, unknown, or other
  misc_feature (665)..(665): n is a, c, t, g, unknown, or other
  misc_feature (687)..(687): n is a, c, t, g, unknown, or other
  misc_feature (696)..(696): n is a, c, t, g, unknown, or other
caaagctggagctccccgcggtggcggccgctctagaactagtggatcccccgggctgcaggaattcgcacgagaccattacctagaacatcctaatcgaaaagaatcgttattatcagtgggctagaacatactaatgcgagtgctgtgctgctaaatctaatctgcgtgcgattggtcgatgggcaggttcggtggagatcgccgccgttggcgtttcgatcgccatatttaaccaagtctccaaggtctgcatctaccctctcgttagcgtcacaacgtcgttcgtcgcggaggaagacgcgatcatcagtaaggccgtccgaggaaacagcagccaggaggaggacgtggagaaagcctcccacgtgggctttgatccggagaccagcaatctgcatgcatctggccctgcaggtatggcagaatgcgtgaactcgtgtatccctacggagtgcgcagcagatccctctggcaggcaagggcggggcgagaaagaggntacgtgcccgtcggtcacgtcgggcttaaatagtcggttccattctcggcctggcttcaggccgtctttctgggtcctttcgggccagattcgtgtcancaattcatgggnntgggttaagtcccggatccccgatgcaaggggncctggcggtgcgctaccntaacgataaagggtcccttggntgcccccgncctgtgcttgctgtctctggccaatggcaaggggttttttttcccggggg

SEQ ID NO: 26057 - DNA, 753 bp, Zea mays
  misc_feature: Ceres CLONE 1398304-F
  misc_feature: Encodes the peptide sequence at SEQ ID NO. 26058
  misc_feature (343)..(343): n is a, c, t, g, unknown, or other
  misc_feature (380)..(380): n is a, c, t, g, unknown, or other
  misc_feature (381)..(381): n is a, c, t, g, unknown, or other
  misc_feature (563)..(563): n is a, c, t, g, unknown, or other
  misc_feature (568)..(568): n is a, c, t, g, unknown, or other
  misc_feature (736)..(736): n is a, c, t, g, unknown, or other
acaagctggagctccccgcggtggcggccgcttctagaactaagtggatcccccgggcttgcaggaattcgcacgagaaccattacctaaaacatcctaaaaaaaaaaacccccgtcctcctcgccgctccgccgcgcggttgagcgccgacgagcgagcccaccgctgcctcgtccgccctatggatatggatgtccgccgcagggttccaccgccgcacgggagcgtccctaggcgccagcaggcgaccggggccgagtgggagcgggtgcgtgtgcaggcgggtgatgcgctaccgctgccgatccggcacacgaacctctctttctcggcgctgttcgncgcgtcgctggtgaccgaatggcggtcgggtgggcgnnggaaagatccgcgcctccacgccgttccacgtggtctccccccgccgagatcttcgccatctgcggcctcgtcgcgtcgctcatctacctcctcagctttcttcggaatcggctttcgtgcagcccgtcgtctcccagcaaggacgaccaagagggacttcatcgtcgactcccgccacgcnggggnggcgggccccccccaaatcctgggaaaacccccgttgggccttccttggaaaccccgccccccccaacgaaaaaaatgcccaaagaagaaagggaatccgggcccgctttggggaaagaaaaatcccctcccacggggtgggacctagggggggaaaaacccccccgnccccccgaaaaaagaga

SEQ ID NO: 26058 - protein, 177 aa, Zea mays
  misc_feature: Ceres CLONE 1398304-F
  misc_feature: SWISSPROT Homolog: EC 1.1.1.34 Hydroxymethylglutaryl-CoA reductase (NADPH)
  misc_feature (54)..(54): Xaa is any aa, unknown, or other
  misc_feature (67)..(67): Xaa is any aa, unknown, or other
  misc_feature (129)..(129): Xaa is any aa, unknown, or other
MDMDVRRRVPPPHGSVPRRQQATGAEWERVRVQAGDALPLPIRHTNLSFSALFXASLVTEWRSGGRXKDPRLHAVPRGLPPPRSSPSAASSRRSSTSSAFFGIGFRAARRLPARTTKRDFIVDSRHAGXAGPPQILGKPPLGLPWKPRPPQRKKCPKKKGNPGPLWGKKNPLPRGGT

SEQ ID NO: 26059 - DNA, 734 bp, Zea mays
  misc_feature: Ceres CLONE 1398307-F
  misc_feature: Translation starting site: 182
  misc_feature: Pfam Name: CBS Pfam Description: CBS domain pair
  misc_feature (539)..(539): n is a, c, t, g, unknown, or other
  misc_feature (678)..(678): n is a, c, t, g, unknown, or other
  misc_feature (679)..(679): n is a, c, t, g, unknown, or other
caaagctggagctccccgcggtggcggccgctctagaactagtggatcccccgggctgcaggaattcgcacgagaccattacctagaacatcctaatcgaaaaacagaaccctgcaactgcaagctaaggagagtgtgatcaccaacagctagtgctagtcccccttccttccatccatccatggcatgcgtcagcaccttccagagctgccccattgccagaagagcaaagatcaacacgaggtccaggggctgcagcagtagcgtggcgaaggggtcatcaccaccagccttccagttccagtgcagggcgtcgactttcgcggcggacaccagcctccggctcgagctggacgagaaccccgaggcgatcatccttcgggggcgtggcccgggaactgctccctcctcagctacgacgacctccgcgcctacctcgagtcgcaggagacggcggcccaggcagacggtcacaagcgcggcgtggcgctcctgagcgagaccatgtcccaccccgtgctggtggccacagcagacanacccctgaggggacgtcgaggccactttcgagggcccgtgtcgggggctttccggtcgtcgacagcggctcaaaatggggctcggggggtgatcgtcaaagaacgacccggcaagagcctctcatgggtccaagacaannaaatttcgaaagtgatgacctctcccgctatcacactatcgtctgacaaaaccct

SEQ ID NO: 26060 - DNA, 633 bp, Zea mays
  misc_feature: Ceres CLONE 1398309-F
  misc_feature: Translation starting site: 146
  misc_feature: SWISSPROT Homolog: EC 3.2.1.23 Beta-galactosidase
  misc_feature (429)..(429): n is a, c, t, g, unknown, or other
  misc_feature (439)..(439): n is a, c, t, g, unknown, or other
  misc_feature (440)..(440): n is a, c, t, g, unknown, or other
  misc_feature (444)..(444): n is a, c, t, g, unknown, or other
  misc_feature (449)..(449): n is a, c, t, g, unknown, or other
  misc_feature (450)..(450): n is a, c, t, g, unknown, or other
  misc_feature (462)..(462): n is a, c, t, g, unknown, or other
aaaagctggagctccccgcggtggcggccgctctagaactaagtggatcccccgggctgcaggaattcgcacgagaccattacctagaacatcctaatcgaaaaagttcgccaccatcgtgctccgtacacgctccgctccggccatggccgccgccgcggcctccctttcggccctgccgttccttctacttttgctgctggtgccgtcgctcgacggcgcctccaatgtgacgtacgaccaccgctccctcatcatctccggccgccgccgcctcgtcatctccacctccatccactacccccgcagcgtccccgagatgtggcccaagctggtggctgaagccaaggacggcggcgccgactgcatcgagacctacgtctttctgcacggccatgagatcgcccccaggcagtactacttcgaggnaccggttgannctgntgcgnntcgtgaaggtcngtagagacgctgggctgctcttgatcctgcgcatcgggccctatgtcggcggcgagtggatttatgaaggctgcccggttgtggttcactactggccagaaacggttttccggacaaacaccaggccttcaggaccctattgaagagtttcccgctacttcggggaattga

SEQ ID NO: 26061 - DNA, 759 bp, Zea mays
  misc_feature: Ceres CLONE 1398311-F
  misc_feature: Encodes the peptide sequence at SEQ ID NO. 26062
  misc_feature (604)..(604): n is a, c, t, g, unknown, or other
acaaagtggagctccccgcggtggcggccgctctagaactagtggatcccccgggctgcaggaattcgcacgagaccattacctagaacatcctaataaaaaaggaattctgccttcttatctcatcttcctgctcatctcagtatgagctttagctgaagcaacgcctccggccaccgccacgatatggacaccacgttgcacaagcccctgggggcgatcaccgttgacgacctcaccgcggcgacatctgggtcggacgcaaccgcgctccacacagtgctcgggagcgcgctcgactgcgtacggacccaccgaatcgcgaccgcgatgttctgccgatccatgctctgaccgactgtacccttcgccgtccaccggatgctctactacggatgattcgacgtcttgccgatctcccacggcggcgactgaacgtcgcagatctccaaggaggctgacttgaccaatgtccctctgtgtattataggcgcgtggtaagtacttcatcttttacgcgtaagaggatctgatcatcaggttatcagacctcctgatgatctcatcaatgacccatagctaaaatggaagatgctatgagagnatatgagtatcctagttaaaggagagacatcctgtatatgcatagatagactgcatatcggggtagtgaaatgtttactaggtgctaagttctaggtgctggaaatactgtgatgcttaaccagttatggagctcggcgacggagcaatgataga

SEQ ID NO: 26062 - protein, 55 aa, Zea mays
  misc_feature: Ceres CLONE 1398311-F
MDTTLHKPLGAITVDDLTAATSGSDATALHTVLGSALDCVRTHRIATAMFCRSML

SEQ ID NO: 26063 - DNA, 727 bp, Zea mays
  misc_feature: Ceres CLONE 1398313-F
  misc_feature: Encodes the peptide sequence at SEQ ID NO. 26064
  misc_feature (136)..(136): n is a, c, t, g, unknown, or other
  misc_feature (351)..(351): n is a, c, t, g, unknown, or other
  misc_feature (352)..(352): n is a, c, t, g, unknown, or other
  misc_feature (398)..(398): n is a, c, t, g, unknown, or other
  misc_feature (414)..(414): n is a, c, t, g, unknown, or other
  misc_feature (416)..(416): n is a, c, t, g, unknown, or other
  misc_feature (417)..(417): n is a, c, t, g, unknown, or other
  misc_feature (426)..(426): n is a, c, t, g, unknown, or other
catagctggagctcaccgcggtggcggccgctctagaactagtggatcccccgggctgcaggaattcgcacgagaccattacctagaacatcctaatcgaaaaacatccgtcttcctcctgtaaccagatctgggnaaatcccgcggcgacagaaacaaacgctcgctcgctcgttcgttgtccgttcattgtcttcgccggcgccgagggaccctgagagggcaggcgggcgagatggcgggcggcggcgttgaggacgtgtacggcgaggaccgcgctaccgaggagcagctgatcacgccgtgggccttctccgtcgcagctgctacaccctgctgcgcgacccgcgnnacaacagggcctgggcctctcggaaggcgagggggacggaactacntccggggctggtgccncnngggctttgntcccaagaattccggaaaaaattccttgcaaaaacggggccgggaaaaaaaacctttgcccgttatttgcccatgggggaccgggggaaggcaaaagagggctttttaaaggcctcctcaaaaagggggaggagggttccccggtttaacccccccccggggggggggtggggaaaaaaggggtataaaccccccccgggggggggttatatcccccggggagagaaaacaccccgggggagaaaaagcggcggagaggaattttttttttctcccccagggaggggttccttcctttttt

SEQ ID NO: 26064 - protein, 99 aa, Zea mays
  misc_feature: Ceres CLONE 1398313-F
  misc_feature: SWISSPROT Homolog: EC 1.1.1.40 Malate dehydrogenase (oxaloacetate-decarboxylating) (NADP(+))
  misc_feature (39)..(39): Xaa is any aa, unknown, or other
  misc_feature (55)..(55): Xaa is any aa, unknown, or other
  misc_feature (60)..(60): Xaa is any aa, unknown, or other
  misc_feature (61)..(61): Xaa is any aa, unknown, or other
  misc_feature (64)..(64): Xaa is any aa, unknown, or other
MAGGGVEDVYGEDRATEEQLITPWAFSVAAATPCCATRXTTGPGPLGRRGGRNYXRGWCXXGFXPKNSGKNSLQKRGREKKPLPVICPWGTGGRQKRAF

SEQ ID NO: 26065 - DNA, 778 bp, Zea mays
  misc_feature: Ceres CLONE 1398316-F
  misc_feature (256)..(256): n is a, c, t, g, unknown, or other
  misc_feature (259)..(259): n is a, c, t, g, unknown, or other
  misc_feature (268)..(268): n is a, c, t, g, unknown, or other
  misc_feature (284)..(284): n is a, c, t, g, unknown, or other
  misc_feature (625)..(625): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (681)..(681): n is a, c, t, g, unknown, or other
  misc_feature (695)..(695): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (738)..(738): n is a, c, t, g, unknown, or other
  misc_feature (739)..(739): n is a, c, t, g, unknown, or other
  misc_feature (741)..(741): n is a, c, t, g, unknown, or other
  misc_feature (743)..(743): n is a, c, t, g, unknown, or other
  misc_feature (748)..(748): n is a, c, t, g, unknown, or other
  misc_feature (749)..(749): n is a, c, t, g, unknown, or other
  misc_feature (752)..(752): n is a, c, t, g, unknown, or other
  misc_feature (753)..(753): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (762)..(762): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
caaagctggagctccccgcggtggcggccgctctagaactagtggatcccccgggctgcaggaattcgcacgagaccattacctagaacatcctaatcgaaaaaatgtcaaatctctcgcgagcgaggcagacccacgggccgcggccatctcacggtggaagcagccaagcagccggcctggcgcccctccccttccgtcccgccgctgctgccgtgcctcgtggctgccagcggcggatgccgccccgccccgntgntgaccacgncgctgctgagcatggnccgcgctcccgcgggcgctcagaaacgctgcgtcttccgtggcaacataccataagatgcgacggaggagcacttcgtgcaaatttgcaaagaagtgggcccggccgaatcccttgaaatgggggttgacaaagaacccggcaacccaaaaaggtttggtctttgggaggccaaaggagaagaaaagtgttttaaggcccccccgaaacctctggggataaaaaaaataggggggcccccatacaccgtttttttttcgtaaagggggggaacccctgtgaaaaaataaaaaaagccccccccccccccccggggtgtttttttttgtgttaaaaaaaaanggttgtttttcttttgttaggaaaaaaaaatcttccacnnntgggggccccccccnaaaaaatggttttntaannnnnggnnnnttccccaccccccccccctcnnnnnnnannantnccctnnagnntacnnnncnccccccccccnnnngt

SEQ ID NO: 26066 - DNA, 690 bp, Zea mays
  misc_feature: Ceres CLONE 1398317-F
  misc_feature: Translation starting site: 182
  misc_feature (427)..(427): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
aaaagctggagctccccgcggtggcggccgctctagaactagtggatcccccgggctgcaggaattcgcacgagaccattacctagaacatcctaatcgaaaaagggtttttcctgatctcgcctcccgagccacacacgttgccgccgtgagccgccgcccacaaggctaagcaccaaccatggccttcggagctctcgtcacgtcgaggctggccaggtccggccgcacccttgcatctgccgttgcccagggtcccgttgcccagcggatagcacctcctctgctctccaggcttggagcagtagctcgtcttctcagcacaaagccagccgcaacagatgtcatcggtatcgatctaagcactacgaattcctgcgtctccgtcatggaaggaagacaccacgggtgattgaaaatgcaaaangcgcgaggacgacaccctccatttnnntgcagaatcaaaatgttgaccttggtgattggaatcacagcgaggcgggcagcaagtaccaatgccacaaacccaatccggggtcaagcggctttacgggagggctttttgggacccccaacccaaaaggggatgaaaaggggccttaaaaatggcagggccccaagggggatccgggttcaaaatggggggcaaaaaacccccaaaagaatgggggatttgttccccaaaaggaa

SEQ ID NO: 26067 - DNA, 774 bp, Zea mays
  misc_feature: Ceres CLONE 1398320-F
  misc_feature: Encodes the peptide sequence at SEQ ID NO. 26068
  misc_feature (271)..(271): n is a, c, t, g, unknown, or other
  misc_feature (286)..(286): n is a, c, t, g, unknown, or other
  misc_feature (289)..(289): n is a, c, t, g, unknown, or other
  misc_feature (290)..(290): n is a, c, t, g, unknown, or other
caaagctgggagcttcaccgcggtggcggccgctttaaaactaagtggaacccccgggctgcaggaaatcgcaacgagaccatttacctagaaacaatccctaaatcaaaaaagaaaaacgcatttccgcaagaacgcgcggcgagggagtaaggaggggaacggcgggtgccgaaggcccgcaggcacggggaagcttaaccttgcttgcgtagccgggcgggctcgcgctgtgcttgtcgctccatgtcggtcgccggcgagagcgggnggaattatccggcgncgnnacgccgccgatgatatctctccaacaagggccccgacagcactccaatgttgaaagaggctgtggaaatgtctacagatgaagaatcggatgtcgttgttatatgccatccgaatggtaacactgatggatgtgacgaagccattagtggcagtcatgatgatgatagcccagaaggccagtaaactagttccatcaaggacccttgatgtagaaggtgacacacaggaagacaagtgtgtaaatcaagattcactgaagttgattgatcaagagacgtctgctccccccaagtccccagcgaagtccgcgactgcgagttctgcaccagaagaacctaaacgtgttgtcacccaaccattgtctctttctactcaacgaaggtcatctggagtaaaatggtggtgtgaccaatccatcacccaataaggataaaatctgttgataaagtagcatctctccagcagcatgacaaaaaagtgtac

SEQ ID NO: 26068 - protein, 29 aa, Zea mays
  misc_feature: Ceres CLONE 1398320-F
KAGSFTAVAAALKLSGTPGLQEIATRPFT

SEQ ID NO: 26069 - DNA, 754 bp, Zea mays
  misc_feature: Ceres CLONE 1398322-F
  misc_feature: Encodes the peptide sequence at SEQ ID NO. 26070
  misc_feature (406)..(406): n is a, c, t, g, unknown, or other
caaagctggagctccccgcggtggcggccgctctagaactagtggatcccccgggctgcaggaattcgcacgagaccattacctagaacatcctaatcgaaaagacatagagaggcacaggccacagggcagacaggcaggaggatgcggacgagtcggccagggagctgtgtgcttttcagatagaggtattaagatggtggtgcttccgttgcttgccctgatctccctgctcttcgcagtggccagtcctggcaggcacatcgcccacgatgcctgctcgtcggaagtggaggatttccagcacctgaacaacagctcgagggtccacctgacgctgcaccacccgcatagcccctgctccccggcgccgctgcccggcgacctccccttctccggggcggcnggcacagcgacggcgcgcgcatcgacgtccatcgccgcgaggcgcacctggaggccgtcctctcggaccatcttgattgacgagagccgcgcgtcgctcatggtcttcatcatgccatgactagtccgtcgcgtggcgggacgctcgcgccatgcagaacggtcagctggagcaagtacgggacgccgatggctgtcgggacgactacctggtcgaaggcactgggcacgcggacagcatctacgtctcagctgggtgcgtgaccacgatgcctcgtgtctgtgaaccgccggtacgagatggacgcccccacgcacgggggaccagctgctacgcgtcaccgtggtg

SEQ ID NO: 26070 - protein, 109 aa, Zea mays
  misc_feature: Ceres CLONE 1398322-F
MVVLPLLALISLLFAVASPGRHIAHDACSSEVEDFQHLNNSSRVHLTLHHPHSPCSPAPLPGDLPFSGAAGTATARASTSIAARRTWRPSSRTILIDESRASLMVFIMP

SEQ ID NO: 26071 - DNA, 739 bp, Zea mays
  misc_feature: Ceres CLONE 1398325-F
  misc_feature: Encodes the peptide sequence at SEQ ID NO. 26072
  misc_feature (299)..(299): n is a, c, t, g, unknown, or other
aaagctggagctccccgcggtggcggccgctctagaactagtggatcccccgggctgcaggaattcgcacgagaccattacctagaacatcctaatcaaaaaaccaaccaaccagtgctgtcctccgccgatccactgacctaccgcgagcgccaatggtgaccgccgcggtcctcgccgccacattagcgctgttcctcggcgccgccgccgcaacggacgcgacggctgcggcggaggcggaccggatcggcaggctgccggcccagccgccggtcaacttctccatgtactccggntacgtcaccgtggacgcgagggcgggacggaccctcttctactgaatcatcgaggcgtcctgtgtgcccgcggcatccgcggcggtggtggtgtgactctacgaagggcccgggtgctcctccgtcgtttaccgtgcgtgatatgaggtcggcgcccttccggaacaacgccgaggccagggccttcttattgaacccctacccctgggaataaggggggaaatttggcggttcttgaactccccggccggttttccaattatcattatccaaatcccccttccgatttggaaactgggcggtggaaacaggacctgcccccggaatgcgcctgttttcttgggggaatgggcggagaacggattccaacaaaagagcttctgggttttctcgctccgggggagggagcacccccgcccctcacgggcccaggaggttcc

SEQ ID NO: 26072 - protein, 62 aa, Zea mays
  misc_feature: Ceres CLONE 1398325-F
  misc_feature: SWISSPROT Homolog: EC 3.4.16.6 Carboxypeptidase D
MVTAAVLAATLALFLGAAAATDATAAAEADRIGRLPAQPPVNFSMYSGYVTVDARAGRTLFY

SEQ ID NO: 26073 - DNA, 674 bp, Zea mays
  misc_feature: Ceres CLONE 1398326-F
  misc_feature: Encodes the peptide sequence at SEQ ID NO. 26074
  misc_feature (553)..(553): n is a, c, t, g, unknown, or other
  misc_feature (594)..(594): n is a, c, t, g, unknown, or other
  misc_feature (613)..(613): n is a, c, t, g, unknown, or other
aaagctggagctccccgcggtggcggccgctctagaactagtggatcccccgggctgcaggaattcgcacgagaccattacctagaacatcctaatcgaaaagtggttgcaaaaatctctactccgacccccacctaagggaccgactcgccggggacagagagagaccgacgcgccggcagatcccaagctcaccggagagggggaagagggcgaccgaaggcggcgatgggtttcatcatggacttcgcggagaatatgatcctccgtctgatggaggacccggacaagcgcgaccaggttcggcgggagcatgtctacaagatgaaggagcggtgcgagcgcactaagggcgcgtggagcctccctctgcgcccctacggcttctggaccttcgaccgcttcaactcgcagctctcctgggatccccagatcagccaggccggcggccgtcgggacccctacgatgacctcatcgcccggcactctgggtcggccgcgtcttcctgaacacccgttccgatctttgcccagaaggtctacttgggcatcnataaggaactctttcccctcaagctgatggggggtcatccntctctggctgggaaatgtngtcaccaactaccctatttcctgttcagtttggatggaagataagtggggacttctatctc

SEQ ID NO: 26074 - protein, 93 aa, Zea mays
  misc_feature: Ceres CLONE 1398326-F
MGFIMDFAENMILRLMEDPDKRDQVRREHVYKMKERCERTKGAWSLPLRPYGFWTFDRFNSQLSWDPQISQAGGRRDPYDDLIARHSGSAASS

SEQ ID NO: 26075 - DNA, 664 bp, Zea mays
  misc_feature: Ceres CLONE 1398328-F
  misc_feature: Encodes the peptide sequence at SEQ ID NO. 26076
  misc_feature (343)..(343): n is a, c, t, g, unknown, or other
  misc_feature (357)..(357): n is a, c, t, g, unknown, or other
  misc_feature (360)..(360): n is a, c, t, g, unknown, or other
  misc_feature (369)..(369): n is a, c, t, g, unknown, or other
  misc_feature (664)..(664): n is a, c, t, g, unknown, or other
aaagctggagctccccgcggtggcggccgctctagaactagtggatcccccgggctgcaggaattcgcacgagaccattacctagaacatcctaatcgaaaaactagttgccaaccccacgcacgttctgcgacgagctaccccatttccccacccccagcaccccactccccgcttccatttccttggaccccaccaccgcgcctacatccctcagagctcagatgcagccgccggcgaccgagatgcacccggccgccgacgccgccacctccgccgccaccgcgcaggccgacactactgctcgcgccgccgtccccgcatccgatccaccccgcccccnggcggggcgccggnggntgagacggncgatccgccgcccccgccgccagcgccggcgcccaagacggtcacctggagcgagaagctcacgtccgactcgccgacgcacgtgcacgccgccgccgcggcggagtccagccagtacgtgtcccgtgggcccgcatcctcgtctaagggcgccgtggaggcgatgagggagacgctgtcaaggtgggggaagtcgtggggggagaccaccaagctggtcgagagcctcagccgcgacacgtggcaacacttcaagactggacctagttttactgaagctgctatggcacgcctn

SEQ ID NO: 26076 - protein, 44 aa, Zea mays
  misc_feature: Ceres CLONE 1398328-F
MRETLSRWGKSWGETTKLVESLSRDTWQHFKTGPSFTEAAMARL

SEQ ID NO: 26077 - DNA, 672 bp, Zea mays
  misc_feature: Ceres CLONE 1398329-F
  misc_feature: Encodes the peptide sequence at SEQ ID NO. 26078
  misc_feature (487)..(487): n is a, c, t, g, unknown, or other
  misc_feature (488)..(488): n is a, c, t, g, unknown, or other
tggagctccccgcggtggcggccgctctagaactagtggatcccccgggctgcaggaattcgcacgagaccattacctagaacatcctaatcgaaaaacatcgacccagtcatctcctcaccctcgttcaccacacagtccgccactcctttagtagcttgtgatttgtacgtcgacgagatcactggtcgggtggtggacgactacacatggggaagggtagtgtgggtgcatcatggtgggcgttcctcctgctcgccggcgtgctgctggtcgtagcagccacggccggagcggaggacggagtggtcgaacgggaccgcaaggaggacctgcgatggtgcaagcaggcgtgcgagtggcagtacggaaaggacaccccgcggaagagggaatgcagagagcgagtgccgcgagcggcaccagcaagctgacgcgggcgaggtacgtggacagcggcgtggacgcctacgtctcccgctccggnnaggggcgagtgacggcgccagtgcctgcgccgccacgagggccagccgtgagacacccaggagtgcatggatgcgttgccgccgccgcgaactggccgtcgaatggaagcaagagtacggtcgcggcaccgagagcgacggcaatgtctcggtatgagtgctgagcgccccaccgcgtgggact

SEQ ID NO: 26078 - protein, 74 aa, Zea mays; identical to SEQ ID NO: 18729
  misc_feature: Ceres CLONE 1398329-F

SEQ ID NO: 26079 - DNA, 686 bp, Zea mays
  misc_feature: Ceres CLONE 1398333-F
  misc_feature: Encodes the peptide sequence at SEQ ID NO. 26080
  misc_feature (413)..(413): n is a, c, t, g, unknown, or other
aagctggagctccccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttcccttctttccccataccttccatcaatgatagcttcagtatgtgaaaacccagctcttcaaccctataggctccaacaagcaatcgcagcaagcaacatacctttatcacccttgtttcaacaatcgccagccctatctttgntgcagtcattggtacaaaccatcagggcacagcagctgcagcaactcgtgctacctgtgatcaaccaagtagctctggcaaacctttctccctactctcagcaacaacaatttctttcatccaaccaactgtctacattgaaccgtgctgcttatttggagaaacaactattaccattcagccagttagctactggctactctcaaaaaacaacaacttcttccatttaaccaattggccgcactgaaaccccgctggttatttgcaaaaaca

SEQ ID NO: 26080 - protein, 157 aa, Zea mays
  misc_feature: Ceres CLONE 1398333-F
  misc_feature (82)..(82): Xaa is any aa, unknown, or other
MATKIFSLLMLLALSACVANATIFPQCSQAPIASLLSPYLPSMIASVCENPALQPYRLQQAIAASNIPLSPLFQQSPALSLXQSLVQTIRAQQLQQLVLPVINQVALANLSPYSQQQQFLSSNQLSTLNRAAYLEKQLLPFSQLATGYSQKTTTSSI

SEQ ID NO: 26081 - DNA, 683 bp, Zea mays
  misc_feature: Ceres CLONE 1398342-F
  misc_feature (515)..(515): n is a, c, t, g, unknown, or other
  misc_feature (625)..(625): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (646)..(646): n is a, c, t, g, unknown, or other
  misc_feature (647)..(647): n is a, c, t, g, unknown, or other
  misc_feature (676)..(676): n is a, c, t, g, unknown, or other
  misc_feature (677)..(677): n is a, c, t, g, unknown, or other
aaagctggagctccccgcggtggcggccgctctagaactagtggatcccccgggctgcaggaattcgcacgagaccattacctagaacatcctaatcgaaaaattggggcaggatcccgcgatggctcccagctcggtggcgtggaacccgtccgtggcgcccgcgaggccgaggtcgagctcggtgagcgccgcggctgctgccgggtgcgctgcgagcgccggcccgatgtcctccgtccagcagtagaactcggagaggtcgagcgccctgagcgctgggcagtccccgaggagcggctcgagatccgcgccggcgtcgaggcccggcgggcgctggtgccagcgcacgagcttgacgctgcggaggcgggacctccagtgcggggtgaggctgacgagcgtggtggggtcgcggcagtagacggcgagcgaggacacggcggggaagcagtaggcgaggcgcgccgcgaccagctcgttctgctccgcgacctgctgcggcgtcacggacnggcgcgacggcgtcggcgcggcgcccgccgggaggaaaaggaacgggtggccccacggggacgccagcgagaggtcgagccgctccagcgccgggaagcagaacgcgggnctgaggannnaggaacgcggnncgaccgtgggtccccgcgcaacgacaggnngggccc

SEQ ID NO: 26082 - DNA, 834 bp, Zea mays
  misc_feature: Ceres CLONE 1398343-F
  misc_feature (1)..(1): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (30)..(30): n is a, c, t, g, unknown, or other
  misc_feature (34)..(34): n is a, c, t, g, unknown, or other
  misc_feature (35)..(35): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
nccgtcccccnnnnnnnnnnnnccgggggnggcnnaaaaatcnnnnnnntaaaagctggggctccaccgcggtggcggccgctctagaactagtggatcccccgggctgcgggaattcgcacgagaccattacctagaacatcctaatcgaaaactctcatccgaattcccaggcaggcaggtcggcgaggagggcaggaagaccgaagaccgagccgtgcgggggctcgggacgggaacgggacaggaccccaaaatctcagatccttcctgcccgcccgcccgtgcccgtcgacgcgtcgttcttgccgggcggggcccacctccgccctctcctcctccaggggggatcggatacgccacaggcctgcggcgatggtgcctgtgggtcttcgggctaccggctccctcatctgggaacccccggcttccacctttcgacggacaaaaatccctcggggcttcattcagggggctaccaaggcggaacctttttaatcctccgctttggcattggacccaccagagggcacccccggggaaccattcccgggcgaagggaccctgggcaccggtttggaaaacccgaacggacgggaggggccttatgggcctgggggggaatttggcataattgggggggccaaggggggggggcccccagaaacaaaagagggcttaaaaaggcgaatcacgggtaccttgggggagagaaaaaaaaggagggggggaggcacccacccaggaaaaaaaaatccccttgtgatctcccaccaagggggaagggaggatccccctttgaaacccaggcggggggggggggggggccttaag

SEQ ID NO: 26083 - DNA, 663 bp, Zea mays
  misc_feature: Ceres CLONE 1398347-F
  misc_feature: Encodes the peptide sequence at SEQ ID NO. 26084
  misc_feature (482)..(482): n is a, c, t, g, unknown, or other
  misc_feature (549)..(549): n is a, c, t, g, unknown, or other
  misc_feature (550)..(550): n is a, c, t, g, unknown, or other
  misc_feature (569)..(569): n is a, c, t, g, unknown, or other
  misc_feature (663)..(663): n is a, c, t, g, unknown, or other
aaagctggagctccccgcggtggcggccgctctagaactagtggatcccccgggctgcaggaattcgcacgagaccattacctagaacatcctaatcgaaaaattgccatccatcacatcctctcccaccttactcaagctagtgcgagcatagcaatggggttcgcccggaagagtggagttgcagcagtaggggtttggtggctcctcctgctcgccggcgtgctgttgcctttggcggcggcatttggccggcacgccgatgccggcaacgacatgtgcgacatcaagtgccagcatcacagcgacccggccaggaggcagcagtgcgtggatgagtgccatagccgggagcaccatcaccctagcagagagttttgcgagatgaagtgccagcaccaccaggaccctgcaaggaaagagatctgcgtacagcagtgcatgagctatggtctcagccaccgtgcgagtgccagtgttgnttgatgagggtgaaaagcgcttccatggctgggaaaacgacggtggccggaggaatcctcgaggcgnntgtgagcaacgtacgacgntataataacagtacgtcataattaataaaataagctacacccgcgtttcccttatatatatatggtcttgctatggcatagagatatcatggcn

SEQ ID NO: 26084 - protein, 108 aa, Zea mays
  misc_feature: Ceres CLONE 1398347-F
MGFARKSGVAAVGVWWLLLLAGVLLPLAAAFGRHADAGNDMCDIKCQHHSDPARRQQCVDECHSREHHHPSREFCEMKCQHHQDPARKEICVQQCMSYGLSHRASASV

SEQ ID NO: 26085 - DNA, 690 bp, Zea mays
  misc_feature: Ceres CLONE 1398354-F
  misc_feature: Encodes the peptide sequence at SEQ ID NO. 26086
  misc_feature (268)..(268): n is a, c, t, g, unknown, or other
  misc_feature (376)..(376): n is a, c, t, g, unknown, or other
  misc_feature (612)..(612): n is a, c, t, g, unknown, or other
aaagctggagctccccgcggtggcggccgctctagaactagtggatcccccgggctgcaggaattcgcacgagaccattacctagaacatcctaatcgaaaaatccgcagtccatacagtgacccccacgaggtcaagaacctgtacgaggagaggaaagaacctggaagagaggagcttgaggagatggcgagcgccgagggcgagaggtgggtggaactggcgacggacttctcgcaggggagccgagaggcgctgcagtgggcgncgaccaacctgctccgcgccggcgaccacctgctgctgctgcacgtcatcaaggagcccgactacgagcagagcgaggccatcctctgggaaatcaccggctccccgntgattcccctctcggagttctctgaccctattatcgcgaagaaatatggagcaaaacccgacatggaaaccttggacctcctgaacactacagctacccagaaggaaattatggtggttgtgaaagtcctgtggggagatccgcgtgagaagctctgtcaagttatccatgacaccccgttgagctgctttggtataagaagcaggggccttgggcaactccagagggtgctcttnaggaagggcaggggattacgtcgtgaaaacggaccctgccctgtccccggtggtcagtcatcaagcaccgaagggttt

SEQ ID NO: 26086 - protein, 168 aa, Zea mays
  misc_feature: Ceres CLONE 1398354-F
  misc_feature (28)..(28): Xaa is any aa, unknown, or other
  misc_feature (64)..(64): Xaa is any aa, unknown, or other
  misc_feature (142)..(142): Xaa is any aa, unknown, or other
MASAEGERWVELATDFSQGSREALQWAXTNLLRAGDHLLLLHVIKEPDYEQSEAILWEITGSPXIPLSEFSDPIIAKKYGAKPDMETLDLLNTTATQKEIMVVVKVLWGDPREKLCQVIHDTPLSCFGIRSRGLGQLQRVLXRKGRGLRRENGPCPVPGGQSSSTEGF

SEQ ID NO: 26087 - DNA, 675 bp, Zea mays
  misc_feature: Ceres CLONE 1398355-F
  misc_feature: Encodes the peptide sequence at SEQ ID NO. 26088
  misc_feature (233)..(233): n is a, c, t, g, unknown, or other
  misc_feature (265)..(265): n is a, c, t, g, unknown, or other
  misc_feature (473)..(473): n is a, c, t, g, unknown, or other
  misc_feature (567)..(567): n is a, c, t, g, unknown, or other
  misc_feature (639)..(639): n is a, c, t, g, unknown, or other
  misc_feature (659)..(659): n is a, c, t, g, unknown, or other
aagctggagctccccgcggtggcggccgctctagaactagtggatcccccgggctgcaggaattcgcacgagaccattacctagaacatcctaatcgaaaactccccaactcgccgtctgccttctgcgcctccatttcggcctctgtcccttgcaagttcaatctcacctccaaccatgggtaaagagaagtcccacatcaacattgtggttattggccatgtcgactctgncaagtcgaccaccacaggacaccttatctacnagcttggaggcattgacaagcgtgtgatcgagaggtttgagaaaggagctgctgaaatgaataagcggtccttcaagtacgcgtgggtgctcgacaagctcaaggctgagcgtgagagaggtatcaccattgatattgctctgtgggagtttgagaccaccagtactactgcacggtcattgatgcccctggaaccgtgacttcatcnagacatgatcactggtacctcccaggctgactgtgctgtccttatcattgactccaccactgggtggtttggaggcttgtatctcccaggatgnccagacccgtgaacatgctctccttgcgttcacccttggagtgaacaaatgatttgctgctgcaacagatgnatgcacccactccaatactnccaggcccgtatgaaa

SEQ ID NO: 26088 - protein, 95 aa, Zea mays
  misc_feature: Ceres CLONE 1398355-F
  misc_feature (5)..(95): Pfam Name: GTP_EFTU Pfam Description: Elongation factor Tu GTP binding domain
  misc_feature: SWISSPROT Homolog: EC 2.7.7.4 Sulfate adenylyltransferase
  misc_feature (19)..(19): Xaa is any aa, unknown, or other
  misc_feature (30)..(30): Xaa is any aa, unknown, or other
MGKEKSHINIVVIGHVDSXKSTTTGHLIYXLGGIDKRVIERFEKGAAEMNKRSFKYAWVLDKLKAERERGITIDIALWEFETTSTTARSLMPLEP

SEQ ID NO: 26089 - DNA, 680 bp, Zea mays
  misc_feature: Ceres CLONE 1398358-F
  misc_feature: Translation starting site: 208
  misc_feature (606)..(606): n is a, c, t, g, unknown, or other
  misc_feature (680)..(680): n is a, c, t, g, unknown, or other
aaagctggagctccccgcggtggcggccgctctagaactagtggatcccccgggctgcaggaattcgcacgagaccattacctagaacatcctaatcgaaaaacttcattccggtttccggatagcttacctcccatcgacggtcggtgagccgttggtgagtggcgagacagcgggtgcgctgggcaagaacaggcgacgaagaagatgagcacgctggacacgcggacgctcaaggacgagctgacgagcatggacaggaagtgcctcgtggacctcggccacccgctgctcaaccgcgtcgccgacagcttcatccgcgccgctggggtcggggcggccagggccgtctccagggaggcctacgtcgtcaccgtcgaagggctttcaggagactcgtccgggctagacgccgacggcggcaagcggagccatttctccagcatcagaggtgacgacggccagaggtcgctcgacgcagtggtaaaaacggccggcaaggaggcccttccagtgggggttggcagccggagtctactcagggctcacgtacgcgctgcgggaggccaggggatgccacgactggaagacgggggccatcgaggngcatcgcttggggggcggcggtgcggctcaggggtggacgccggcggccactccgacaagctcgtcaacttcgn

SEQ ID NO: 26090 - DNA, 663 bp, Zea mays
  misc_feature: Ceres CLONE 1398361-F
  misc_feature: Encodes the peptide sequence at SEQ ID NO. 26091
  misc_feature (324)..(324): n is a, c, t, g, unknown, or other
  misc_feature (478)..(478): n is a, c, t, g, unknown, or other
aagctggagctccccgcggtggcggccgctctagaactagtggatcccccgggctgcaggaattcgcacgagaccattacctagaacatcctaatcgaaaaacgcctcctcctccgcctcccgctcctgccgcgcgtcgccgcgttttgtcgcagtccgcgccatggcttcggggaacccctacgccgccgagctcgccgccgccaagaaggccgtcaccctcgccgccaaactctgccagacagttcaacaggatattatgcattctggcgttcaggctaaggcagacaaaagtcctgtcacagtggctgattatggatctcnaatattggtcggtttttcccttaagatggatgtatcatctggaccattttcattggtggctgaagaggactcagatgaattgagaaaagatggcgctgaagaaattttggaggatattactgaccttgtcaatgaaaccatctttgatgatggntcatataacatttcgtttacaaaaggaggtatactctctgcaattgatgatgggaagtctgaggggagtccatctggacgacatggggtgcttgatcccgatgacggtactaaaggtttcttgaggggcgaccatatgccatggcattggctctgcttgatgaaaggaaagttgtttttgggggg

SEQ ID NO: 26091 - protein, 166 aa, Zea mays
  misc_feature: Ceres CLONE 1398361-F
  misc_feature: SWISSPROT Homolog: EC 3.1.3.7 3'(2'),5'-bisphosphate nucleotidase
  misc_feature (54)..(54): Xaa is any aa, unknown, or other
MASGNPYAAELAAAKKAVTLAAKLCQTVQQDIMHSGVQAKADKSPVTVADYGSXILVGFSLKMDVSSGPFSLVAEEDSDELRKDGAEEILEDITDLVNETIFDDGSYNISFTKGGILSAIDDGKSEGSPSGRHGVLDPDDGTKGFLRGDHMPWHWLCLMKGKLFLG

SEQ ID NO: 26092 - DNA, 667 bp, Zea mays
  misc_feature: Ceres CLONE 1398362-F
  misc_feature: Encodes the peptide sequence at SEQ ID NO. 26093
  misc_feature (234)..(234): n is a, c, t, g, unknown, or other
  misc_feature (313)..(313): n is a, c, t, g, unknown, or other
  misc_feature (467)..(467): n is a, c, t, g, unknown, or other
  misc_feature (549)..(549): n is a, c, t, g, unknown, or other
  misc_feature (568)..(568): n is a, c, t, g, unknown, or other
  misc_feature (569)..(569): n is a, c, t, g, unknown, or other
  misc_feature (622)..(622): n is a, c, t, g, unknown, or other
  misc_feature (623)..(623): n is a, c, t, g, unknown, or other
  misc_feature (667)..(667): n is a, c, t, g, unknown, or other
aagctggagctccccgcggtggcggccgctctagaactagtggatcccccgggctgcaggaattcgcacgagaccattacctagaacatcctaatcgaaaaaaattctattactagctgcaaaagggcgtgtttgagactagcggaccgaccttgaagttgaagttgaaaaggccggcctgcgcggcgatggatgtcaagtgcggcgtctggaggggaaggtggccatcgtgancgcgtccacgatggggatcggcctcgccatcgccgagcgcctcggtctggagggcgccgccgtcgtcatctcctcccgncagcagaagaacgtgaacgaggcggtggaggggctcagggccaagggtatcaccgcggttggtgccgtctgccacgtctccgacgcacagcagcgcaagagcctcatcgagacgggcgtcaagagcttttggcacatagatattcttgtctccnatgctgccgcaaatccttctgtagatagcatacttgaaatgaaagagtctgttttctcgataagtgtgggatataaacgtcnagggcttctatccttcttnnatcagatgctgctcctcacctacgggaggggccatctgggattattattcctnncaatggctggtacaatccagaacaggattgacaatgtatggtgn

SEQ ID NO: 26093 - protein, 140 aa, Zea mays
  misc_feature: Ceres CLONE 1398362-F
  misc_feature: SWISSPROT Homolog: EC 1.1.1.184 Carbonyl reductase (NADPH)
  misc_feature (75)..(75): Xaa is any aa, unknown, or other
  misc_feature (102)..(102): Xaa is any aa, unknown, or other
  misc_feature (108)..(108): Xaa is any aa, unknown, or other
  misc_feature (109)..(109): Xaa is any aa, unknown, or other
  misc_feature (127)..(127): Xaa is any aa, unknown, or other
MGIGLAIAERLGLEGAAVVISSRQQKNVNEAVEGLRAKGITAVGAVCHVSDAQQRKSLIETGVKSFWHIDILVSXAAANPSVDSILEMKESVFSISVGYKRXGLLSFXXQMLLLTYGRGHLGLLFLXMAGTIQNRIDNVW

SEQ ID NO: 26094 - DNA, 662 bp, Zea mays
  misc_feature: Ceres CLONE 1398364-F
  misc_feature (215)..(215): n is a, c, t, g, unknown, or other
  misc_feature (218)..(218): n is a, c, t, g, unknown, or other
  misc_feature (220)..(220): n is a, c, t, g, unknown, or other
  misc_feature (221)..(221): n is a, c, t, g, unknown, or other
  misc_feature (222)..(222): n is a, c, t, g, unknown, or other
  misc_feature (224)..(224): n is a, c, t, g, unknown, or other
  misc_feature (226)..(226): n is a, c, t, g, unknown, or other
  misc_feature (227)..(227): n is a, c, t, g, unknown, or other
  misc_feature (238)..(238): n is a, c, t, g, unknown, or other
  misc_feature (239)..(239): n is a, c, t, g, unknown, or other
  misc_feature (240)..(240): n is a, c, t, g, unknown, or other
  misc_feature (249)..(249): n is a, c, t, g, unknown, or other
  misc_feature (250)..(250): n is a, c, t, g, unknown, or other
  misc_feature (251)..(251): n is a, c, t, g, unknown, or other
  misc_feature (351)..(351): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (378)..(378): n is a, c, t, g, unknown, or other
  misc_feature (379)..(379): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (433)..(433): n is a, c, t, g, unknown, or other
  misc_feature (435)..(435): n is a, c, t, g, unknown, or other
  misc_feature (436)..(436): n is a, c, t, g, unknown, or other
  misc_feature (439)..(439): n is a, c, t, g, unknown, or other
  misc_feature (444)..(444): n is a, c, t, g, unknown, or other
  misc_feature (447)..(447): n is a, c, t, g, unknown, or other
  misc_feature (448)..(448): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (491)..(491): n is a, c, t, g, unknown, or other
  misc_feature (502)..(502): n is a, c, t, g, unknown, or other
  misc_feature (505)..(505): n is a, c, t, g, unknown, or other
  misc_feature (506)..(506): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (515)..(515): n is a, c, t, g, unknown, or other
  misc_feature (536)..(536): n is a, c, t, g, unknown, or other
  misc_feature (538)..(538): n is a, c, t, g, unknown, or other
  misc_feature (541)..(541): n is a, c, t, g, unknown, or other
  misc_feature (542)..(542): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (579)..(579): n is a, c, t, g, unknown, or other
  misc_feature (580)..(580): n is a, c, t, g, unknown, or other
  misc_feature (583)..(583): n is a, c, t, g, unknown, or other
  misc_feature (587)..(587): n is a, c, t, g, unknown, or other
  misc_feature (591)..(591): n is a, c, t, g, unknown, or other
  misc_feature (597)..(597): n is a, c, t, g, unknown, or other
  misc_feature (598)..(598): n is a, c, t, g, unknown, or other
  misc_feature (606)..(606): n is a, c, t, g, unknown, or other
  misc_feature (607)..(607): n is a, c, t, g, unknown, or other
  misc_feature (611)..(611): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (632)..(632): n is a, c, t, g, unknown, or other
  misc_feature (635)..(635): n is a, c, t, g, unknown, or other
  misc_feature (639)..(639): n is a, c, t, g, unknown, or other
  misc_feature (640)..(640): n is a, c, t, g, unknown, or other
  misc_feature (642)..(642): n is a, c, t, g, unknown, or other
  misc_feature (644)..(644): n is a, c, t, g, unknown, or other
aaagctggagctcaccgcggtggcggccgctctagaactagtggatcccccgggctgcaggaattcgcacgagaccattacctagaacatcctaatcgaaaaatgttctcctgcctccgctccgccgccgcaacaaccatttccttctctagccgccgcctccgatcccctcccgaggctacagaaccagttcatccaggcgcgaatggggcggncgngnnncngnnaaaaggggggnnnaaaaaaggnnnccccccccccccccttttttggggggggggggccccccccccttttttttttttttttttttttccccccccccccttttttttgggggggggggggggngnnnaaaaaaaaaaaaaaaaaaaaagnnggggggggggggggggggggnnnnnnnnnnnnnnnnnnnnnnnnnnnccccccncnnaanaaaanaannaaagnnnnnagnnnnnnngnnnnnccccccccccccccccccncccccgcccgncgnntttnnnntnttttttttttttttttttgtncncgnncccgnnnnnnnnnnnnccccccccccccccccccccnnccncggngggngggggnngggggggnngggnggnnnnnnnnnnnnnnnnncnccncccnncncntttttttttttttttttt

SEQ ID NO: 26095 - DNA, 699 bp, Zea mays
  misc_feature: Ceres CLONE 1398369-F
  misc_feature: Encodes the peptide sequence at SEQ ID NO. 26096
gctctagaactagtgggtcccccgggctgcgggaattcgcacgagaccattacctagaacatcctaatcgaaaaacgatcacacaccactccacagcagtagcaagagggatagagcaaggccacacacacacacacaccactaggctagcctagccttttagtcgtcgaggaggagcaagaagggcgcgcacgcaagcaggcaagcaagaagagagccgatcgaccgagagctagcacgcgatggcgaggtcttccaagatgatgggggcggcagctctgctgggcttggccctggccgtgtcgatcgccgacgcgaggaacatcaagaccacgacgacggaaaagaaggacgacggcggtggtgcacccgcagaccttcccggcccttcgacccgcctcgggggggggcgcgtcccccggggttccggcggcctccccgggggggagcattccctgggcagcagcgattccccgggtttcaggatgggcccgggagcggcagcacccctacccggggttcaggcttggcccgggaggggggaagcatggccccctcttcgggggggggctccccggggctccaggggggttcggggggcatggcccggggtccccaaccggccgggtccggtccccgaggacggcaacaagccctggaacgccaacaagggggggaaataaaaggggcgctacctgt

SEQ ID NO: 26096 - protein, 146 aa, Zea mays
  misc_feature: Ceres CLONE 1398369-F
MARSSKMMGAAALLGLALAVSIADARNIKTTTTEKKDDGGGAPADLPGPSTRLGGGRVPRGSGGLPGGEHSLGSSDSPGFRMGPGAAAPLPGVQAWPGRGEAWPPLRGGAPRGSRGVRGAWPGVPNRPGPVPEDGNKPWNANKGGK

SEQ ID NO: 26097 - DNA, 677 bp, Zea mays
  misc_feature: Ceres CLONE 1398370-F
  misc_feature: Translation starting site: 160
  misc_feature (260)..(260): n is a, c, t, g, unknown, or other
  misc_feature (381)..(381): n is a, c, t, g, unknown, or other
  misc_feature (455)..(455): n is a, c, t, g, unknown, or other
  misc_feature (456)..(456): n is a, c, t, g, unknown, or other
  misc_feature (550)..(550): n is a, c, t, g, unknown, or other
  misc_feature (551)..(551): n is a, c, t, g, unknown, or other
  misc_feature (674)..(674): n is a, c, t, g, unknown, or other
aagctggagctccccgcggtggcggccgctctagaactagtggatcccccgggctgcaggaattcgcacgagaccattacctagaacatcctaatcgaaaaatcgcacataattattgagaccaactagcaacatagaaagcacaatattgtaccaataatggcagccaaaatattttgcctcattatgctccttggtctttctgcaagtgctgctacggcgagcattttcccgcaatgctcacaagctcctatagcttnccttcttccccatacctctcaccagcgatgtcttcagtatgtgaaaatccattcttctaccctacaggatccaacaggcaatcgcagcaggcatcttacctttatcacccttgttcctccnacaatcatcagccctattacaacagttacctttggtgcatttattggcacaaaacatcagggcacaacactacnnacactcgtgctagcaaaccttgctgcctactctcagcaacagcagttacctttggtgcattttgtggcacaaaacatcagggcacacaactacnnacactcgtgctagcaaaccttgctgcctactctcagcaacaacagtttctgccattcaaccaactagctgcattgaactctgctgcttatttgagcaacaaacactacttacattcagccagntag

SEQ ID NO: 26098 - DNA, 740 bp, Zea mays
  misc_feature: Ceres CLONE 1398373-F
  misc_feature: Encodes the peptide sequence at SEQ ID NO. 26099
  misc_feature (384)..(384): n is a, c, t, g, unknown, or other
  misc_feature (602)..(602): n is a, c, t, g, unknown, or other
aaagctggagctccccgcggtggcggccgctctagaactagtggatcccccgggctgcaggaattcgcacgagaccattacctagaacatcctaatcaaaaaacgttgacggccaccccgcccacagccgcgacaaactcttcctcagacccacgccacgtacgatgcctctctccccttcccctccgcccaacgccgccgccgccgccgccctacccctcctcctgctgctcgtctgcgccagcagcattgccgcgcatccgctggcgtcgtcgcaggccaaggcgctcctccgggtgcgccgactgctgttctacccgcacgggatatagccgctgcgcggtgcggcgcacacatgcggattaccgtccctgtcggacatgnttgcaccatcgcgagcatgctgtgcttctgtagtgccggtcccgtgaagaacgatgccgatcctgtatatgtgatgccagcatgacgcatagatactgcttagataggttgcagataatcgtagtgaatgacgaggacagccctcacaatcactctcggcaatgaataggagtaccggaacccacaatgtgacggagacgtcattctgggcccactanagagagcctcggcctacactacatatatggtgacgcgatgaacttcacatcatcagaagccggcaaagacctgctgccgtattggagaacggaaaaaacatcgacatgaaggcccggattgatttggaaactctcagg

SEQ ID NO: 26099 - protein, 55 aa, Zea mays
  misc_feature: Ceres CLONE 1398373-F
MPLSPSPPPNAAAAAALPLLLLLVCASSIAAHPLASSQAKALLRVRRLLFYPHGI

SEQ ID NO: 26100 - DNA, 748 bp, Zea mays
  misc_feature: Ceres CLONE 1398374-F
  misc_feature: Encodes the peptide sequence at SEQ ID NO. 26101
  misc_feature (449)..(449): n is a, c, t, g, unknown, or other
tggagctccccgcggtggcggccgctctagaactagtggatcccccgggctgcaggaattcgcacgagaccattacctagaacatcctaatcgaaaactccttcccctccctctttccacgacaccaaaagaaaccgaaaaccatcgacgcgctccgtccaccctcccctaccccgcgtcctcctcccctacgcctcccagcccagcggcaaaacctaaccctagatgggcgccgtcacctctacggtcgcggcgcgctttgcctttttcccgccgagcccgccgtcgtacgggttcgagcagccggcgccgcttccggcccctgccacacccgagcctccggccccggacacatccaaggcgccgcctccggacccggacacacccaagccgccgcctccggacccggccacacccaagccgccgccagtgggggaggagaacggcgntgccgcgtcgttggagctcacgggcgtcccgcggatggctaacgtggaggcgcgacggctgcggacgaagcgttgcactgaggtgcccgcgaagcacgtgcgccagccgggggccaagctcacgctgctctactcccagggaatcgccgccgacctcggccagatgaacaagctcttcgtcgagctcagggcccacctcaacggtcaacctcatgggaaatgactaattctgggaatgggcaaaccaaccggaatccccaaaggcaccaaaacattaattcttgaaataagaaggtgga

SEQ ID NO: 26101 - protein, 148 aa, Zea mays
  misc_feature: Ceres CLONE 1398374-F
  misc_feature (75)..(75): Xaa is any aa, unknown, or other
MGAVTSTVAARFAFFPPSPPSYGFEQPAPLPAPATPEPPAPDTSKAPPPDPDTPKPPPPDPATPKPPPVGEENGXAASLELTGVPRMANVEARRLRTKRCTEVPAKHVRQPGAKLTLLYSQGIAADLGQMNKLFVELRAHLNGQPHGK

SEQ ID NO: 26102 - DNA, 696 bp, Zea mays
  misc_feature: Ceres CLONE 1398381-F
  misc_feature (103)..(103): n is a, c, t, g, unknown, or other
  misc_feature (210)..(210): n is a, c, t, g, unknown, or other
  misc_feature (211)..(211): n is a, c, t, g, unknown, or other
  misc_feature (255)..(255): n is a, c, t, g, unknown, or other
aaagctggagctccccgcggtggcggccgcttctagaactagtggatccccccgggctgcaggaattcgcacgagaccattacctagaacatcctaatcgaanagtttcttggatagtccgtagccgcttgccctgttcgcatcttcgcgcgtggcgcacaccgctccagctctccttcgacgggcacggccgagccgccttcgtcttgnncgcagcggtgcgcgctctccatggcgtcctaatttagctagcgncacgccccgcccgtgcctgcgggatggatgaaccccttcctgggcatgggcctaggaccaacggaaaaaaagaagctggtaagggcccagtccaaaaacgaattaacttggtgggccctcaccgctgatgggacccacgaaatttttccaatgaaaccttttgggttgtcgggcccccctgggagggtttccccttcccggggcccccttccccccccctttgggggggaaaggggttccactatttcggggaagggggaaaacttggaaaccctgtggggaaatcttcgggcgaaaaaaaaaattttttttggtttacaaaaaaagggaaacctttggtgcccccattaacccgtgggggggggaatatttggaaaaaccggggaacccctttcttttttttggaaaaacaaaaatatccttgtggggggagggtttttc

SEQ ID NO: 26103 - DNA, 732 bp, Zea mays
  misc_feature: Ceres CLONE 1398382-F
  misc_feature: Encodes the peptide sequence at SEQ ID NO. 26104
  misc_feature (566)..(566): n is a, c, t, g, unknown, or other
  misc_feature (567)..(567): n is a, c, t, g, unknown, or other
agagctggagctccccgcggtggcggccgctctagaactagtggatcccccgggctgcaggaattcgcacgagaccattacctagaacatcctaatcaaaaaaaaaaaagttggtccgctcccaccctccgtccgaccgtcctcgacctcccgtcccgccgcctcccacagtcgcaaccctagtcccacccgccgtcctcccgccctcccgcttcccattttcagtcgccgagccgcgtacagcgcacgcactgcacgcgcatcggcacttccagcgacgcgtcgtgagctcctcccttcgacccttcctgtggcgcgtcgtaagctctgtgcaggcgacggcggcgcgctaccagtgacggggggatacggcggcatcgtctccctcggcccctcctccatcccggtgcggcggcgccagcctacagggcaggagtaccaccaagcgagcgcgatggtgagctccgcactgaggcgctgtctcccctgccatgcctctctctgtcatgccttccctccccatccgctgctggcggctgccggcgtcttccagtcgtcattccagnnccgggggatggggagactattgaccgattccaaaaaaaggggttggtttgggggggaagggcccccggacaaaggggtccctctcttcgagaaactcccgaaagggcctgaaaaaacccggggaggaaataaatatggcccttgggaagaaggaggggggtttat

SEQ ID NO: 26104 - protein, 92 aa, Zea mays
  misc_feature: Ceres CLONE 1398382-F
  misc_feature (38)..(38): Xaa is any aa, unknown, or other
MVSSALRRCLPCHASLCHAFPPHPLLAAAGVFQSSFQXRGMGRLLTDSKKRGWFGGEGPPDKGVPLFEKLPKGPEKTRGGNKYGPWEEGGGF

SEQ ID NO: 26105 - DNA, 732 bp, Zea mays
  misc_feature: Ceres CLONE 1398384-F
  misc_feature (323)..(323): n is a, c, t, g, unknown, or other
  misc_feature (334)..(334): n is a, c, t, g, unknown, or other
  misc_feature (335)..(335): n is a, c, t, g, unknown, or other
  misc_feature (345)..(345): n is a, c, t, g, unknown, or other
  misc_feature (378)..(378): n is a, c, t, g, unknown, or other
  misc_feature (379)..(379): n is a, c, t, g, unknown, or other
tggagctccccgcggtggcggccgctctagaactagtggatcccccgggctgcaggaattcgcacgagaccattacctagaacatcctaatcgaaaaacataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaaggacgcgcgctggcgcccagcgtgtcgtactacgacacatcatcctggggcgcggcacggccggntgcccgctggnncgcacgctgncgagcgcctccccgtgctgctgcttgaaagcgnngcctcgcccaacgacgacaccgaattgggggaaatgcccccctttcggaaacacctggtcgaaaccttccccgggtcgcccgcgcagagctctttgggggaagaagggggcattaaatcccggcccccgggggttggtgggggggaaaatgaataaaaaccgggttttacaccggggccaagaaaaatacatgggggggggtctccgggaaccatggggcccccccgggggggtaaccctggggggggagaaaaggtgggggtcccccccaacttgtggccccccccgaaaacccctttttgtgggcccccccccaagaggggggaagccccccaaaaagtgttcttttaaat

SEQ ID NO: 26106 - DNA, 732 bp, Zea mays
  misc_feature: Ceres CLONE 1398385-F
  misc_feature: Encodes the peptide sequence at SEQ ID NO. 26107
  misc_feature (428)..(428): n is a, c, t, g, unknown, or other
  misc_feature (429)..(429): n is a, c, t, g, unknown, or other
  misc_feature (560)..(560): n is a, c, t, g, unknown, or other
aaagctggagctccccgcggtggcggccgctctagaactagtggatcccccgggctgcaggaattcgcacgagaccattacctagaacatcctaatcgaaaactcgccgcaacgaattcccggtctccaaccagccggccagccaccgcagacgacccctagttccgcgtccccgacccgaaccctcgagttcgcacgggctccggccagattcgcgcggtctaagcttcgaatcggcgcatggaggcagcagtagccgcggcactcaagtcgcccaccgccgcacgtccctcgtggcggcccgcggccccgggcgccacctcgctcccctttgaccggaggcgcagctttgccttcggctccatcaagggtctcgggcggcagcagctcacctctaggactaggaggcgaagcagtgtggtcagggnnctctggtccccctcggagtctctggcaccgtcctcgtcgatggcgccgctcaggatggaatcgcccgcggggcagctactctcccagattcttcaaagcacccgcacctactggctgggcgcggcgagganaaactcgagctgctccgaccgacggggggaaaaaaggttaaggttaggggaggcgatggtggcgaaaagctgtttccaaagggggcgacctctgttgaaaggggggatggtcagttaaagaaaaggaccgggggggctctttgaggaaacctttggtctgggttggagaaat

SEQ ID NO: 26107 - protein, 145 aa, Zea mays
  misc_feature: Ceres CLONE 1398385-F
  misc_feature (63)..(63): Xaa is any aa, unknown, or other
  misc_feature (107)..(107): Xaa is any aa, unknown, or other
MEAAVAAALKSPTAARPSWRPAAPGATSLPFDRRRSFAFGSIKGLGRQQLTSRTRRRSSVVRXLWSPSESLAPSSSMAPLRMESPAGQLLSQILQSTRTYWLGAARXNSSCSDRRGEKRLRLGEAMVAKSCFQRGRPLLKGGMVS

SEQ ID NO: 26108 - DNA, 660 bp, Zea mays
  misc_feature: Ceres CLONE 1398386-F
  misc_feature: Translation starting site: 248
  misc_feature: SWISSPROT Homolog: EC 1.14.13.93 (+)-abscisic acid 8'-hydroxylase
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (400)..(400): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (557)..(557): n is a, c, t, g, unknown, or other
  misc_feature (559)..(559): n is a, c, t, g, unknown, or other
  misc_feature (564)..(564): n is a, c, t, g, unknown, or other
  misc_feature (566)..(566): n is a, c, t, g, unknown, or other
gctcaccgcggtggcggccgctctagaactagtggatcccccgggctgcaggaattcgcacgagaccattacctagaacatcctaatcgaaaacgaaaaattcgaaagatccctccaggaaagatttttcttccctcctccgacgccccagcccaccaacacactctataaagcagccctcagtcacacacagaacgcacaagcgcaagccgggcaagaaaactccgtaggccagtctgcgagttggatggccttcttcttggccctcgtgtgcatcctcatcttgctagccatcgcctcctacgtccagtacactcgctggaaaaaaaggggaaaagaccgctcgcgnnncatgggaggtctgctcccttgaaagctgctcctggctccatgggctggncttaccttggcgagaccctccagctttacaccaaggaccccagtttcttctcgctcaaaaaagaaaaggaacggcgagaactccaaacgcaccttccggggttcccggggggtaatgtggaaaaccgaaaaannnccccggtttaatttgagggggngnggggncngtttttgcgccgctttccccccggcgcgggaggggtgtggtgggctcctcgtttcttttttcccagggggggtaacccccccccccccccgagg

SEQ ID NO: 26109 - DNA, 744 bp, Zea mays
  misc_feature: Ceres CLONE 1398389-F
  misc_feature: Encodes the peptide sequence at SEQ ID NO. 26110
caaagctggagctccccgcggtggcggccgctctagaactagtggatcccccgggctgcaggaattcgcacgagaccattacctagaacatcctaatcgaaaaccttcgcattaatggccgctctctccctatcccctttcgtctcgctctcggagtaggacactcgcccgcttccggcttaaccttcaagattctccctcctcctcctacttcttcccgcttgggcgggcgcggcaccttccggttctgggcctcctatatatatacgcgcgcgaccgtcccccttccatactccctagcatgctcggctcgcaccccggattgatcgagctcgcccgtcgccgcgatggattcggtgccttccccctcctcttctacccgggccaccgctgctcccggtccctgctgccgctttgacgcgctagcggagggcgtgcgccaggcacgccgccgccgccgagcgggcccgccgggtgggcgctcggcgcgctgctcactgcgtcttcgccgtcgtgagctcactcgtcggaatcttcatggtgctttccatggggatgtctacagaaagcgcatgtcccgcggggctggggtcggaacagtctcggaagcagtctctccattggagggtggtgagtctgcatccaagaattggagggccagcccttcgggaaaaacgggattccctaaggggtgggaatcatctctaggcccttcagggggaaaaatgtgggggaaaaaagcca

SEQ ID NO: 26110 - protein, 57 aa, Zea mays
  misc_feature: Ceres CLONE 1398389-F
MSRGAGVGTVSEAVSPLEGGESASKNWRASPSGKTGFPKGWESSLGPSGGKMWGKKA

SEQ ID NO: 26111 - DNA, 810 bp, Zea mays
  misc_feature: Ceres CLONE 1398392-F
  misc_feature (218)..(218): n is a, c, t, g, unknown, or other
  misc_feature (268)..(268): n is a, c, t, g, unknown, or other
  misc_feature (269)..(269): n is a, c, t, g, unknown, or other
  misc_feature (277)..(277): n is a, c, t, g, unknown, or other
  misc_feature (278)..(278): n is a, c, t, g, unknown, or other
  misc_feature (301)..(301): n is a, c, t, g, unknown, or other
caaagctggagctccccgcggtggcggccgctctagaactagtggatcccccgggctgcaggaattcgcacgagaccattacctagaacatcctaatcgaaaaaaacaacgccgcgacgagaagagagaagagggcgggcatcggccagtgggggctcggaggccgagggaggcgaggaaagcggcgggtgccgggccgcccgcggcggtgccgaggnccctcacagtcaccaccccctccccctcttcgtctgtcccccgctggcgnncaccgcgnntgctggtcgggacctttcccccnttttacgctcccgggggcccgggttggggtccctttttgccgccggtggcttcgtggccggaactcgggggttccccccggttccccaatcccggccgggggggggggtttcccccccgatttggggcgggaaagggccccccaaggttatagtgggcgggggggccccccttgtggggccccccgtccccccttttcccccccccggggggggggtgctcttctcctttgtgggcccccaaaagaaaaaaaaaaaccgggggggggttttttggggggggtttaccttcccccgcggggggggggggaggagaaaaaacacaccccccggggtttttcctccccccccccccccgtggggggggggggcccctcctttttgggggggggggggttttttaaaaaaaccccccccccccccccccccggggggggggggggggggaaaagaaaaatatttcccccccccccgcgggggggagttttttttttaaacaccaacacccccc

SEQ ID NO: 26112 - DNA, 666 bp, Zea mays
  misc_feature: Ceres CLONE 1398395-F
  misc_feature (459)..(459): n is a, c, t, g, unknown, or other
  misc_feature (540)..(540): n is a, c, t, g, unknown, or other
  misc_feature (647)..(647): n is a, c, t, g, unknown, or other
tccccgcggtggcggccgctctagaactagtggatcccccgggctgcaggaattcgcacgagaccattacctagaacatcctaatcgaaaactgttttgttctccttctcattcgactctgatgatgacgagacggttatcgttccccttctggttcggtggagatcgccgccgttggcgtttcgatcgccatatttaaccaagtctccaaggtctgcatctaccctctcgttagcgtcacaacgtcgttcgtcgcggaggaagacgcgatcatcagtaaggccgtccgaggaaacagcagccaggaggaggacgtggagaaagcctcccacgtgggctttgatccggagaccagcaatctgcatgcatctggccctgcaggtatggcagaatgcgtgaactcgtgatcccctacggagtgcgcagcagatccctctggcaggcaagggcggggcgagnaagaggtaccgtggccgtcggtcacgtcggcggtaaatagtcggttccattctcggcctggcttcaggccgtcttcctggncctttcgggccagattcgtgctcacaatcatggggtgtaaagtccggatccccgatgcaagggcctgcggtgcgctacttaacgataagggcccttggggcccccgntgggctgctggctctggcc

SEQ ID NO: 26113 - DNA, 705 bp, Zea mays
  misc_feature: Ceres CLONE 1398396-F
  misc_feature (37)..(37): n is a, c, t, g, unknown, or other
ggcggtggcggccgctctagaactagtggatcccccngggctgcaggaattcgcacgagaccattacctagaacatcctaatcgaaaaaaccttcgcctctcctcccgttgtcagccgccgtgcctgttctctctgcctttctaaaagtgcggcgactggttgggctgccgccgactgccggggccttcgccgacctcttcgccggcgaagaggtcccatcaggagaaggagtagatcgtcgacccagaaccctcgctgatggcgactttcgcgaaactgagaacgcgctgaagagagccgaagattaatccatgttggtcaaaagcagtcagccctgcaggcttacctgatctcattacctcgaaagaggacggggcatggaagagccctcccgaaagatcttggtggagtatggaaaaattcctgggtgacctgaggaaaggaaatttggaaaaaaggggctattccaacaaaagattgttcggcaaaaagaaaaagggcctccctttggggggggcgaaaaaacatttccggggcttttcaaaggggaagggggaaagtttaaaaagcgcgccaaaaccccggaagagcttttggcgttgggaaaatattttgaaaaaaaaaggggcccccgggcgccctgctgtgtttttttttggggcgggcgcaaaaagagagcaccccccttcgttcaaaagaggggg

SEQ ID NO: 26114 - DNA, 665 bp, Zea mays
  misc_feature: Ceres CLONE 1398400-F
  misc_feature: Translation starting site: 276
tccccgcggtggcggccgctctagaactagtggatcccccgggctgcaggaattcgcacgagaccattacctagaacatcctaatcgaaaaatataataggttctctcgagccttcgccgccaagagcccgatacccgccgtcctccctgctcctgctgccgcgtgcccctctccggccacccgccgccggcgcagtgtccatgaactagcacctctttcttcgcccggtacccattcagttcgtccgcctccttctcttcgagtttgggtgcccatggagaccagcagtgcgcccgccgccgccaccgaggcgcggctggtacgtgcttggaccgaacctaggagggcgtcggaccctacgcgcttgctgagcttcgagaacatttcgcacacggttatttcaatgagagcacaatgctcctgggcaacagggaggaaggaatgcatgccactctcgtccatctctgagtaacactccgcagccgcagcgaaggatcaatctgaacagatgctcaagaaggttgatgatgatttttgagaaattccggaaggaggttatcgaaccgaaaatgggggggggaaggccttgaaaggccattgatgtgaaccagcaagtatgatgagcggccagcaccccccctggaagggaagaggaagaatttac

SEQ ID NO: 26115 - DNA, 699 bp, Zea mays
  misc_feature: Ceres CLONE 1398401-F
  misc_feature: Encodes the peptide sequence at SEQ ID NO. 26116
  misc_feature (317)..(317): n is a, c, t, g, unknown, or other
  misc_feature (412)..(412): n is a, c, t, g, unknown, or other
  misc_feature (426)..(426): n is a, c, t, g, unknown, or other
  misc_feature (441)..(441): n is a, c, t, g, unknown, or other
  misc_feature (442)..(442): n is a, c, t, g, unknown, or other
tccccgcggtggcggccgctctagaactagtggatcccccgggctgcaggaattcgcacgagaccattacctagaacatcctaatcgaaaaacaaaccctcgtctcgtgccactttctcagtcccctctagccgccgcctaccgctcgcgctctcctcgcgttcgggaaggtcgtttcgccatggcctcggagacggagacgttcgccttccaggcggagatcaaccagctgctctcgctcatcatcaacaccttctactcccacaaggagatcttcctcagggagctcatctccaactcctccgatgccttggacnagatcagggtttgagaagtttgacggacaagacccaagctggatgccagggcccggagctgttccatccacaattgtcccccggacaaggcccancaacacggctgacnatcatcgacagcggnnatttgggtatggaaccaaagcaggaacctttgtgaaccaccttggtaccactttgggcccgtccagggccccaagggaaattcatgaaggactttgctgcgggggggcctgatgggcccatgaattggccccctttttggggggccctttttcacctcggcccccctggtgcaaaaaaagggttgtcccggccccctaaacccaatggttgtgggcccgaacgggggggaaatttccagggtgggggggcccccccg

SEQ ID NO: 26116 - protein, 49 aa, Zea mays
  misc_feature: Ceres CLONE 1398401-F
  misc_feature (46)..(46): Xaa is any aa, unknown, or other
MASETETFAFQAEINQLLSLIINTFYSHKEIFLRELISNSSDALDXIRV

SEQ ID NO: 26117 - DNA, 678 bp, Zea mays
  misc_feature: Ceres CLONE 1398403-F
  misc_feature: Encodes the peptide sequence at SEQ ID NO. 26118
  misc_feature (580)..(580): n is a, c, t, g, unknown, or other
  misc_feature (581)..(581): n is a, c, t, g, unknown, or other
  misc_feature (600)..(600): n is a, c, t, g, unknown, or other
  misc_feature (604)..(604): n is a, c, t, g, unknown, or other
  misc_feature (678)..(678): n is a, c, t, g, unknown, or other
tacccgcggtggcggccgctctagaactagtggatcccccgggctgcaggaattcgcacgagaccattacctagaacatcctaatcgaaaaattaagattagcaaaattgtgggccagcagcaggagcgcccccgtctccctccaccctcctctgtcagggtcctccgattcggacttcctcacggccgccgcgcgaaatcccgtctcgttgctccggtccgctgcgcatcctcaggaatggaacttggcgccaccactgccctctaccctctgcaccgctgcaaaaccatttacctggtcaggcatgcccagggcatcacaaaatggtcgcgggggagaaggacttcggcgcgtacatgtcacatgaactgttcgatgctcagctcactcctttgggttggacccaagtcgatggtctgcgtgagcatgtgaaagaaaagtgggcttgcagaaaagattgaaattagttatttcttcccctttactgaggactatggcaaactgcagttagtggtctttgggtggtgaaaggattactggatggtgtaaatgcacctccactaatggtcgaaatgcaannaaccagtgggcccgccggnacantttcaagtttgaactgcccccaaattttattgcagtcgaaacctgcaaaaggaacactgtgggggtccatcccn

SEQ ID NO: 26118 - protein, 45 aa, Zea mays
  misc_feature: Ceres CLONE 1398403-F
MVAGEKDFGAYMSHELFDAQLTPLGWTQVDGLREHVKEKWACRKD

SEQ ID NO: 26119 - DNA, 707 bp, Zea mays
  misc_feature: Ceres CLONE 1398405-F
  misc_feature: Encodes the peptide sequence at SEQ ID NO. 26120
  misc_feature (625)..(625): n is a, c, t, g, unknown, or other
  misc_feature (641)..(641): n is a, c, t, g, unknown, or other
  misc_feature (652)..(652): n is a, c, t, g, unknown, or other
  misc_feature (653)..(653): n is a, c, t, g, unknown, or other
  misc_feature (658)..(658): n is a, c, t, g, unknown, or other
  misc_feature (659)..(659): n is a, c, t, g, unknown, or other
aaagctggagctccccgcggtggcggccgctctagaactagtggatcccccgggctgcaggaattcgcacgagaccattacctagaacatcctaatcgaaaaaaatcccgctgcttccgccaccggctaccctcgcggcctcgcccgtggccacctcctttcctctttccatttccgttcctccgctcccgatccctaaaccctacctaccccaaacccgcggcggcggcggcgcgactgttgggtttccttggtcatgggctgcttcctctcctgcttccggggcggctccaacccgtcgggcgatctccgcgacccgctcgtgagggagagccgcatcggggacgcctttgtcaacgacgagaagaagcttgatgaagcgactggaaagctggatgtcgaggcggctactgaccacggagtcgacgacgagccttcggagagaggcaaattatctcaaatcatgtggcacaatatcacagaccccaccggaaattctagattcaatcccaatcaactcagaagatggctaacgagtgcggcgatacaccgaccaacgtgcagaacaaaaaattgtaaagggggaaagtttggaagagaactcatctgaactgctcaactccantgggatcacgatgacntacataacggnnactgnngtgtgataaggaggctctctcctggggggggggaatcagagacccaca

SEQ ID NO: 26120 - protein, 117 aa, Zea mays
  misc_feature: Ceres CLONE 1398405-F
MGCFLSCFRGGSNPSGDLRDPLVRESRIGDAFVNDEKKLDEATGKLDVEAATDHGVDDEPSERGKLSQIMWHNITDPTGNSRFNPNQLRRWLTSAAIHRPTCRTKNCKGGKFGRELI

SEQ ID NO: 26121 - DNA, 662 bp, Zea mays
  misc_feature: Ceres CLONE 1398407-F
  misc_feature: Encodes the peptide sequence at SEQ ID NO. 26122
tcagaactagtggatcccccgggctgcaggaattcgcacgagaccattacctagaacatcctaatcgaaaaggacaccgcgccgtcccgcgggccgcggggacaccagcctctccactgcgctctgcgctccaggaccctctctggcctctgcgaaatgccgctcttcccctccaccgccgtggcgcccccgcctcagcatcccattcccattccctctccaccacagccccatcccccttcccctcctgctccgccgccaccactcctcgccccacccgcgccttctccccttggcggcgtccctcccgcccccacctcccgaggagctgctccacaggcaggccacgggtctcgtcactgcctcacaggccaacttcatgcgcgtcatcgtggacgccacgggcccggggctggaccaccaccgcggctccgaccagctctgcgtcgtccgcgcgctgctcaagaagatcccgcgccgcgtgactcgtcggagaacgagtcctccatcgggacgggtctaatggacggaacagccgggaggaagagcggataagagcgacggaggggaggaaccgagagaattaagagatgactcgtgcgacgagggggagagagcgagaggaaacgccggtacgatgtgaagaggacaaggagcaacgt

SEQ ID NO: 26122 - protein, 47 aa, Zea mays
  misc_feature: Ceres CLONE 1398407-F
MRVIVDATGPGLDHHRGSDQLCVVRALLKKIPRRVTRRRTSPPSGRV

SEQ ID NO: 26123 - DNA, 635 bp, Zea mays
  misc_feature: Ceres CLONE 1398408-F
tttcacgagaccattacctagaacatcctaatcgaaaaggacaccgcgccgtcccgcgagccgtggggacaccagactctccactgcgctctgcgctccacaaccctctctggcctctgcgaaatgccgctctacccctccaccgccgtgacgcccccgcctcagcatcccattcccattccctctccaacacagccccatcccccttcccctcctgctccgccgacaccactcctcgccccacccgcgccttctccccttgggggagtccctcccgcccccacctcccgaggagctgctccacaggcaggccacgagtctcgtcgctgcctccacaggtcaacttcatgccagacatcgtgaacgccacggccccggggcaggaccaccaccgcggctccaacctgctctgagacgaccgcgagctgctcaagaagataccccgaccgcgtgctcatcgatgaccgagatctccctcagcccgatcaaaatgaaactgaatcgccgccgataagatccaaggatgccttcctaacgtaaaatccccaggttcgccgacccatcctgtcacccaacgtcaaaccattccctcacatgctacttccccgtaaataaaaccgagaaataagaaaacg

SEQ ID NO: 26124 - DNA, 744 bp, Zea mays
  misc_feature: Ceres CLONE 1398409-F
  misc_feature: Encodes the peptide sequence at SEQ ID NO. 26125
aaagctggagctccccgcggtggcggccgctctagaactagtggatcccccgggctgcaggaattcgcacgagaccattacctagaacatcctaatcgaaaaagtcttcacggcgcggttgttgtcgcttgtggccagccgccagcaccagcacaaggcgatcgagagtggtgaccaccagtaaactgcaaagtgcaaaccaaacaccacccacgagaaagcggaggagggagcaatggcggagccgagccagcagctgcggtcgttcgtggaggtgccggcgggctcccacttccccatccagaacctgcccttcggggtcttccgccggcggtgggtgcaggcgcaggcgccgcgccccgcggtggccatcggagacttcgcgctcgacctcgccgccgtcgccgacgcgggactcttcgacggtgccgcgctctccggctccccgtgcttccaccaggagacgctcaacatgttcttgtcgatgggccgtacgccgtgaagggagtcgctcgccacgctacagaaatcctatcagacgactagcccgtcttgcgtgacacgaagcactgaggaactagtgtctgtgaccaatgactgaatagagatgcatctaccgatgacgagtgagacgtatcggcctacttatgctgtgctgccgagcaatgatttcagattgcactacggtgcctgaaaatctcaaaatagacttaatctctgtacctcagcacagaagaacctcgg

SEQ ID NO: 26125 - protein, 88 aa, Zea mays
  misc_feature: Ceres CLONE 1398409-F
  misc_feature (10)..(88): Pfam Name: DUF1969 Pfam Description: Domain of unknown function (DUF1969)
  misc_feature: SWISSPROT Homolog: EC 3.7.1.2 Fumarylacetoacetase
MAEPSQQLRSFVEVPAGSHFPIQNLPFGVFRRRWVQAQAPRPAVAIGDFALDLAAVADAGLFDGAALSGSPCFHQETLNMFLSMGRTP

SEQ ID NO: 26126 - DNA, 765 bp, Zea mays
  misc_feature: Ceres CLONE 1398414-F
  misc_feature: Encodes the peptide sequence at SEQ ID NO. 26127
  misc_feature (277)..(277): n is a, c, t, g, unknown, or other
  misc_feature (331)..(331): n is a, c, t, g, unknown, or other
  misc_feature (441)..(441): n is a, c, t, g, unknown, or other
  misc_feature (442)..(442): n is a, c, t, g, unknown, or other
  misc_feature (462)..(462): n is a, c, t, g, unknown, or other
acaagctggagctccccgcggtggcggccgctctagaactagtggatcccccgggctgcaggaattcgcacgagaccattacctagaacatcctaatcgaaaagtcgcacggattggcattggctgccctccggccctgttcctcgtcctcctcatcaaatcccgtctcctcagtcctcccaataatggtggcgtggtgagaaatccttccgtccggccgtcgtcttagaagatgaactgttcctcttgctgcgccgctgccactccatcttctccngcgcttctcgccaggccgcgggggggtttagctgctagctgctccacgacgacngcaaatcagaaggtgctttttcctgggctcaaaacagtttccacggatcacgtataggccttgcgttcctcacggttgtacgcggaaagaagtattaagctttttgcggnncaacaaccttgggacatcgncagaatttgtcaagaaccttgattttcttcaagggggcttccaaactttttcaaagattggaaaacctttccatcggcagtttccctgaacctggtttttagggaaggccccaaaaaaagggaaccctcaaaagggggggctggtactggaaccccccgggggttttggcccacctttgttgggaaccccttgaaaaaaaagggaaccctcttcccaatttttgtcaaaaagtgacaagcggggggtttattttttccccctatttgtcctttttttttggaggtttgtccaaagaaaacctt

SEQ ID NO: 26127 - protein, 51 aa, Zea mays
  misc_feature: Ceres CLONE 1398414-F
MNCSSCCAAATPSSPALLARPRGGLAASCSTTTANQKVLFPGLKTVSTDHV

SEQ ID NO: 26128 - DNA, 646 bp, Zea mays
  misc_feature: Ceres CLONE 1398416-F
  misc_feature: Encodes the peptide sequence at SEQ ID NO. 26129
  misc_feature (379)..(379): n is a, c, t, g, unknown, or other
  misc_feature (413)..(413): n is a, c, t, g, unknown, or other
  misc_feature (458)..(458): n is a, c, t, g, unknown, or other
  misc_feature (499)..(499): n is a, c, t, g, unknown, or other
cgcggtggcggccgctctagaactagtggatcccccgggctgcaggaattcgcacgagaccattacctagaacatcctaatcgaaaaactctgcaaagcgcgcgaccggacggcccggttcgttctcgacctctcgtctcgctcatccgcccgcccccgaggaagtaaccctagcctagccttgctccgaccggtcgccgcggcgactgcgacgatgatggactgcgctggaggccgagaccccgtggaggacttcctcctcggcggcgccggcgccggcgacgacggagatctcgtcgccgtcttctgcgacgacggaggacttggggattgagggtatccatggagatgcttgtggatttgagcaatctaatttggngaaaaggggtagagatgaaccatgttcatctggnccacatccaaagcttgccgtgaaaaaatgaggaggggacagctgnatgacaggtcctgggaattagtttcattatgaatcctggtnaggaagcaaagtagataagcaaatatattgagtgatgagccccggatgttgcacaactttaaagggggaggcgaaaaggtaaggatccaattgaaaagtggggggaaaatttagggggtttgaagggggggaaaaccggctccggga

SEQ ID NO: 26129 - protein, 39 aa, Zea mays
  misc_feature: Ceres CLONE 1398416-F
MMDCAGGRDPVEDFLLGGAGAGDDGDLVAVFCDDGGLGD

SEQ ID NO: 26130 - DNA, 672 bp, Zea mays
  misc_feature: Ceres CLONE 1398420-F
aaagctggagctccccgcggtggcggccgctctagaactagtggatcccccgggctgcaggaattcgcacgagaccattacctagaacatcctaatcaaaaaaacatcgattttcctccggaatcgtaacctcagaaagccaaatctcattctccggcgctcaggcccacccgagcgtcgactctcccgatccaatcggtacctcctagttcctcgccggcggtagcggcgtcgggcggacagcggtgacttggcgagggcgcttggccggcgactatcatccactaggatgggaagtgaggcacagaacgtgggtaggtcttggtcttaaacatgtgggtctcctggagactactacctttcagaatacgttctggaagccagtggccaacaaggacttggttgatcatgcacaccctggccccgtgtaaagggtcttcactcaggaacttgaggccactttgggaaagaacttaatccaaactatacgtggacctctcgtgagcccaaaggttttttgtactctcgcaagagtccacaaaaaagaggttgggccccctattattgcccccctttgaaggggtgggcaaatggaaaagagacttttttgggggggggaaaatttgagggcactctttggtaaattgttgggggggcgccccaatggatacc

SEQ ID NO: 26131 - DNA, 745 bp, Zea mays
  misc_feature: Ceres CLONE 1398421-F
  misc_feature: Encodes the peptide sequence at SEQ ID NO. 26132
  misc_feature (745)..(745): n is a, c, t, g, unknown, or other
tggagctccccgcggtggcggccgctctagaactagtggatcccccggtgtgcgagaattcgcacgagaccattacctataacatcctagtccaaaaacactcgtccactcagcccctctttgctctgcctcgccgcgccgcagagcagagcatggcgcccccacgccctctcctcgccgccgacttcctcgccggggcggcactgctcctcctttctccggcagaggcggagacgcggggcgtgaactacggccgcgtggcgaacgacctgcccgacccagcggaggttgtgcagctggtccagcagcatgacgtcacgaaggtgaagctgtacgacgccgaccccaccggtgctgcgcgccctcgcgaacacggccaataaaggggggcgcgggtcgctgccacaccaacaaggccgcgaccggaaacggccccgcccaaccataaaaggggggtaagactcggcgccggacaattggcaaaccaaccaaacggggggcggacaacgtgccgggccccctcccccgacggacgccacctcgggtacggggcaaagaaaattttcagcggggtataaactcccgcgcgcgggcgctcgcccaccccccgacgcgccacatccgtcggcgacactcgggggcccccctctccttacagtagcccaccctcctcccgagtctcgggattaccaacctgcagcacctgcgcacaccattcaccgatactcacccccctcttcccacn

SEQ ID NO: 26132 - protein, 76 aa, Zea mays
  misc_feature: Ceres CLONE 1398421-F
  misc_feature: SWISSPROT Homolog: EC 3.2.1.39 Glucan endo-1,3-beta-D-glucosidase
MAPPRPLLAADFLAGAALLLLSPAEAETRGVNYGRVANDLPDPAEVVQLVQQHDVTKVKLYDADPTGAARPREHGQ

SEQ ID NO: 26133 - DNA, 737 bp, Zea mays
  misc_feature: Ceres CLONE 1398430-F
  misc_feature: Encodes the peptide sequence at SEQ ID NO. 26134
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (466)..(466): n is a, c, t, g, unknown, or other
  misc_feature (467)..(467): n is a, c, t, g, unknown, or other
  misc_feature (493)..(493): n is a, c, t, g, unknown, or other
  misc_feature (496)..(496): n is a, c, t, g, unknown, or other
  misc_feature (502)..(502): n is a, c, t, g, unknown, or other
  misc_feature (511)..(511): n is a, c, t, g, unknown, or other
  misc_feature (577)..(577): n is a, c, t, g, unknown, or other
  misc_feature (579)..(579): n is a, c, t, g, unknown, or other
  misc_feature (610)..(610): n is a, c, t, g, unknown, or other
  misc_feature (665)..(665): n is a, c, t, g, unknown, or other
caaagctggagctccccgcggtggcggccgctctagaactagtggatcccccgggctgcaggaattcgcacgagaccattacctagaaacatcctaatcgaaaaaaccaacccctcaaacggttaaacccatgccgctaatcgacgccgccgcctcggcggtcgcgccgcccccaccccggcgagtggctcaactccgcttcttcagcactcgcagacccggaatcctatccctaactgccaccagctgctccccctcccctccgcccccggtcgctgcggaggtgcctgcgccgccacaggaagcgaagtcgaagccaggccacggcggtacccgaagcagtaccccggcgagtcggtgggcgttgctgaggagatgcgctttgtcgccatgcgcctgcgtaaccccaagcgcaccaccataaaagacaagtcgnnngacggaggacgcgacgccgnnnnncggnnggttgtccggagggcgaggctgaagnagnacgacnggccggcgncgtggaaggaagaaacacgaggaggagggatgagggcgagctcgagggaagggggaatgatgccancnttgggggggggggttcgtgcggatacctggntggaaaagcagggctcgtcttcgaaaccatcggaaggggggtccggggccgaaanccccaccgaggtcgcctatggtacctaaagggaaaaaagggggttggaagggttcagctagaatttcaaaaa

SEQ ID NO: 26134 - protein, 97 aa, Zea mays
  misc_feature: Ceres CLONE 1398430-F
MPLIDAAASAVAPPPPRRVAQLRFFSTRRPGILSLTATSCSPSPPPPVAAEVPAPPQEAKSKPGHGGTRSSTPASRWALLRRCALSPCACVTPSAPP

SEQ ID NO: 26135 - DNA, 743 bp, Zea mays
  misc_feature: Ceres CLONE 1398431-F
  misc_feature: Encodes the peptide sequence at SEQ ID NO. 26136
  misc_feature (612)..(612): n is a, c, t, g, unknown, or other
  misc_feature (613)..(613): n is a, c, t, g, unknown, or other
  misc_feature (699)..(699): n is a, c, t, g, unknown, or other
aaagctggagctccccgcggtggcggccgctctagaactagtggatcccccgggctgcaggaattcgcacgagaccattacctagaacatcctaatcgaaaagtgtatcgcggaattttttgggttctcgggctccgccgcgatcccatccccatccccgccttgccgttgccgttgccggcccccccggttctcccggagctttctttctggccggcgcagtagagaagcaagacagaattgcggcggcgcctgcccgcgcaaaggaaataatcagcactgtttgccaaaggcagctcctgacgcatggctagtacttaaggatactttatgtgcagaccatgaagatagatgacgaaaggccttaccaaactcatatttttcatgatcttgcatctaacggcagtcctaaattagactgtgaggctgaaagacaaagtaatcacaaggttgaggcagataaaatggttgagcaaaccaatcaatctgaagttagctttgtgaaggctgagcatctgaatggaggtaaaattcggaagacacgcattgaggattactcctatgacaaggatggttgtagagatcaaactgccagacacagatctttcttcnntgatacggtgtccatttttgtcaggatgtctgcatttgatgaaggagttcctccagatcaaaagatttcatcagaaaagcagtagnaccagaggtgtctataaactttgattcctcgaatatacaaacgt

SEQ ID NO: 26136 - protein, 118 aa, Zea mays
  misc_feature: Ceres CLONE 1398431-F
  misc_feature (91)..(91): Xaa is any aa, unknown, or other
MKIDDERPYQTHIFHDLASNGSPKLDCEAERQSNHKVEADKMVEQTNQSEVSFVKAEHLNGGKIRKTRIEDYSYDKDGCRDQTARHRSFFXDTVSIFVRMSAFDEGVPPDQKISSEKQ

SEQ ID NO: 26137 - DNA, 608 bp, Zea mays
  misc_feature: Ceres CLONE 1398433-F
  misc_feature (273)..(273): n is a, c, t, g, unknown, or other
  misc_feature (281)..(281): n is a, c, t, g, unknown, or other
  misc_feature (349)..(349): n is a, c, t, g, unknown, or other
caaagctggagctccccgcggtggcggccgctctagaactagtggatcccccgggctgcaggaattcgcacgagaccattacctagaacatcctaatcaaaaaaccaaccaaccagtgctgtcctccgccgatccactgacctaccgcgagcgccaatggcgaccgccgcggtcctcgccgccacattagcgctgttcctcggcgccgccgccgcaacggccgcgacggctgcggcggaggcgggaccggatcggcaggctgccggggccagnccggcggnccaaacttcttccatgggaacctcccgggttaacgtcaaccggggggacccccggggggggggggggngggggggccccccccccctttacaaggggggggcaaaaaaagaaaaagggccgggggtccccccggaatccccccccctttttttgtgtatctgggggccccgggggtccccccttcttataaggggaaaaaaaaattttccctcttttttaaaacccggggggggggggggtttttttacccccccccgccaaaaaaaaagggagaaaaatttttttttttttttccccccccccggggggtttatatttttacaccc

SEQ ID NO: 26138 - DNA, 662 bp, Zea mays
  misc_feature: Ceres CLONE 1398434-F
  misc_feature: Encodes the peptide sequence at SEQ ID NO. 26139
  misc_feature (290)..(290): n is a, c, t, g, unknown, or other
  misc_feature (346)..(346): n is a, c, t, g, unknown, or other
  misc_feature (347)..(347): n is a, c, t, g, unknown, or other
  misc_feature (373)..(373): n is a, c, t, g, unknown, or other
  misc_feature (428)..(428): n is a, c, t, g, unknown, or other
cgcggtggcggccgctctagaactagtggatcccccgggctgcaggaattcgcacgagaccattacctagaacatcctaatcgaaaactggatttttcttcacaggtgcttatctcctccccggagctccctgctcctctcttccccagccgtgcccagctcctctgctcgccggccgcgagcccctgtccatggccgcgcgtcttcctccgtctccctgttgtcgtgccctggagttccctacgcgcttctctgctcggtgccctgcttgctcccgatgccgcactcgngtcgccatggcgtgcccaggctccagctccccctgcgcgtgctcgccggcgggagnnctctctggcgcgctcgcccatgccgncgcgcagccgagctcgccctgcgcaccccatctccccaggtgctcggccagctcngcccatggtcgcgccccttgacttcgccccagcgcccgaccggtcacttccatggcgcgcccaatcccctgcgtcctccccctgcatcgtgccctccatcctcccctgttgtcgcgcctggctcgcccccttgcgcgtggtgtcctcgccgcgcccgagcgctctggctcactggtgccgcaaccccagccggaacctccctggcttgccccctgcttccatgactggaccgcg

SEQ ID NO: 26139 - protein, 61 aa, Zea mays
  misc_feature: Ceres CLONE 1398434-F
MARPIPCVLPLHRALHPPLLSRLARPLARGVLAAPERSGSLVPQPQPEPPWLAPCFHDWTA

SEQ ID NO: 26140 - DNA, 698 bp, Zea mays
  misc_feature: Ceres CLONE 1398436-F
  misc_feature (205)..(205): n is a, c, t, g, unknown, or other
  misc_feature (208)..(208): n is a, c, t, g, unknown, or other
  misc_feature (211)..(211): n is a, c, t, g, unknown, or other
  misc_feature (214)..(214): n is a, c, t, g, unknown, or other
  misc_feature (698)..(698): n is a, c, t, g, unknown, or other
tacccgcggtggcggccgctctagaactagtggatcccccgggctgcaggaattcgcacgagaccattacctagaacatcctaatcgaaaacccttggccccttctccctttctctctctcctcctctcccccctgtcttcccccattccccactcccccacctctccagctccgtcgctagggctccatttccctgcacctcgncgncgncgncgcttaacatcagaagaccggattcggtggtgtttctcggctgcctcagcttcgccgccggagagcccccggggggggggttcgccccccgccctccggcctttggttggagccctctaaaacatgaaaagggttggtggctgaaaaaaaaagcgaaaccgcgggggccaattgggggctgtccccctgggaaacgggaaaaaaaatgggggggcaaacatgtggcctctctccgcggaagggcccccccggaacaaaaagaaaaatgccccaaggaactctcgccggggggcataaaaaataaggaaaaagttgtgggagccgttttttttatcaccccccaggggccccccttttgggatgcattccaaaacgggggggaacataacctaggggggcgaaaaaacaccggaaaagaaacaccccccctccctcccgcgccgcggggggaatttataacaagacccccccggagggggaaccn

SEQ ID NO: 26141 - DNA, 660 bp, Zea mays
  misc_feature: Ceres CLONE 1398438-F
  misc_feature: Encodes the peptide sequence at SEQ ID NO. 26142
  misc_feature (464)..(464): n is a, c, t, g, unknown, or other
gctctagaactagtggatcccccgggctgcaggaattcgcacgagaccattacctagaacatcctaatcgaaaaaacgcatttcgctccccacagcggctcggccacaacccacagccagacggtctcgagctggatctctaccgttcgtccgttccagcagacagcagtgcgcgctctctctctccctcgtggcgacgactgggcgaccgctgccgctgcccttgtgccccggtctccgtcggtccgttcgccaggtctcctgcgggctctttgtcgtcgacaagctccgccaggttgctgtgtgaagtccaaggttgtcacatggattcagcacaagatttccaacccaggacattctcgtataaagttgtggccaccaagtgaaagcacacggatcatgcttgttgacaggatgacaaacaatctgtctacagagtccattttctctcgcaaatatcgccnttttgggaaagcaagaggctcatgagaatgcaaaaacgattgaagaactttgctttgccttggctgatgagcatttcagagaggagcaaagggcgcatagggacagtcctgctgtccagctatatgcaaaggaacgggaagattgatggttgggaacccctggaaaaaagccccaggactactgcacaactggagc

SEQ ID NO: 26142 - protein, 29 aa, Zea mays
  misc_feature: Ceres CLONE 1398438-F
  misc_feature (22)..(22): Xaa is any aa, unknown, or other
MLVDRMTNNLSTESIFSRKYRXFGKARGS

SEQ ID NO: 26143 - DNA, 645 bp, Zea mays
  misc_feature: Ceres CLONE 1398441-F
  misc_feature: Encodes the peptide sequence at SEQ ID NO. 26144
  misc_feature (450)..(450): n is a, c, t, g, unknown, or other
  misc_feature (541)..(541): n is a, c, t, g, unknown, or other
  misc_feature (593)..(593): n is a, c, t, g, unknown, or other
tccccgcggtggcggccgctctagaactagtggatcccccgggctgcaggaattcgcacgagaccattacctagaacatcctaatcgaaaaaaattaacctgtcccagccgcaccgatccaccccccctcggcctcggcctccctccggccatggaggtgttctactacgtcgtgttcggcgcgctggccgccgtcgtggcggggctcgagctcggcaagagcggcaaggaccgcgtcgccaccacctccgcattcaactccttcaagaacaactacgtcctcgtctactccctcatgatgtccggggactggctgcagggcccctacgtctactacctctacagccagtatggcttcgacaagggcgacatcggccgcctcttcatcgccggcttcggatcctccatgctcttcggcaccatcgtcggctccctcgccgacaacagggncgcaagagggcctgcgtcacctattgcatcagctacatcctcagctgcatcacaagcactccccgaagtacaggtccctcatgatcggcgnaattcttcgggggatcgccacctcgctgctctctcccgcttcgagtcctggntcgtcgcgagcacacaaagagagtttggacccccaaagggctgtccataact

SEQ ID NO: 26144 - protein, 163 aa, Zea mays
  misc_feature: Ceres CLONE 1398441-F
  misc_feature (4)..(162): Pfam Name: DUF791 Pfam Description: Protein of unknown function (DUF791)
  misc_feature (100)..(100): Xaa is any aa, unknown, or other
  misc_feature (148)..(148): Xaa is any aa, unknown, or other
MEVFYYVVFGALAAVVAGLELGKSGKDRVATTSAFNSFKNNYVLVYSLMMSGDWLQGPYVYYLYSQYGFDKGDIGRLFIAGFGSSMLFGTIVGSLADNRXARGPASPIASATSSAASQALPEVQVPHDRRNSSGDRHLAALSRFESWXVASTQREFGPPKGCP

SEQ ID NO: 26145 - DNA, 679 bp, Zea mays
  misc_feature: Ceres CLONE 1398442-F
  misc_feature: Encodes the peptide sequence at SEQ ID NO. 26146
  misc_feature (322)..(322): n is a, c, t, g, unknown, or other
  misc_feature (323)..(323): n is a, c, t, g, unknown, or other
  misc_feature (357)..(357): n is a, c, t, g, unknown, or other
  misc_feature (403)..(403): n is a, c, t, g, unknown, or other
  misc_feature (440)..(440): n is a, c, t, g, unknown, or other
tccccgcggtggcggccgctctagaactagtggatcccccgggctgcaggaattcgcacgagaccattacctagaacatcctaatcgaaaaacccctaccattgcctagctcaccagatcgatcttaccatggctttcctcaccatcctcctcctcgcgcgcatttccagctccattgccatctcgtccaactacatctcaaggagcgccgagcagcaggtcatcgccaccgtcgcgccggccattgttcctgacatcgacggccagggcgcgcagccgttcctcacctcgccctccggatcgtacgccgcgtacctccgcnncgcgccgtggacggcgccggcggcctcggcgggngacgcgtgcttatgtccaagtcccagcaagatgtcgccagcggagncggtaatggggagtcggactgccacccccggtggggntggcgcctgacgcgtgcggacctggcgttccttcgccgggtgggcctcgagctcttcgcccggagggcagtcgctgtgggaaaacgggggtcgacgccgatccgggaacgctgagccttgacgacggcggcgacatgaagatgttagcaaggaaagtgtggacggtgtggacggcaagcagcgaccatggacgggcagcagtgcgggctccccttgcggtggcacgaccggccttcaag

SEQ ID NO: 26146 - protein, 106 aa, Zea mays
  misc_feature: Ceres CLONE 1398442-F
  misc_feature (65)..(65): Xaa is any aa, unknown, or other
  misc_feature (92)..(92): Xaa is any aa, unknown, or other
  misc_feature (104)..(104): Xaa is any aa, unknown, or other
MAFLTILLLARISSSIAISSNYISRSAEQQVIATVAPAIVPDIDGQGAQPFLTSPSGSYAAYLRXAPWTAPAASAGDACLCPSPSKMSPAEXVMGSRTATPGGXGA

SEQ ID NO: 26147 - DNA, 794 bp, Zea mays
  misc_feature: Ceres CLONE 1398448-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
nnnnnnnnnnnnnncccccccccctcccccccgccccccctcccccccgaaagatggggctccccgcggtggcggccgctctagaactagtggatcccccgggctgcaggaattcgcacgagaccattacctagaacatcctaatcgaaaaaaaacgccccacagcgcaagcgagcagatcctcctccctttctgcttcctggcatcctctctgcctccccgcgccgatctcgagcacctggggagaccgcgagacgtgcgcctgatttttctcatcgcagcagccctcaagttccccacctcttttttcttgcagctttcaattaatctggttatttagctacatctttattttactttcattttacctttaatctgtttagttccattgcatcttctgcggttgcggtaagtattgctggttcctgctccttggttcttgggtcttttgcttcaaaccatgggacgcaggaacctaactccatctcatccaagaaagagccccacggggggaagcagggggggcccccttcttcaggaagggcggggaccccggccccaaatgggccggccctgagaaaaaggaattggcacacccctggggccaaggggttaaccggcacgagaggtcctccccgcgccaaggtctgcggtagtggacatggaaaaagggggcgcaaaaatgggggcccggggggccgtcaaagcgcaacaatgaaaaaaagccccgccccaggagaccacgccccgaggcgggggaagcggcgggccgccgtcgccgcgcgcagaaaaac

SEQ ID NO: 26148 - DNA, 750 bp, Zea mays
  misc_feature: Ceres CLONE 1398451-F
  misc_feature (318)..(318): n is a, c, t, g, unknown, or other
  misc_feature (324)..(324): n is a, c, t, g, unknown, or other
  misc_feature (423)..(423): n is a, c, t, g, unknown, or other
  misc_feature (449)..(449): n is a, c, t, g, unknown, or other
  misc_feature (525)..(525): n is a, c, t, g, unknown, or other
  misc_feature (544)..(544): n is a, c, t, g, unknown, or other
  misc_feature (545)..(545): n is a, c, t, g, unknown, or other
  misc_feature (557)..(557): n is a, c, t, g, unknown, or other
aaaagctggagctccccgcggtggcggccgctctagaactagtggatcccccgggctgcaggaattcgcacgagaccattacctagaacatcctaatcgaaaagacgaagcaaggaacgcaccccgaatcccaactcctgtgtccgccatcgcctcgtggcggtcgctcctgctcctgctgctgctgctgctcccccagccgctcccgcccggagcacgccgccggcgccgacgccggcgcgtcgcatggatatggcccccgcgtctgtctacttcaatccgcgctcggtcgaggaaatcttcaaggacttctccggnccgccngcgcggggctcgtccgcgccctcacctccaatggtggacgattttctgcagcttgtgcgacccagataaggaagaatttgtgtctctacggccttcccnacgggagctttgggaggtgtcgccgnccggcggaaggaggtcccttccggaagttgccgaagccggggctcggcatcaacctttgcgcgcgacggcttgcancggccgcgactgggtcaannttcggtcgccgncactttgtgattcgtggttcaacctccgtcgcaattttttctaacgtgcccgcctcaccggcaacgaccgggaaacggtttgttcaaaaaggataaaggaacttcctttcccccttaaaaaaattcccgaacagaaacaggcaaaaaaaaggctctggggttttaaaaacaacgcaaaatccaaaactctcaa

SEQ ID NO: 26149 - DNA, 697 bp, Zea mays
  misc_feature: Ceres CLONE 1398452-F
  misc_feature (181)..(181): n is a, c, t, g, unknown, or other
  misc_feature (184)..(184): n is a, c, t, g, unknown, or other
  misc_feature (196)..(196): n is a, c, t, g, unknown, or other
  misc_feature (197)..(197): n is a, c, t, g, unknown, or other
  misc_feature (229)..(229): n is a, c, t, g, unknown, or other
  misc_feature (230)..(230): n is a, c, t, g, unknown, or other
  misc_feature (244)..(244): n is a, c, t, g, unknown, or other
  misc_feature (246)..(246): n is a, c, t, g, unknown, or other
tggagctccccgcggtggcggccgctctagaactagtggatcccccgggctgcaggaattcgcacgagaccattacctagaacatcctaatcgaaatttttctgctgcccagccgccgtccgtccgcgcttcactatccttcattttcctccctgtcagcgacgactgggtaggctaccgncgncgccctacgctnnagtgccatctcttcggcggcgaagagcgccanncaagctccggcaangnccgtgattgccgcttgtaagcaactttgaaccccgggaataggaaatctttatggggaaggactaaaaagaaagggccttccggccaagggcccgggaaaaaaaaccttcaaaccgcgaaatgggaaaatttccagtgggaagaaataaaaagggaacggcctccgccaaaaaggggggggcgcccccccccccccccaaggaagtttttaacccccgggggggggaaaactctcgggggggggggaaataaaggaggcgcaaagtgggtttatgtgggggttaaacccccctttttcctttgggggccatggtgggggggggggggggggaggcccatccctttgcccgggtggggggggaaaaaaaacacaaccggggggggcccaatttgggaggggaaaaaaggggatggccccccaccggggggggggggcccacgggcgcggggg

SEQ ID NO: 26150 - DNA, 658 bp, Zea mays
  misc_feature: Ceres CLONE 1398453-F
  misc_feature: Encodes the peptide sequence at SEQ ID NO. 26151
  misc_feature (554)..(554): n is a, c, t, g, unknown, or other
  misc_feature (561)..(561): n is a, c, t, g, unknown, or other
  misc_feature (562)..(562): n is a, c, t, g, unknown, or other
tccccgcggtggcggccgctctagaactagtggatcccccgggctgcaggaattcgcacgagaccattacctagaacatcctaatcaaaaaccaaaccagcgaggcagctaccgttttgtcgccatagcactcccgccgaccccctcgccgccgcctggaatggagaccagcaccaagaagcttagcagccttcgtatcacctccctggacgacgatgacgacgagaccgagatcccgcaccagccccctcaagcaggcctctccaccgctgaagcggattatgaggacgacgacgatgaggaggaagaagccgaagtgactcttggtgtccttagcaaaccgaagcacccaggcctcctcctccgccacttgttccccagcaaggccggtggcatcccggcgtggctagacccggtgaacttgccgtcgggaaagccagctactgtggtttctgtgggaggcctctgcagtcgtccctccaggtgtttttctttgtgtgcaatgaagttgccacactcgacggccttattgtttggatatcgacttgtcacgntaagggnntggggtggggggtttaaaatttatgcaccaaattgaagattaatgtagcaggctttaacccgaagggtggtttcaagggtcatgtggcccattccg

SEQ ID NO: 26151 - protein, 145 aa, Zea mays
  misc_feature: Ceres CLONE 1398453-F
  misc_feature (132)..(132): Xaa is any aa, unknown, or other
  misc_feature (134)..(134): Xaa is any aa, unknown, or other
METSTKKLSSLRITSLDDDDDETEIPHQPPQAGLSTAEADYEDDDDEEEEAEVTLGVLSKPKHPGLLLRHLFPSKAGGIPAWLDPVNLPSGKPATVVSVGGLCSRPSRCFSLCAMKLPHSTALLFGYRLVTXRXWGGGFKIYAPN

SEQ ID NO: 26152 - DNA, 743 bp, Zea mays
  misc_feature: Ceres CLONE 1398455-F
  misc_feature: Encodes the peptide sequence at SEQ ID NO. 26153
caaagctggagctccccgcggtggcggccgctctagaactagtggatcccccgggctgcaggaattcgcacgagaccattacctagaacatcctaatcgaaaagtacgagactgcgccgccgttgccgtctcctcctccgacccatcactctctgctcgcgcactctcacctgcccgcgccgtcttcgaccgccaccaagatgaacaaggagaggctcatgaagatggccggcgccgtccgcaccggcggcaagggcaccatgcgcaggaagaagaaggctgtacacaagacggtcaccacggacgacaagaggctgcagggcactctcaagagagtaggggtcaacaccatccctgcaatcgaggaggtgaacatattcaaggacgatctcgtcatccagttcttgaaccccaaagtgcaagcttccatcgcggcaaacacatgggtggtcagtggatctccacagacgaaaaagctacaggatgttctccctggtatcattaaccagcttggccctgacaacatggagcacctgaaagaggattgccgaggagatgcaaaagcaggtggctgctgccggtgcggcagcacaggtcaaggaaacaacgatgacgatgttccagagcttgttcctggagagacttttgaagaagtagctcaggagacaaaagctgatcatagctctaaaatagtgaatgttactgcacaatgtgggaaggcccagtggtttttcgggtgatgc

SEQ ID NO: 26153 - protein, 179 aa, Zea mays
  misc_feature: Ceres CLONE 1398455-F
  misc_feature (34)..(92): Pfam Name: NAC Pfam Description: NAC domain
MNKERLMKMAGAVRTGGKGTMRRKKKAVHKTVTTDDKRLQGTLKRVGVNTIPAIEEVNIFKDDLVIQFLNPKVQASIAANTWVVSGSPQTKKLQDVLPGIINQLGPDNMEHLKEDCRGDAKAGGCCRCGSTGQGNNDDDVPELVPGETFEEVAQETKADHSSKIVNVTAQCGKAQWFFG

SEQ ID NO: 26154 - DNA, 711 bp, Zea mays
  misc_feature: Ceres CLONE 1398456-F
  misc_feature (370)..(370): n is a, c, t, g, unknown, or other
  misc_feature (398)..(398): n is a, c, t, g, unknown, or other
  misc_feature (399)..(399): n is a, c, t, g, unknown, or other
  misc_feature (428)..(428): n is a, c, t, g, unknown, or other
  misc_feature (481)..(481): n is a, c, t, g, unknown, or other
  misc_feature (576)..(576): n is a, c, t, g, unknown, or other
  misc_feature (588)..(588): n is a, c, t, g, unknown, or other
  misc_feature (589)..(589): n is a, c, t, g, unknown, or other
  misc_feature (605)..(605): n is a, c, t, g, unknown, or other
  misc_feature (613)..(613): n is a, c, t, g, unknown, or other
  misc_feature (656)..(656): n is a, c, t, g, unknown, or other
  misc_feature (665)..(665): n is a, c, t, g, unknown, or other
  misc_feature (701)..(701): n is a, c, t, g, unknown, or other
  misc_feature (711)..(711): n is a, c, t, g, unknown, or other
aaaagctggagctccccgcggtggcggccgctctagaactagtggatcccccgggctgcaggaattcgcacgagaccattacctagaacatcctaatcaaaaagagggggaggcagagagcttgccatcccaagcaaaggttccctctccttccccacctcgcgctcaacccccctcatcctcccacatccgattgtgccctgcgctctgccgttctcttatccaagatttcgccggcggcggctcagggagcggacaaagattgtttttttttcgggctatggagacgaggcctgattcattcagccccgggcggtggagtggcttcctgaccgggtctgattcgtattggttcaaatgatctgggcgncttaattggttgcatccgcttccaccgnngaatcggagctagggctgtggtttgttgnccggctggtggattcgtcggcttgggtctggtgagatcttgaggggttctggntcagcacacggggcgcaggtctgcgtagatcccctctttcgatccgtggcggatttgtttaaggttttggtttgagtctggtggaagatgataangcagatccttgnncagctgcccgagaagnccgggaangctggggatagcaggaaagctgctgctgcgggaatggaactgnaccgcgaanttctaacggtgtggtgaggggcatggaccagggaancagaggctgn

SEQ ID NO: 26155 - DNA, 757 bp, Zea mays
  misc_feature: Ceres CLONE 1398458-F
  misc_feature: Encodes the peptide sequence at SEQ ID NO. 26156
  misc_feature (263)..(263): n is a, c, t, g, unknown, or other
  misc_feature (371)..(371): n is a, c, t, g, unknown, or other
  misc_feature (474)..(474): n is a, c, t, g, unknown, or other
  misc_feature (635)..(635): n is a, c, t, g, unknown, or other
  misc_feature (715)..(715): n is a, c, t, g, unknown, or other
caaagctggagctccccgcggtggcggccgctctagaactagtggatcccccgggctgcaggaattcgcacgagaccattacctagatcatcctaatcgaaaaaaaaaaaaccgtaatagcaaaaacgactccacacggtccacggcgtcttctccggcgaaccttcgcgagccctcggctcccctctaccaccgctgccgcgaccccgcctccagagcatcctcgggtagcgctctggcttcccgtgccgccggacgtcctngcaggaggcggcggcctccgtggcatggttgatgagggccgccgctgccctccctcgccgatcgtcgcggccctcgggagccggggtcctcctcctcccgggctcccngcccctggggcctcctccagccgggctcctggcccctggggcctccttcaccccccttcgatgtcgataccgacccgccatcacggcctgagctgacgcccgnagcagaatcgggcttttgcgtcgacgcgctcgcgcatttcgagtacaaggggaagcgccgggatgacttgtccgacgagttcagaagcctctcggtatcggatattagacatatgaaaacgatcagtgtagctcattatcctgttaatagagagagaacgnaatatattgatgtcttaccatttgacgataccagagtacagctaaaatcctcagcacggcctccaacaacgattacatcnatgcaagctttataaagctactgagaacacagagttgcaact

SEQ ID NO: 26156 - protein, 47 aa, Zea mays
  misc_feature: Ceres CLONE 1398458-F
  misc_feature (17)..(17): Xaa is any aa, unknown, or other
MKTISVAHYPVNRERTXYIDVLPFDDTRVQLKSSARPPTTITSMQAL

SEQ ID NO: 26157 - DNA, 654 bp, Zea mays
  misc_feature: Ceres CLONE 1398459-F
  misc_feature (335)..(335): n is a, c, t, g, unknown, or other
  misc_feature (497)..(497): n is a, c, t, g, unknown, or other
  misc_feature (505)..(505): n is a, c, t, g, unknown, or other
  misc_feature (515)..(515): n is a, c, t, g, unknown, or other
gctctagaactagtggatcccccgggctgcaggaattcgcacgagaccattacctagaacatcctaatcgaaaaagaaaatacgcacctgctcctcactcttctttatatttttttctccatttggcaacttttgcttgtcgttcatgtatatgcatgaccctttcacacatatgatcagaagataagcacatgcaagacgatctcgcgtggatatgatgcatggatcagacctaacctctatatcatcaccaaacgctcgtagatgatgctatacaattccatgattaaattatatataagtaaaaaaaaaagaaccgtacgtgcatacataanattaagaattaatggctgccaatggacgacatatgcatggacaggtaagctggtgatcccactgaaccgggaggcgcccaacttccggtccatgatcgggatgatcgacgggaggacggagctgaagccgctgccagccagcggggggccagaagaccgcgnctggcagntggtggccgncctcggccgcccgccggatcccggggggggatgactacctactttggaacggggagagcgcaaagggccggggggggccgctgggtgcaaacaaaaaaaacggtgaaagggggggggctcgtcccgcccccgacccctg

SEQ ID NO: 26158 - DNA, 646 bp, Zea mays
  misc_feature: Ceres CLONE 1398460-F
  misc_feature: Encodes the peptide sequence at SEQ ID NO. 26159
  misc_feature (254)..(254): n is a, c, t, g, unknown, or other
  misc_feature (342)..(342): n is a, c, t, g, unknown, or other
  misc_feature (345)..(345): n is a, c, t, g, unknown, or other
  misc_feature (346)..(346): n is a, c, t, g, unknown, or other
  misc_feature (371)..(371): n is a, c, t, g, unknown, or other
  misc_feature (415)..(415): n is a, c, t, g, unknown, or other
caaagctggagctccccgcggtggcggccgctctagaacttgtggatcccccgggctgcaggaattcgcacgagaccattacctaagaacatcctaatcgaaaaatggagaagcttccttcagtgagtcctccctttccgtttaaggcagcaagcaggagcagacaggaggcgccgagaagccagcgtcggagatctccgccgccatggagacgctggccagcgccatgcggcgcgagaaccgccggtcaaggncccgccctcctcctctggttcctccgccctcggctcgggcagggtcctctcgtcatggccttcctctcttggctcgcctggtcttacntcnnccggccgtttgtggcaggacgcganaacccgggggaatctggtcggcctcctcaagagagctctacagnggtcccgaggggttttccgggggaggaaaagtttagaaccttggtggcagggttttggaaaaaaaatttttgggggggaaagggccttaccaggcaaaaacgggggtaaccttgggggggaaagattttttccttttggcacccaaaaaaaaacacgtcttttgcgcccttttgattataaacagggggggtgggcccccctttcaaaggaaaagtttttcggggtccggt

SEQ ID NO: 26159 - protein, 81 aa, Zea mays
  misc_feature: Ceres CLONE 1398460-F
  misc_feature (17)..(17): Xaa is any aa, unknown, or other
  misc_feature (46)..(46): Xaa is any aa, unknown, or other
  misc_feature (47)..(47): Xaa is any aa, unknown, or other
  misc_feature (56)..(56): Xaa is any aa, unknown, or other
  misc_feature (70)..(70): Xaa is any aa, unknown, or other
METLASAMRRENRRSRXRPPPLVPPPSARAGSSRHGLPLLARLVLXXPAVCGRTRXPGGIWSASSRELYXGPEGFSGGGKV

SEQ ID NO: 26160 - DNA, 681 bp, Zea mays
  misc_feature: Ceres CLONE 1398461-F
  misc_feature: Encodes the peptide sequence at SEQ ID NO. 26161
  misc_feature (345)..(345): n is a, c, t, g, unknown, or other
  misc_feature (360)..(360): n is a, c, t, g, unknown, or other
tccccgcggtggcggccgctctagaactagtggatcccccgggctgcaggaattcgcacgagaccattacctagaacatcctaatcgaaaaaaccccaccagaccttcaaccgctacatttccgtcactaccggagccgccactccgacgaacgcgggcggcggagcggaagcgaaccagagcaccggtaaaaagaaaaggatgaggcttgggagtataaacggcttgcggttcacgcagcttaaacttgtcatccttgcgttcttcatggtgtttgttctctggaaatgggagaagggctcgtcatactacgattccgaaatcctccagcagaatccggtgggntctgactcatccgcntaacttcggaggttggtagaccagcatacatcccccaggaagaagactttccaaggtgcagatcgatcacacccggtcaggtaggtaaaagagaaaaaagccggttactaattgcgctggccaccattgtctacgaagggctattctctggttgagggtgcaaaggggggaaaggaatgggccacctccttgaaagaaaggaaatggaggtacaggaatgggggggaaaagggggtttttccggaaaaacggggaacctattaattccgcggggggtttgtggggtaaaaaaacaggggttttcttaaaaaagaggtgtcc

SEQ ID NO: 26161 - protein, 53 aa, Zea mays
  misc_feature: Ceres CLONE 1398461-F
MRLGSINGLRFTQLKLVILAFFMVFVLWKWEKGSSYYDSEILQQNPVGSDSSA

SEQ ID NO: 26162 - DNA, 712 bp, Zea mays
  misc_feature: Ceres CLONE 1398463-R
  misc_feature (476)..(476): n is a, c, t, g, unknown, or other
  misc_feature (482)..(482): n is a, c, t, g, unknown, or other
  misc_feature (483)..(483): n is a, c, t, g, unknown, or other
tcgattgggtaccgggccccccctcgaggtcgacggtatcgataagcttttttttttttttttttcactgaagttctctctacctcctaattcggaagagagaatgcatgcggcatttttgacacgctacacgacagtacttactgtccatattaacatttcaagattatctactcttgaaatgtcaccatattgattagcatatgtacgaggtacacactagagcaagagatcatcccagatcaacgctatactgttcctagtgctctgctcaaagtccaccgtggcctaagcctagatgattaccgccttttgctcctcctccttgtcgtcgacgtcgtccaccgcggcgtcggcggccaccacccggttttgcccctcgtcgccgtatgcccagccacacactgcgaagtacagcacgttggcggcgcatagcaccgccagtaccaagtagtagtagtcgtagtgccccctgntcaggnntgctcgcagccagccgtcgtggctgccgccgctccgggtccccgcgtcgatgaccccaacaatgcgctgccaaaaacggcgccaaatcgaagcccaacgccaagcaggacccccctatgctggaaatggtcttgggggactccgaaaaaaaaaaatcaatttgccccaatcagttcagggccttcgaaaccccctgaaggaagtgcttcggccccaaattaagggccaa

SEQ ID NO: 26163 - DNA, 676 bp, Zea mays
  misc_feature: Ceres CLONE 1398464-F
  misc_feature: Encodes the peptide sequence at SEQ ID NO. 26164
  misc_feature (413)..(413): n is a, c, t, g, unknown, or other
tggcggccgctctagaactagtggatcccccgggctgcaggaattcgcacgagaccattacctagaacatcctaatcgaaaaatgaaatgaaaccctagtgagtagtgaccctgtccggatcactgcgtggcgccgccatggcaccctccgctctggcctccctcccggcgccgctccggtcactgcggctcaagacgaagcagcaggagctactgctccgcgtctcggcgctggcgctcatctacgttctcgccttcgccgtccgcctcttctccgtcctccgctacgagtcatggatccacgagttcgacccctacttcaattaccgcaccacgctcttcctcaccgagaacggtttttagcgagttcttggaaactggttcgaattccgagagctggtacccgctcgggncgcggtcgtccggggggactcctcttcccggggtctcaatggtgaccggccgcgctgctcgcgctcctccgcgcgttctcccctggctgccaaaaatccgcgaagggtcagcgtcctcacccgggccttatcttcgacgccaacacccagtcttcgtcggctaaagcctaggggccgagacaattgggaaagcccggggggggacgggccgacaaccacgccggccaatcgcaccgacccgggggagaactgtgggggggaga

SEQ ID NO: 26164 - protein, 74 aa, Zea mays
  misc_feature: Ceres CLONE 1398464-F
  misc_feature: SWISSPROT Homolog: EC 2.4.1.119 Dolichyl-diphosphooligosaccharide--protein glycotransferase
MAPSALASLPAPLRSLRLKTKQQELLLRVSALALIYVLAFAVRLFSVLRYESWIHEFDPYFNYRTTLFLTENGF

SEQ ID NO: 26165 - DNA, 674 bp, Zea mays
  misc_feature: Ceres CLONE 1398467-F
  misc_feature: Encodes the peptide sequence at SEQ ID NO. 26166
  misc_feature (409)..(409): n is a, c, t, g, unknown, or other
  misc_feature (451)..(451): n is a, c, t, g, unknown, or other
  misc_feature (468)..(468): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
cgcggtggcggccgctctagaactagtggatcccccgggctgcaggaattcgcacgagaccattacctagaacatcctaatcgaaaaaacgcatttcgctccccacagcggctcggccacaacccacagccagacggtctcgagctggatctctaccgttcgtccgttccagcagacagcagtgcgcgctctctctctccctcgtggcgacgactgggcgaccgctgccgctgcccttgtgccccggtctccgtcggtccgttcgccaggtctcctgcgggctctttgtcgtcgacaagctccgccaggttgctgtgtgaagtccaaggttgtcacatggattcagcacaagatttccaacccaggacattctctataaagttgtggccaccaagtgaaagcacacggnatcatgcttggttgacaggatgacaaacaatctggtctacangagtccattttctctcngcaaatatcgcccttttgggaaagcaagaggctcatgagaatgcaaaaacgattgaggaactttgctttgccttggctgatgagcatttcagaaggagcagagggnnnatagggaaattcctgctgtccagctatatgcaaaggaacgaagcagatgggttgtgtggaagttctgaaaaaaggcccagggactactggagaactgg

SEQ ID NO: 26166 - protein, 31 aa, Zea mays
  misc_feature: Ceres CLONE 1398467-F
  misc_feature (25)..(25): Xaa is any aa, unknown, or other
MDSAQDFQPRTFSIKLWPPSESTRXHAWLTG

SEQ ID NO: 26167 - DNA, 631 bp, Zea mays
  misc_feature: Ceres CLONE 1398468-R
tgggtccgggccccccctcgaggtcgacggtatcgataagcttttttttttttttttttgtaactgaaataaaaatagctacataattgcttaaatagttatacaactcgtatcacaaacagaaacaaagatgggcataacgtataagtgacacttttcctgtataaagcttggactatgtcccggctaatgcttgatagcctttgaacattatcctgacccattgatcactacactctacttgcactatattaatctccaaatccttatgtggcgggcgcatccacttcatgatctatggagcaacattatatcctgcctttatccgaatctctggctatattgaatcatcattgcaatcctaatatgtcctgtacaatgtaccacacacatataccaaaaaagttaccgatatggtagagactatataaacacaacgtcttcacaatattcatctcgagaacagatttgtttaagattgcagcctctaacggttataataaacagctaccaatatatcatatgccaatcgaagtcattatcttatagaacgaccacattacgaacaataatattgctatacgccacgcacataacttcgaatgatttaaaagctaaagatgcacgcatg

SEQ ID NO: 26168 - DNA, 686 bp, Zea mays
  misc_feature: Ceres CLONE 1398469-F
  misc_feature: Translation starting site: 221
  misc_feature (436)..(436): n is a, c, t, g, unknown, or other
  misc_feature (448)..(448): n is a, c, t, g, unknown, or other
  misc_feature (568)..(568): n is a, c, t, g, unknown, or other
aagctggagctccccgcggtggcggccgctctagaactagtggatcccccgggctgcaggaattcgcacgagaccattacctagaacatcctaatcgaaaaatttccacaagacccttgcgtgctctctctctctcctcttggcgacgactgggtggcaggtgcccaggtcttcttgggacccttccggcgacaagcaccaccagcttgcaggtttcaagatggaagtggtaaaaactacacatgctgggcatgcaaaatctcttgtatcaactattgattttagtacctgtcctgatggtattgtatgtgtgggtgggtgatggggattgtaaatgaggtcctcaatggtcttctatgcagagatgatcaaaatatgtctgcctctgtaccaataggtataatacctggctgggtctgataactcacttatttgngacagtcttggngtgtcaaggatccaatttctgcagcattgtcaattgttcaggggaggtctacaccctatttgatggtttttttctgttgaatgggattcaaagtgggactaatgcattatggtacacgantcactaaatttttgggtttggggtaagcggatgttcttgagcttctcagagaagtatcagaaaggcattttgggtcctttacgatacctttgggaagctgggttttctcaaaattccc

SEQ ID NO: 26169 - DNA, 829 bp, Zea mays
  misc_feature: Ceres CLONE 1398471-F
  misc_feature (1)..(1): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
nttttnnnttttcctccccccatttttccccccccctcccctcccccctcccttgcggtagttccccgaggtggcggccgctctagaactagtggatcccccgggctgcaggaattcgcacgagaccattacctagaacatcctaatcgaaaaagtaccgcaccaccaccaagcaccgcaaccggagccggagccagaggtagggcgagaggccgagggtataggagcgaaggaggccgccgaccgaccgtgcgtccggccccgcggcggcgtcagcaggtcgtatacggcagacgaggagcaccagcagcacgaggcggtcgggcccggtccacgatcatgccgcagaaagaggagcaggccgccgcgctctgcgaataggaggtgatcgccgagttccagtccctcacgtgataccactcgccgccgttgcagtgtgacatgcctgcgtccgtgatcttgggcctacgacgcgctggtgcctatgcacaccaccatgtctgacttcctccccctaccttccccttatctgtctgtcctgcattgtttctcgcctgctgttatagagtcattgacacacccaccaccccgtggtatctttaacgtttctatttttcaaccaccgtaacccaaaatagaaattacaattacactccaaattgtgctatctcgagcacatattttaccctacccccaacacccccatcccccaaccacactagttaacacattcccgcaataatggtgcggcgcgtgccaatggcgggatccgaagggtagccaggtacaaacatgctctcttctttttctctggctcccgctttactgg

SEQ ID NO: 26170 - DNA, 666 bp, Zea mays
  misc_feature: Ceres CLONE 1398473-F
  misc_feature: Encodes the peptide sequence at SEQ ID NO. 26171
gctctagaactagtggatcccccgggctgcaggaattcgcacgagaccattacctgaacatcctaatcgaaaaacgaaatggttttgccttcgcttttgcttatgcgtacgcgcggcgaatcacggcgcccaccttccaaccggacttgagtcacttgactccgccgcgggattccccgccagatctcattctcgccccaaccctaaccgccgacggtggccatgatggccaccgagcccttgtccccggggaatctcgtcgaggacgtcgaaacactacccctggactcctcctccactctcgcggctacgacggacccgctgctccgcccacctcccccctcgtccaccttctctccgcaccgccggtgagaaccgtggcgcttttctggacgaggagggatgaggacgtgggtgaatgacttcacgcctccgctggctccccatgtcgctacggcggggacgaagtcccgcgagcggccaccggggttgcgttgaaagcattggtacccgagcctagggaatgcacgcgcagcccgcgaacggtgagcggggtgttgttctcccccggctcggtggagatacgtttccgtactctacgattcttgaggtggaccgaagggagtgcacattccacctcgaagccgacgccatcgtgggcgtcca

SEQ ID NO: 26171 - protein, 49 aa, Zea mays
  misc_feature: Ceres CLONE 1398473-F
MMATEPLSPGNLVEDVETLPLDSSSTLAATTDPLLRPPPPSSTFSPHRR

SEQ ID NO: 26172 - DNA, 591 bp, Zea mays
  misc_feature: Ceres CLONE 1398479-F
  misc_feature: SWISSPROT Homolog: EC 1.11.1.6 Catalase
  misc_feature (100)..(100): n is a, c, t, g, unknown, or other
aagctggagctccccgcggtggcggccgctctagaactagtggatcccccgggctgcaggaattcgcacgagaccattacctagaacatcctaatcgaanaatgtaaaccacactccactccagcactgaacacttgattgattcagtgggtagctagctagctgaatcacaatggatcctaccaagttccgtcccgtcagtagccacgacccgacggtgacgacgaccaaagctgggccctcctgttgggaacgaaaaccaagcccttaacttggggggcctcccggccccattcccggtgagggaacccccctgaatcaaaaagggggccattttccggggggaaacatctcccgaaagggggggggaaacccccgggggccccccccaaagggttttttttagggaccccccaaaaggagaatttttgaaggggggaaatttttttggggccccgcggggggggacccccccataaagggcctttcttaaagaggaacacaaaggggggttcccccaaaagaatacccccccccccggggggtttccccgaaaaattttccccccccgggagaaaattttattctttc

SEQ ID NO: 26173 - DNA, 638 bp, Zea mays
  misc_feature: Ceres CLONE 1398480-F
ggagctccccgcggtggcggccgctctagaactagtggatcccccgggctgcaggaattcgcacgagaccattacctagaacatcctaatcgaaaaattatccccagctttttctccaagcgtccgttcaggaagctgtccggcaacgagccgctcggcactgggcggtggccgtgcaagagcgatcgggaccgcatcgctcgtctgctcctccaggctccgcctccctcatcatcactgcagcggcgagaaaacaagggacggtccggcgggggtctccactgacatcgcctaccatggctaccatgctgcgccggggcatgggggatctgggcccgttggggtcctccgggaggtccccaaaacgaattttggggaaaaggcaaatttttctaaaaggggaaaaaaatccaccaaggggtttccccaaaggcctcaacagaaaggtggcccccggcccctaggaacacctctttcccacgggaaaaaaaaggtttaaaaattggtccttggaaacttttgggggggggggacaaaattattggggccaccccccccggggtataaaaaaaccccccatataagagaaaaaaattttgccttttaattttaaaaaaaaaaaaaatctccaaaaaggt

SEQ ID NO: 26174 - DNA, 693 bp, Zea mays
  misc_feature: Ceres CLONE 1398482-F
  misc_feature: Encodes the peptide sequence at SEQ ID NO. 26175
  misc_feature (378)..(378): n is a, c, t, g, unknown, or other
  misc_feature (643)..(643): n is a, c, t, g, unknown, or other
atagctggagctccccgcggtggcggccgctctagaactagtggatcccccgggctgcaggaattcgcacgagaccattacctagaacatcctaatcgaaaactcttcgtcgtcctatcttataatcgcatttcgaaatccccaaacggaggcctcgccactcttccgaacctgaacaatcaccaccgttattaagaagatgatgcgctgcgctgcaacgggcggcgggtgcgtcgcttcgtggagcggcgattggagattgccggcggtcaacccctgcagcgtgcggatgccgacgggcaacgatgggtggtgcgccggcctgaggtcgcgggcggtggatctcgccggcctcaagatggccaacctgcgcggcgncgtcgggggggctctttccgcggcgagcccgcgctacggggcgtttgcaagccacggcggtcagttgaaccctgaaaatatcccattggagaaaggttcaaggtaaaatcctccgcgacatgttcttgccataatgttggcgtttgtttggtttggcggctaatttctgttgggttaccctcttggggggtggccaaagggggccctttaaaatatcccccgaaagaactttgggaattgctaaaaaatggcttccttgcaaggngggggggggttaagcacactccttgggggggggcaaaaaccaaagttctt

SEQ ID NO: 26175 - protein, 94 aa, Zea mays
  misc_feature: Ceres CLONE 1398482-F
  misc_feature (60)..(60): Xaa is any aa, unknown, or other
MMRCAATGGGCVASWSGDWRLPAVNPCSVRMPTGNDGWCAGLRSRAVDLAGLKMANLRGXVGGALSAASPRYGAFASHGGQLNPENIPLEKGSR

SEQ ID NO: 26176 - DNA, 671 bp, Zea mays
  misc_feature: Ceres CLONE 1398484-F
  misc_feature: Encodes the peptide sequence at SEQ ID NO. 26177
tggagctccccgcggtggcggccgctctagaactagtggatcccccgggctgcaggaattcgcacgagaccattacctagaacatcctaaaaaaaaaaataggacaagccccagcagtttgccactcccacgcgaaacagaagccccagcagggcggcactcccgacgcgacgcccctgcttgccggccgggaggctcactcgactctgcctccacttcctcgtctgtccgttggagcacggcgccgatggcggcggcgccagcgctcgcgcgggagctgctggacgcggcgcgggagccggagttcgcggagtggcagcgcggcgtgcggcgccggatccaccagcacccggagctggccttccaggagcaccgcaccagcgcgctcgtgcgcgccgagctcgacgcgatcggcgtcccgtacgcctggcccgtcgcgcagacgggcgtcgtggccaccatcaccggccccgccgcgggccccgtgttcgcgctccgcgccgacatggacgcgctccccatccaggaaatggtagaatgggagttcaagagcaaggaagacgggaagatgcatgcgtgcggccatgacgcccacgtggcgatgcttcttggagcagctaggttgcttcagtctcggagggacgatttaaggtactgaatagtttttttgg

SEQ ID NO: 26177 - protein, 136 aa, Zea mays
  misc_feature: Ceres CLONE 1398484-F
  misc_feature: SWISSPROT Homolog: EC 3.5.1.14 Aminoacylase
MAAAPALARELLDAAREPEFAEWQRGVRRRIHQHPELAFQEHRTSALVRAELDAIGVPYAWPVAQTGVVATITGPAAGPVFALRADMDALPIQEMVEWEFKSKEDGKMHACGHDAHVAMLLGAARLLQSRRDDLRY

SEQ ID NO: 26178 - DNA, 839 bp, Zea mays
  misc_feature: Ceres CLONE 1398491-R
  misc_feature: Pfam Name: GLE1 Pfam Description: GLE1-like protein
  misc_feature (94)..(94): n is a, c, t, g, unknown, or other
  misc_feature (483)..(483): n is a, c, t, g, unknown, or other
gaaaaaacgattgtgtacagggccccccctcgaggtcgacggtatcgataagcttttttttttttttttttagataaaaataaattaaatatancattccatgttgggctttttagctgttgcacttacatttaagataatgatacaaattgtgatgcaaaaattcgaaatgatgccgtgcagagggggaaatgatctggggaactatcccataaataatgttcgtgagatttgaaattcacgaccgtgtttctgaaacacgaacagctccatatcgatctggtgctttcatctatacatgaagccgctcttgcgatagtggtaactatgggcgaggtaccgcccttcagacgatcacacgatgtctcataccgatctaggtgttttgatctttacataaacaactccttggatagtagctgctggacgaggtactgcccttctggttcctcaaggtagatcttgtcgttcaggtaattctgntagattgatgacagcatcagcctgcatcttgatgccttgttccttcaaagccggtaaaaagcaccgtgatattacaaccaggattttcatgaactgtgacccatattttcttgtaaagtgcaaaaccagacatcttgaatgaaagcgtgaagggcacatgcagtggctgtagtagcttgggagaaaaattgaggaaaatggcgagccacttccatccctcaactaaaccatggaggatgacgaaaaccttttgaattcccgtctgaatcattggcggcggaagagtttaacatattgccacgaccgtatgggtaaaaaaacttttaggggctcctccgagcttttccttttttttg

SEQ ID NO: 26179 - DNA, 666 bp, Zea mays
  misc_feature: Ceres CLONE 1398492-F
  misc_feature: Encodes the peptide sequence at SEQ ID NO. 26180
  misc_feature (581)..(581): n is a, c, t, g, unknown, or other
gcggtggcggccgctctataatagtggatcccccgggctgcaggaattcgcacgagaccattacctagaacatcctaatcgaaaacttgtgaacatcgcagcgctgtattctccttcgtattgagcgagtatggagatgtcatccatgtaggatatcctcccacaggcgatggagaggaggaacttcgcccctcttcacatattctaattgaatttgccaatctgatagctaaaggagaacaatcaccaatctgcatccttaataatatgatgcgatgcactgtaacgtctgatgaccgcgttgcttccagcattggtgatctagaggtggccggctgtctacccccttcatggtgaggatgtcgacggtgatcggcgactgccgcgtcggcctgaggtcgcggatgacgcatctctccggcctcaagatgttcatctagcggtggtgtcggtgagctcttccgtgcgagcccgcgatatgggcgcttgcaagccacggccgcagttgaccctgaagatattccacgtggagaaggttcaagctacatcctcaggacatgttatgcccatatgtttggggntggcttgtttggccgctattgctgtttggttatcatctttggggtgatcaatgctgcgcttgaaatatcttgcgaaggatcttgg

SEQ ID NO: 26180 - protein, 40 aa, Zea mays
  misc_feature: Ceres CLONE 1398492-F
RWRPLYNSGSPGLQEFARDHYLEHPNRKLVNIAALYSPSY

SEQ ID NO: 26181 - DNA, 687 bp, Zea mays
  misc_feature: Ceres CLONE 1398493-F
  misc_feature: Encodes the peptide sequence at SEQ ID NO. 26182
  misc_feature (358)..(358): n is a, c, t, g, unknown, or other
  misc_feature (394)..(394): n is a, c, t, g, unknown, or other
  misc_feature (395)..(395): n is a, c, t, g, unknown, or other
  misc_feature (408)..(408): n is a, c, t, g, unknown, or other
  misc_feature (425)..(425): n is a, c, t, g, unknown, or other
  misc_feature (426)..(426): n is a, c, t, g, unknown, or other
  misc_feature (434)..(434): n is a, c, t, g, unknown, or other
  misc_feature (439)..(439): n is a, c, t, g, unknown, or other
  misc_feature (440)..(440): n is a, c, t, g, unknown, or other
cgcggtggcggccgctctagtactagtggatcccccgggctgcaggaattcgcacgagaccattacctagaacatcctaatcgaaaaacggatcaaaatcgaatccaacgctactgcctagggtttcctctgcatttcccctaccacaccccgcgccgcccacccatggccgccgcagacgcgtccgccgagaccgccgccatcgcgcggcgcctggcctcctgcaacaccggcacccgggagcgcgcgctccgctacctcctctccgaatttctgccggcctccgcgccgcgcctctccgccaccgaccctcctcagctctggaagggcatcttcttctgcttctggcacgccgacnagccgctctaccagagctcccgtcgctcgcctccgnncgtctcgtcccgncgtcccccggcgatggnntgcgcttnctcgnncgctaactcacaaggtcgggcgggaggggcccaaattcaagtcccacggcctcaaaagttctactccttaaacggcgggtccctccacaggccttccggtttcccagggaaaccccttcccccccaaggacctccccaaggggggggccgccctgaaaaaaaggcccctgtccccgaaaaagcaaaaaagtcccctgtcccatccccgggggccggaaaaaaccggcgagggggtgtttttgagatt

SEQ ID NO: 26182 - protein, 174 aa, Zea mays
  misc_feature: Ceres CLONE 1398493-F
  misc_feature (9)..(174): Pfam Name: Nop52 Pfam Description: Nucleolar protein,Nop52
  misc_feature (65)..(65): Xaa is any aa, unknown, or other
  misc_feature (77)..(77): Xaa is any aa, unknown, or other
  misc_feature (87)..(87): Xaa is any aa, unknown, or other
  misc_feature (90)..(90): Xaa is any aa, unknown, or other
  misc_feature (92)..(92): Xaa is any aa, unknown, or other
MAAADASAETAAIARRLASCNTGTRERALRYLLSEFLPASAPRLSATDPPQLWKGIFFCFWHADXPLYQSSRRSPPXVSSRRPPAMXCAXSXANSQGRAGGAQIQVPRPQKFYSLNGGSLHRPSGFPGKPLPPQGPPQGGGRPEKKAPVPEKAKKSPVPSPGAGKNRRGGVFEI

SEQ ID NO: 26183 - DNA, 630 bp, Zea mays
  misc_feature: Ceres CLONE 1398494-F
  misc_feature: Encodes the peptide sequence at SEQ ID NO. 26184
  misc_feature (324)..(324): n is a, c, t, g, unknown, or other
  misc_feature (423)..(423): n is a, c, t, g, unknown, or other
  misc_feature (497)..(497): n is a, c, t, g, unknown, or other
  misc_feature (506)..(506): n is a, c, t, g, unknown, or other
gctcagaactagtggatcccccgggctgcaggaattcgcacgagaccattacctaaaacatcctaatcgaaaaaagtagacaacccagctctccagcggtccagcggtccagcctctcctagccgaggccaaaacccccataccaacacacacttcgcttctcgctgcctccgcggcggcgcgccgctccgctccgagccctcttcctcctcctcctctgcccgttcggtcgagaatgttctactcgcatcagcttctcgcgcggaaggcgccgctcggccagatatggatggcggcgacgctccactcgaagatcaaccgcanacggctcgacaagctcgacatcatcaaaatctgtgaggaaattttgaacccctcggtgcccatggctctgaggctctctggaatcctcatgggtggcgntggtgatcgtgtacgagaaggaaggtgaaagctctctacactgatgtctctcggcttctgactgagatcacgangcatggcgnatcaaaccggtcacagaccccaccgtctccccagggtaaaaactcagccagggatgaagcagtacactggcagagattcattatgggggtggaacagcccatggtttctcagaagctgaggggc

SEQ ID NO: 26184 - protein, 71 aa, Zea mays
  misc_feature: Ceres CLONE 1398494-F
  misc_feature (1)..(71): Pfam Name: Rad21_Rec8_N Pfam Description: N terminus of Rad21 / Rec8 like protein
  misc_feature (30)..(30): Xaa is any aa, unknown, or other
  misc_feature (63)..(63): Xaa is any aa, unknown, or other
MFYSHQLLARKAPLGQIWMAATLHSKINRXRLDKLDIIKICEEILNPSVPMALRLSGILMGGXGDRVREGR

SEQ ID NO: 26185 - DNA, 669 bp, Zea mays
  misc_feature: Ceres CLONE 1398496-F
  misc_feature (150)..(150): n is a, c, t, g, unknown, or other
  misc_feature (296)..(296): n is a, c, t, g, unknown, or other
  misc_feature (362)..(362): n is a, c, t, g, unknown, or other
tccccgcggtggcggccgctctagaactagtggatcccccgggctgcaggaattcgcacgagaccattacctaaaacatcctaatcgaaaaaattctaaattcgtaaaatcatcacgcgccgtcttcagtcctctgcctcctcgtcgganagccctaatcccactcaatcctctcgctgccgatccgacctcaattccgaatccctcccccatctcccggcgtccccaacgccctccgccatgccggacgtgcagccgctcgtcagcgacttcgtccctcagcttaagcgccgganggtggaggggtcgcacgcggttggcccggcagaacgcgggaactgctacgggcggttgtgtcccancaacggaggggtagcaacgcccaaccaggaagccgggtttgccgaatgttgtacccccttgggggggaataactcaccttcccccaatccctttggatttggttggtggaaaatttggggaaacggggtttacctttttaaagagggggggggttttttttcccccaagagggggaaaataagaggtcttcttctgtttttggtgggcggggggtataaaaataaccggggaaaatttgtgaaccccccgcaaaaataccgcggggggttttgggggaaacagaaaaaaaaccccccccgccccccc

SEQ ID NO: 26186 - DNA, 644 bp, Zea mays
  misc_feature: Ceres CLONE 1398498-F
  misc_feature: Encodes the peptide sequence at SEQ ID NO. 26187
tccccgcggtggcggccgctctagaactagtggatcccccgggctgcaggaattcgcacgagaccattacctagaacatcctaatcgaaaaattgttgattgattgatcctccccgcctcactcctttgtctcctcgcctcgtgctcgctcgctcccctcgccctggcgaggagggcagcagaaaccctagcggctcaggccgggcgggggttagatgctccaaggttcgagagggaagggtaggttagtggtgcgccatcgactatgggctgcgtcttcggccgggcggctgcgtcgtcctctgcagcgccgaagaagaagtgcggcaagggggaggtcgtccccgcagcccgaagcggggtcgccctccgcagtcgccgccaccgacggggacgggaggccgcggcggcggctcgggggccgcagggcgtcgggacccaggcagggttgcgtccccgcggctgccgcggcggagcagctcgccgccggttggccaccgtggctcgttgcagtcgctggggaggccctccgcggctgggcgacgcgacgcgccgacacgttcgagaagcttaataagatacgatcggtgacgtacagcaacgcgtaccgcgagagggacaccgtctctgggcgcatcgtcgct

SEQ ID NO: 26187 - protein, 143 aa, Zea mays
  misc_feature: Ceres CLONE 1398498-F
MLQGSRGKGRLVVRHRLWAASSAGRLRRPLQRRRRSAARGRSSPQPEAGSPSAVAATDGDGRPRRRLGGRRASGPRQGCVPAAAAAEQLAAGWPPWLVAVAGEALRGWATRRADTFEKLNKIRSVTYSNAYRERDTVSGRIVA

SEQ ID NO: 26188 - DNA, 821 bp, Zea mays
  misc_feature: Ceres CLONE 1398503-F
  misc_feature (1)..(1): n is a, c, t, g, unknown, or other
  misc_feature (19)..(19): n is a, c, t, g, unknown, or other
  misc_feature (20)..(20): n is a, c, t, g, unknown, or other
  misc_feature (48)..(48): n is a, c, t, g, unknown, or other
ntttccccccccccccccnnatattatataaagtaaaatggctgtgcncgaagctggtgctcaccgcggtggcggccgctcttcactagtggatcccccgggctgcaggaattcgcacgagaccattacctagaacatcctaatcgaaaaaattcgaagccttcccggttaccccttcggcctccacctatcaccacccgggacgtcttccatggcctcctcgtagtagaatagctctatctcaccgcaacaactcctcattacatcctttatgagaggctgatcgattggtagatacgtactcgggtggagcagaacaacgagagacatggcgacgacgacgcgtgttgccgccaccgccgacggcgtgcttgctgggtcctgtcggggttggcgaccctggggggggccgagggacccgtaccttttcttcgaggggaaaggggggacgaaggggaacaaatccccgggtgggggggggccccagaaggtcattcttctaaaaggggggaggtcccccgggcccccaagaaaaaaactggcttccctcaaaaaaagaaaaaccggcggagaagggggtttttaacgaggtccaaaacaatccggtcccttttttaaccggggaagggggggggcgggccagaggagaacaaacctgtagaagaggaaaacgaaaaccacaaagatataaaaggagggtgagactcttgggcaaaaagaacggtttcagctacgacattggggggtcgccgccagggagcccaagcatctcgggggcgctcttcctatattcctccccaccaaccgccgcgcgggggagc

SEQ ID NO: 26189 - DNA, 677 bp, Zea mays
  misc_feature: Ceres CLONE 1398505-F
  misc_feature: Translation starting site: 189
  misc_feature (463)..(463): n is a, c, t, g, unknown, or other
  misc_feature (602)..(602): n is a, c, t, g, unknown, or other
  misc_feature (677)..(677): n is a, c, t, g, unknown, or other
ggagctccccgcggtggcggccgctctagaactagtggatcccccgggctgcaggaattcgcacgagaccattacctagaacatcctaatcaaaaacctcacctcactcataccgagcgccagttgccagcacgaagagtaggagtagggatcgaagagtgagtgaaactgaaacacgaggaggagtcatggcgaccccggatgaccgcggcagctggttgctgtacctgtccctagccgccaaatgcgccggcgaccagccttaccgcctcgcgggcttcctggccgtctgcgccgtggccttcgtcgtgacctgcctcctgcactggtgcttcccgggaggcccggcgtgggggaaggtggtggtggacgcggcggctcggtgccggtggcggcgcgacggcggcggcggcggcggccctgccggggccgaggggcctgcccgtggtcgggagcatgtggnctcatgacgggcctggcgcaccgcaagctcgcggcggcggcggagagcctcggcgccaggcgcctgatggcttctccctcgggcacaaaggggggggggggtggctccccaccccggacgggggcgcgcgagatctcgncaagccggggggttcgcggaccggccccatcaaggaagtccgcgttacgggctcctggtccaccgcgcatcgttn

SEQ ID NO: 26190 - DNA, 611 bp, Zea mays
  misc_feature: Ceres CLONE 1398508-F
  misc_feature (202)..(202): n is a, c, t, g, unknown, or other
  misc_feature (317)..(317): n is a, c, t, g, unknown, or other
aaagtggagctccccgcggtggcggccgctctagaactagtggatcccccgggctgcaggaatcgcacgagaccattacctagaacatcctaatcgaaaaactctcgcccccgacctcatggaaggatccgcctctcgcgcgcccccgccgacgcacgcaactcgcagacggcgcccccccagatccacttctcgctggccngctcagatcctccatatcctgacctctccctcctcttgctgcagatgatatgctagagcgtcagcaaggcggactctccaaaccctcccagaagaggggaggggagggcaacagncccatggcccagcacggtacccaatcttggggtgggggggaagggggcccggaactgggtaaccccccgggggggagagggtttttggcgcaccccccccccccccttaaaatccccccccgggggtgggggaaacacaaaaaaggggggaggggggggccacgtggggggggaaaagaccaaaaaacccctttttttttcccaaagaaaaaaaaaaaggggggggggggggggggggccccccccccccccccggaaaaaaatatttctctcccccgagagagggaaaaaaaa

SEQ ID NO: 26191 - DNA, 627 bp, Zea mays
  misc_feature: Ceres CLONE 1398512-F
  misc_feature (291)..(291): n is a, c, t, g, unknown, or other
  misc_feature (312)..(312): n is a, c, t, g, unknown, or other
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
  misc_feature (319)..(319): n is a, c, t, g, unknown, or other
  misc_feature (323)..(323): n is a, c, t, g, unknown, or other
  misc_feature (347)..(347): n is a, c, t, g, unknown, or other
cgcggtggcggccgctctagaactagtggatcccccgggctgcaggaattcgcacgagaccattacctagaacatcctaatcgaaaaatcgatcactacggttccatctcgcacccaactaggcctccgattattccgatcgccagcggatcagatttatgcagtcttactgccgccagctccagccatgccgcgcggcagcagcttggaccagagcctgagcgacgaggagcggtcggcaggtactggggcggtttggatccggcgtcgccggcatggtccgggagcccnaacttccggcgggcggggggntannncngggntttaatgagggtggtggggagggnaataacgaattataatccggtaacccctgggaacctggtccgggggagggcgcacctggtttgaaaaaaaaaagccccaatatggggaaggctcaccggggaaagggaacccccggaaaattttttcccggagggcttttattggggggccctttggattattggcccccccgcaaaggggggttttaatccaaagggggtttttgaaagccccgggaaaaaaatggggttcccttgggccccccccgggggaaaaacctttaaaaaggttttcttcgga

SEQ ID NO: 26192 - DNA, 788 bp, Zea mays
  misc_feature: Ceres CLONE 1398515-F
  misc_feature: Encodes the peptide sequence at SEQ ID NO. 26193
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (788)..(788): n is a, c, t, g, unknown, or other
nnnnttttttttttnnnnnnnnttnnnnnntttccaccccctgccccccaccactcccacggacggcactccccgcggaggcggccgctctagaactagtggatcccccgggctgcaggaattcgcacgagaccattacctaaaacatcctaatcgaaaaaacggacccccattcgcatccgcctccttttccttggagccgaagaagagggaaaggaagggaggacagccgccgccgccgccatcaccaccgtcaggatgcattccacgaacctcctgctcgaggagcccatccggatggcctccatcctcgagccctccaagcccagctacttcccggcgatgaccaagatcgtcggcactctcggccccaagtcgcgttccgtcgacacgatctccgcctgcctcaaggccggcatgtccgtcgcccggttcgatttctcgtggggggacgccgcgtaccaccaggagacgctggagaacctcaagctctccatcaagtccaccaagaagctctgcgctgtcatgctcgacaccgtgggcccggaggctgcagggtgttgaacaagagcgagacccccgatctcctccgaggagaatgggcaaggatcgttctccacccctccaccgggggccaaagacgccctcctcccaggtttgctggcccattcaagctttctctgggaccccggcccaaggggggggggaccaccaggggccacacacaatatatccgtggcgcaacaaccaaccttgggcgccaactggggcggggaggaaacaacccn

SEQ ID NO: 26193 - protein, 101 aa, Zea mays
  misc_feature: Ceres CLONE 1398515-F
  misc_feature: SWISSPROT Homolog: EC 2.7.1.40 Pyruvate kinase
MHSTNLLLEEPIRMASILEPSKPSYFPAMTKIVGTLGPKSRSVDTISACLKAGMSVARFDFSWGDAAYHQETLENLKLSIKSTKKLCAVMLDTVGPEAAGC

SEQ ID NO: 26194 - DNA, 624 bp, Zea mays
  misc_feature: Ceres CLONE 1398516-F
  misc_feature: Encodes the peptide sequence at SEQ ID NO. 26195
  misc_feature (624)..(624): n is a, c, t, g, unknown, or other
gctctagaactagtggatcccccgggctgcaggaattcgcacgagaccattacctagaacatcctaatcgaaaaattccaaaagctctcgagacttcctcagcaatcaatcagctttccagcgatcggcagctcctcgatcgtttcgaagctccaatccgcccggccgcctccgcctgttgccactagctaggtgatcgatcgaatggactgcggtggcgcgctgcagctcccgcctgggttccgcttccaccccaccgatgacgagctggtgatgtactatctcctccgcaagtgcggcggcctgccgctcgccgcgccggtcatcgccgaggtggatctctacaagttcgacccatggcagctcccagagaaggcgttcggtggggagaaggagtggtacttcttctcgccgcgcgaccgcaagtacccgaatggctccaggcctaaccgggcggcggcggggtaacattgggaaagccaccgggcgcgacgaaaccgggtagggtcgcccgcgccccgtgcccatcaagaaggcgctcgtcttctaacgccgggaagccgccccaagggcgtcaagacccaactggatcatgcacgagaccgcccccttcgcggacgtcgn

SEQ ID NO: 26195 - protein, 87 aa, Zea mays
  misc_feature: Ceres CLONE 1398516-F
  misc_feature (9)..(88): Pfam Name: NAM Pfam Description: No apical meristem (NAM) protein
  misc_feature: The sequence is a functional homolog of SEQ ID NO 1197 in the 10/412,699 US patent application
  misc_feature: The sequence is a functional homolog of SEQ ID NO 866 in the 10/374,780 US patent application
MDCGGALQLPPGFRFHPTDDELVMYYLLRKCGGLPLAAPVIAEVDLYKFDPWQLPEKAFGGEKEWYFFSPRDRKYPNGSRPNRAAAG

SEQ ID NO: 26196 - DNA, 653 bp, Zea mays
  misc_feature: Ceres CLONE 1398517-F
  misc_feature: Encodes the peptide sequence at SEQ ID NO. 26197
  misc_feature (420)..(420): n is a, c, t, g, unknown, or other
  misc_feature (446)..(446): n is a, c, t, g, unknown, or other
  misc_feature (465)..(465): n is a, c, t, g, unknown, or other
  misc_feature (466)..(466): n is a, c, t, g, unknown, or other
  misc_feature (653)..(653): n is a, c, t, g, unknown, or other
ggagctccccgcggtggcggccgctctagaactagtggatcccccgggctgcaggaattcgcacgagaccattacctagaacatcctaatcaaaaaagcaccgtccacctccaccatctttcctcttcctcctcgcctccaccccttcccttccatctcctcccacccggcgactcctcttcctctctgccgcgccgatcgattggcccacccatcgatcgagcacggggaagaagattccagtccggagtggtttcaattcggtcgggttcgttgcccgtgtgggtgggcgctatggcggcgatggatgcctcggcagataagaacgccgtcttccgcaagcttcgcgcccaatcggacaacaagatgtgctttgattgcaacgccaagaacccgacgtgggcgtccgtcacctacggngtcttcctctgcatcgactgctcggngggcaaccgaaacctcggnngtcacgtcctccttcgtaaggtcaacaaatttgggatcatggacctcagaccaactgaaaaaggatgggcttatgcgggaaaataaacggggggaaagttttttttaaacaaaagggttgggacaaaaggggggaaaaatttaaagaaaagttactttttaagaagttgttgatcttgaaccccaan

SEQ ID NO: 26197 - protein, 85 aa, Zea mays
  misc_feature: Ceres CLONE 1398517-F
  misc_feature (11)..(80): Pfam Name: ArfGap Pfam Description: Putative GTPase activating protein for Arf
  misc_feature (51)..(51): Xaa is any aa, unknown, or other
  misc_feature (58)..(58): Xaa is any aa, unknown, or other
MAAMDASADKNAVFRKLRAQSDNKMCFDCNAKNPTWASVTYGVFLCIDCSXGNRNLGXHVLLRKVNKFGIMDLRPTEKGWAYAGK

SEQ ID NO: 26198 - DNA, 659 bp, Zea mays
  misc_feature: Ceres CLONE 1398518-F
  misc_feature: Encodes the peptide sequence at SEQ ID NO. 26199
tccccgcggtggcggccgctctagaactagtggatcccccgggctgcaggaattcgcacgagaccattacctagaacatcctaatcaaaattatgagtgcaaggagaaaaaagcttgtcagtgtcctgaatgcaactgcaaagatacatggggtggctatgactgcacttgcagtggtgaccttttgtacatcagagagcatgacacctgcataagcaagacagcagttcaggctaaagcagcatgggctgcagtgtggggtatcttgatagttgttgctgttgtggcagcgggaagttatgttgtgtacaaatacagactaaggtcatacatggactctgagattagagctatcatggcgcagtatatgccacttgacaatcaaggagaggtcccaaatcatacacatgacgaagatcgttcataagtgtgcaaatcattacgtgggtggacccatatggcctaatctgacaccaatggaagatcggtcgtgagctctaccaaacagaaagctaccaggcccaaaaaaaagcttggattttttaaaaggaaaaaaaaacctgggaatttggcccggaaaagtttactcggggaacaagtttccttttttaaaataaagaccgggaaatttgggggaaaaaaggccaacttcttaacaa

SEQ ID NO: 26199 - protein, 141 aa, Zea mays
  misc_feature: Ceres CLONE 1398518-F
PRGGGRSRTSGSPGLQEFARDHYLEHPNQNYECKEKKACQCPECNCKDTWGGYDCTCSGDLLYIREHDTCISKTAVQAKAAWAAVWGILIVVAVVAAGSYVVYKYRLRSYMDSEIRAIMAQYMPLDNQGEVPNHTHDEDRS

SEQ ID NO: 26200 - DNA, 780 bp, Zea mays
  misc_feature: Ceres CLONE 1398519-F
  misc_feature: Encodes the peptide sequence at SEQ ID NO. 26201
  misc_feature (1)..(1): n is a, c, t, g, unknown, or other
  misc_feature (2)..(2): n is a, c, t, g, unknown, or other
  misc_feature (21)..(21): n is a, c, t, g, unknown, or other
  misc_feature (29)..(29): n is a, c, t, g, unknown, or other
  misc_feature (34)..(34): n is a, c, t, g, unknown, or other
nnccccccccccccctccccnttgttttngtttntgggtctcgttatgtaagtttaaatcacaacgggacggccggcttttacctaccggatcccccgggctgcgggatttcgcacgagaccattacctagaacatcctaatcgaaaacctccccatcgagtctgtccgctacccctccccgaccagatcgctacgagacgccgcgcgatccgacccaggccgacgccgacgacccctctcgccgccggtggccatggcgtacggtgaccgcgccaccaccttcgaggactccgagaatgatagcgagtacggctatctccgcaaggtctctggacctgtggttgtggctgatgcaatgcttcgtgctgccatgtatgaacttgttcgtgtcggacacgataacctcattggggaaattatccgccttgagggtgattcatctactaccccgagtttatgaggaaacagctggactgatgggtaaatgcccttgtcttgagaacaagaaaggcctctttcagatgtaattgcgcccctggcattcctggaagcccgttctgggaccgggttcccagcggccctcttcaaagaccgtcttccaacaaccacccactgaaaaattcctatacctcccccgatgcgcggccccccagcctcctagtcccctgcacacaatcacggagattgggggacacattctcacgggaaccggcattcatagcggcgctaagggcagggcgcacggcgcgccatcgaggggggggacaccaaaagcgccg

SEQ ID NO: 26201 - protein, 68 aa, Zea mays
  misc_feature: Ceres CLONE 1398519-F
  misc_feature: SWISSPROT Homolog: EC 3.6.3.14 H(+)-transporting two-sector ATPase
MAYGDRATTFEDSENDSEYGYLRKVSGPVVVADAMLRAAMYELVRVGHDNLIGEIIRLEGDSSTTPSL

SEQ ID NO: 26202 - DNA, 643 bp, Zea mays
  misc_feature: Ceres CLONE 1398522-F
  misc_feature: Encodes the peptide sequence at SEQ ID NO. 26203
tccccgcggtggcggccgctctagaactagtggatcccccgggctgcaggaattcgcacgagaccattacctagaacatcctattgaaaaaaagcctaacaacgcatttcgctccccacagcggctcgggcacaacccacagtcagacggtctcgaggtggatctctaccgttcgtccgttccagcagacagcagtgggcgctctctctctccctcgtggcgacgacggggcgaccgctgccgctgcccttgtgccccggtctccgtcgggccggtcgccagggctcctgcgggctctttggcgtcgaccagctccgccaggttgctgtgtgaagtccaaggttgtcacatggattcagcacaagatttccaacccaggacattctctatcatgttgtggccaccaactgaaagcacacggatcatgcttgttgacaggatgacaaacaatctgtccacagagtccattttctctcggaaatatcgccttttgtgaaagcaagagggtcatgagaatgcacaaacgattgaagaactttgctttgccttggctgatgagcatttcacagaggagccagatggtgatgggagttctgctgtccagctatatgcaaaggaaacgagcaagatggatgttggaagt

SEQ ID NO: 26203 - protein, 48 aa, Zea mays
  misc_feature: Ceres CLONE 1398522-F
MDSAQDFQPRTFSIMLWPPTESTRIMLVDRMTNNLSTESIFSRKYRLL

SEQ ID NO: 26204 - DNA, 484 bp, Zea mays
  misc_feature: Ceres CLONE 1398525-F
ccccgcggtggcggcgctctagaactagtggatcccccgggctgcaggaattcgcacgagaccttacctagtacatcctaatcgaaaaacctgccacatctggccatctctcagtctcacacgcgctgccatggacggatccatgtggtgcgctgccactacgtgcctctgacgccgctcagcttctggagcgcgccgcggtcgttgtacggcgaacggcgcggccgtcgtttgcggcgataggcggttcttcgtgggccgcgagaacgagggaaaccggtgccctcgccgggggcagccgcttcctcgcctctcgtctccgggggttgggcccgccgccaacctggggtcccgggtccatccgccccccaaagggacccgggcgaaagggaacgaaacttccctttttcacgggtggccccaaaaaacccggggcccccgtccctggggggaaagcgtttaaaaaaccccccccccaaaaagc

SEQ ID NO: 26205 - DNA, 642 bp, Zea mays
  misc_feature: Ceres CLONE 1398526-F
aaagctggagctccccgcggtggcggccgctctagaactagtggatcccccgggctgcaggaattcgcacgagaccattacctagaacatcctaatcgaaaaatttttggcccccgccacgacttccgtgctcgccgcctttgcgtactagggtggtgctcgttcacatctgttttcctgcggcggaggactacatgaaggctagggagatggggatggccgcggcggctgcgtctgcggcgtccgagggaggaggcgtctagctgcgcgcgaccaatcacgacctgccctaccggcaggactgctggagcgacgtctagacggcagatctcgactccgcctgagggaagcgctacgtcgagctcagacgcggtaacctgctccacaatcaccgccagcgaggtggagacgacgtcaactcgcgccgttgaggctccgcgcggcgccgcccgccgcgcagcgtactccagcgcaagagccgcgtcgataccctcaagaagaagtagaaggccgagctcgcccgcaacgcgtcgtcagcctgttcctacttcgccgaggtcgaccgcctcgtcgtcccaaccctcaacgactccgcctccgagagaacccttggcgttctctgccctcctcatttcccctttg

SEQ ID NO: 26206 - DNA, 635 bp, Zea mays
  misc_feature: Ceres CLONE 1398527-F
  misc_feature: Encodes the peptide sequence at SEQ ID NO. 26207
aaagtggagctccccgcggtggcggccgctctagaactagtggatcccccgggctgcaggaattcgcacgagaccattacctagaacatcctaatcgaaaaatatcaagtctaaagcaagcgcactactcctcggactcggatagccacggcggcagcggcagcagcagccatggcttgctccgcgcaccttgtgtcccagagcctctactcgtcccaccgcgccagcccgcccgggcctaggaatctccgctcccagggccgaccgccggcgcgggcgtctccctctgcgaggcctggctcgagggtcagtggctgccggggtgtcagcctgagagtcgccgcgtcgttcgagcagggaaggaggcaagtggaggtctcttatgacccacaagcgaggtttaaccagatagcagaccaaattgacaaggatgctgggatgacacggcttaacctattctcaccttgcaaaattaatgtgttcttgaggataacgggcaagagaccagatgggttccatgacctggcttctctatttcatgtcataagtttgggtgatactatcaaattctcattgtcaccaagtaaagtaagagatccgctggcaacaaagggttccagggggccccagtgaga

SEQ ID NO: 26207 - protein, 153 aa, Zea mays
  misc_feature: Ceres CLONE 1398527-F
  misc_feature: SWISSPROT Homolog: EC 2.7.1.148 4-(cytidine 5'-diphospho)-2-C-methyl-D-erythritol kinase
MACSAHLVSQSLYSSHRASPPGPRNLRSQGRPPARASPSARPGSRVSGCRGVSLRVAASFEQGRRQVEVSYDPQARFNQIADQIDKDAGMTRLNLFSPCKINVFLRITGKRPDGFHDLASLFHVISLGDTIKFSLSPSKVRDPLATKGSRGPQ

SEQ ID NO: 26208 - DNA, 767 bp, Zea mays
  misc_feature: Ceres CLONE 1398528-F
atttacctaaaaccaaaacccacccaccccctccctcccattacaattatcaaggtggtgctccaccgcggtggcggccgctctacaatagtggatcccccgggctgcaggaattcgcacgagaccattacctagaacatcctaatcgaaaaatatctatatctggattgttccggccctcccccttcttcgattttgtgggcggcttctctctctttttttcttcttcctgttgatgtgcgaatttagaggggataagagcttttggggggaatctgatggaatccgatcgattttctcgccgttcttggtcgatctgtcggggaaggtaggatttgttcatggtttgtgggggatttggttggatttcgaaggtttggggcggccatggtggtgactggtgagcggatatggggatttttggtgatcgagtggggaatcggcctgttggatgtctttaaaacgggattttgtgatactgtaggaatttttcggcggaaccatagctcttgttgcgaaataccggtatagaccacggatcatcatgtattaaaacctttttttttcctcagagcgcaggggatgaccaagggctaaccatatacgtaaaaggattgaacgtcgcacacacacaacaacttacaagaaacggaacccaagtcaataacaccaataacaggtattacttccccgcagttcccttttcttgcgctcatcaccccttaccaccactcactcccgccccgccttctccctcccgcaccgcc

SEQ ID NO: 26209 - DNA, 671 bp, Zea mays
  misc_feature: Ceres CLONE 1398529-F
aaagctggagctccccgcggtggcggccgctctagaactagtggatcccccgggctgcaggaattcgcacgagaccattacctacaacatcctaatcaaaagcaaaagccagcagcagcgagcgtcggcaggggagcccgagcagaggagcacacttgccctctccacctgaaaccccgcgcatgctccgccggccgcggccggtgccgcgacgactcaggacgcgctagctagctagctgttcctctccccgagggccccaccactaccaccatcctgccgcccggactcgcgtgggggatgatgattcctagggagccgaggtggtcgtgagcaaccttccaattcctgatgccgagctgacccccgcccatcgcagcggcggctctgccgcagcgtctgtgcccagacttatgatgatggagacccctcacatcgagatgggaggtatcaaggtcaacagcccgcaagtgaccaacgctgtggtacggcccaccgtgtattcctcctggaactctacgagggacgaacgagagggcgctcaatagcatcaggatcgtcattttcacttccaagctcaacttgctcatgacgttcgggactgcgttcatcattctccacttcacgagtaggatgcatggattgattctcctttatcacatgataagaat

SEQ ID NO: 26210 - DNA, 609 bp, Zea mays
  misc_feature: Ceres CLONE 1398530-F
  misc_feature (359)..(359): n is a, c, t, g, unknown, or other
gctcaagaactagtggatcccccgggctgcaggaattcgcacgagaccattacctagaactcctaatcgaaaaaaatccaagtaaggaaatccccgatgatctcctgcgcgtcgcagcgccagccactcgattagtggagtccaccaaccaagcacgcgtccctccccgtcccagatcccatcccgcggcagccggtcagtccgatccatctccagtacccagcccgtcacccgccttccccgttcgctctcgtcggcgcgcgatggagggtctcatcaaggggttggtccacgtggccatcgacgccgtggaggacgccgtgagggagagggaccacggccggcgccgaacgacgacnaaaggggcccaaggaaggagggggggccccccaagttcccaaaaccaaaaaaaaaacaaggggggggggggggaaaaaaacccccaaaaaaatcttctccgggcaaccgaaggggggggcccaaaaagggggtcttcttctcacaaaaaaaaaaagaggggtggtgtttttttccttggggggggggggggggggggggccccaataaattaaattttggtggggggggggggggggagagaataaaaaa

SEQ ID NO: 26211 - DNA, 553 bp, Zea mays
  misc_feature: Ceres CLONE 1398533-F
  misc_feature (242)..(242): n is a, c, t, g, unknown, or other
  misc_feature (344)..(344): n is a, c, t, g, unknown, or other
ggagctccccgcggtggcggccgctctagaactagtggatcccccgggctgcaggaattcgcacgagaccattacctagaacatcctaatcgaaaagaaacccctctcttcttcctccttccattggggtcgcgtccaacaagaggctggccagccatcccgcgcgagccacttcctctctcctccccatcggatccagcgccacgcggatccgcaaggcaatccatggcctctacccaggncgaagcggagggcgggggcacccgggcccccgcccgaagggggcgggaagccaaaagaaaaaagggcaaagcaagggcccggggttgctttgggaaaagagnttgtggggcgggcccccctttttttccggggggcccccccaggagaaccttttccaaaaaaaaaggggggggggaaaaaccccccccacaaaaaggaaaagccccccccgcccccccccgggggaaatttccccccggaaaaaaaaaaaatttttttccgccccccccccccccgggggggaaaaacccccccgggaagctcccccccc

SEQ ID NO: 26212 - DNA, 672 bp, Zea mays
  misc_feature: Ceres CLONE 1398538-F
  misc_feature: Encodes the peptide sequence at SEQ ID NO. 26213
  misc_feature (532)..(532): n is a, c, t, g, unknown, or other
  misc_feature (533)..(533): n is a, c, t, g, unknown, or other
  misc_feature (566)..(566): n is a, c, t, g, unknown, or other
  misc_feature (628)..(628): n is a, c, t, g, unknown, or other
  misc_feature (637)..(637): n is a, c, t, g, unknown, or other
tccccgcggtggcggccgctctataactagtggatcccccgggctgcaggaattcgcacgagaccattacctagaacatcctaatcgaaaatcggctcccaccttcctccgttgcctcctcttccgcggccccgtcgatgggcttggctttaccagtggcgggttcccacacgggggctagacgccgccaccgctgaccccgtctacaccgaatcccccgcgcgatttaacccctcgcatcgctcgccgcctccgcttccatacaaccgcgcactccaaacgcgcacgcgctgttcgttcctcggccgctctctccaccccctccttctccgcccccaacagatctccgcccggccgtgcggttccttaattcgccttctccgggactgtcggatctccgcggcggctgaggatgggcaactgctgcgtgacgccgaaagcagccgacgacgccggcggcggcaagaagcccaaggagctgaagcagaagaagggtaagaagccgaaccccttctcgagtcgagtacaacgnntcggggcaggcgagcgcgccaaagctggtgggngctgcgggatcccacggggcgggacatccgcgggggcggtacgagctcgccgcggagctcgnccggggccnaattccgggtttacctacctctgcacagaccgcgc

SEQ ID NO: 26213 - protein, 86 aa, Zea mays
  misc_feature: Ceres CLONE 1398538-F
  misc_feature (41)..(41): Xaa is any aa, unknown, or other
  misc_feature (52)..(52): Xaa is any aa, unknown, or other
MGNCCVTPKAADDAGGGKKPKELKQKKGKKPNPFSSRVQRXGAGERAKAGGXCGIPRGGTSAGAVRARRGARPGPNSGFTYLCTDR

SEQ ID NO: 26214 - DNA, 816 bp, Zea mays
  misc_feature: Ceres CLONE 1398540-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (38)..(38): n is a, c, t, g, unknown, or other
  misc_feature (42)..(42): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (384)..(384): n is a, c, t, g, unknown, or other
  misc_feature (407)..(407): n is a, c, t, g, unknown, or other
nnnnnnnnnnnnnnnnnnnnnaagttaaaatggtaaantgangggcacccccnnntcaaaactggggctccccgcggtggcggccgctctagaactagtggatcccccgggctgcaggaattcgcacgagaccattacctagaacatcctaatcgaaaaaacaaaaaccaacgctccccctgcccccctctttcctccccagacccgcgctcccctccgtggcgtgcaacgcgttcctcggctcctgcaggcggcgacctcggaaaggcgggggcgtctcgtcgcgaggcatttgaggccaggattttttggtgctctcattgttagctgactggtgagggtctggatctagcaatggtggaaaacacccacggtagtggtcgncacgtgcctttggggacttgacnaaagtaatttgcaaagcgaggagcccacatcacaatctgcaaaaagaagcacagggtggggataaaggatccaaaccccactgaaaaaagacctggcgactcacgaaaagaagtaccgaatgccaaaaggccaacacgctcacccagcgaatgacggaaaaacgcgaaattggtaatttctggccccattttggcacctggagggaagggcggccccagaagcagatagattctcaaaaagccaatttcaatatcttttccgcgaaaaaattgagtgggtgtcacaacaacataacctggcgcccaaaaaaacccacggaaacccccttattccagagagggagcccccagaggaatctagaaaaaaaccccctctctgcccctcaataacggggccacattaaaaaaa

SEQ ID NO: 26215 - DNA, 713 bp, Zea mays
  misc_feature: Ceres CLONE 1398542-F
  misc_feature: Encodes the peptide sequence at SEQ ID NO. 26216
  misc_feature (1)..(1): n is a, c, t, g, unknown, or other
  misc_feature (2)..(2): n is a, c, t, g, unknown, or other
  misc_feature (13)..(13): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (41)..(41): n is a, c, t, g, unknown, or other
  misc_feature (48)..(48): n is a, c, t, g, unknown, or other
nnaaaaaaaaaanannnnaaaaaaaaaaaaaaaaaaaaaanaaaaatntactacaaaactggtactccccgcggtggcggccgctctagaactagtggatcccccgggctgcaggaattcgcacgagaccattacctagaacatcctaatcgaaaaagctaggttcctatgcccaaagtcacacagcttcttctccttctacttctccttcctcctctcctcaccggcaccttgatctaatctcttccatcctagcttgctcgccgctgccagtctctcctccgcctgcaacgactcccatgtctcagtcttctcctctcttctccgtcgcccgagcgcacgccggagcaggagggcgagccgtggcagccgctctcctgctccgtcgtcgccccattgcacagctgccgcacagcatccatggcctacggtgtctctctccagccagagcgacaccttccaagacgctcctcagcctcccccgcgccacgctgtcctccttcgccgaccccgacggcgacggcggctccagcgcgaaagccagcgacggcggcgccaaggccggcgccggcggggaggagcaggtcggcgaatgcgagatgtcggagatggccagggcgttccacatctcgacacgggtggcgacgtccatctccgtgacgatcgcgttcgccgccctcaccgtgccgctggcgatgcgctcgctggtctgc

SEQ ID NO: 26216 - protein, 38 aa, Zea mays
  misc_feature: Ceres CLONE 1398542-F
MSEMARAFHISTRVATSISVTIAFAALTVPLAMRSLVC

SEQ ID NO: 26217 - DNA, 768 bp, Zea mays
  misc_feature: Ceres CLONE 1398546-F
  misc_feature: SWISSPROT Homolog: EC 5.3.4.1 Protein disulfide-isomerase
  misc_feature (13)..(13): n is a, c, t, g, unknown, or other
  misc_feature (19)..(19): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
ttttcctccctcncccccncccccccgccttttnnnnaaggcgccactttcaaagctggagctccccgcggtggcggccgctctagaactagtggatcccccgggctgcaggaattcgcacgagaccattacctagaacatcctaatcgaaaacagtcccagtcccagtcccagtcccaggacagtcccgtcagcagccacttccccggcccctcccgctcctgctcgccggaggccgggccggcggcgatggaacacgttactagctgcagccgatgcacctttcttcacgattacatcaagcgtggcgcagataggcgtaatggcccactctcaacctggttctcgagattagcttgattgtgatcagctgtacagacaacactgaatggattctttttatacttctcagcacccgacagcaggagctcaaggtacttgtttcttccctctgcctttgaatccaggatgtctggaaggaatgatacaaaacaaatggcaggagaagcacacttctcttccatgacatccgggccagtcaactcataaacttcaactggggcagagatggcttccaactgcttccaatgcaaaggattcaatggctagatgcaactcttagcccgcctggtagggggaacgggcctctcccttaatcagccaacaaaataccaaaaataggttgggaaaaaccttttccacctttgtaactttgcttcaatcaaagggaactttttcaaggcatccagcaattcaaacattgggtcc

SEQ ID NO: 26218 - DNA, 630 bp, Zea mays
  misc_feature: Ceres CLONE 1398547-F
  misc_feature: Encodes the peptide sequence at SEQ ID NO. 26219
  misc_feature (318)..(318): n is a, c, t, g, unknown, or other
  misc_feature (579)..(579): n is a, c, t, g, unknown, or other
gctcttcaatagtggatcccccgggctgcaggaattcgcacgagaccattacctagaacatcctaatcgaaaaagatttggatgtggactagatgcttaaggtgtgaacgtgaaagtggggtccccagatcatcacgaagggtgataatgtcagctgaagcacactacctttcatttgggaagttccttgaacttagtttttcaagccactcaaccgctagaaggctgccaatatgcgggcattcactcaatacggattgtctgcgctttttttgggttgcgctccaaagttgcaatgttccagtattcctcagtcgnaatttacaatgcctgcaaaccacagcctactcttgaggatcacaaccccgatatgcacaaagatgcccccagggtgctgccctcgtggttcgtgctctgattgttgagtcttccatgaaagctgatcccggtatatagaggggacaagcctttgattatttcttttggtaattggggggacaaaatgagggggaacaggtttattaagggaagtccttgacaaaacaagagttcaaaaaaaagaggaaccgaatttgggantcccccaaggggggctccagggaaaagaaacatccccctgggccacaaaaa

SEQ ID NO: 26219 - protein, 90 aa, Zea mays
  misc_feature: Ceres CLONE 1398547-F
MWTRCLRCERESGVPRSSRRVIMSAEAHYLSFGKFLELSFSSHSTARRLPICGHSLNTDCLRFFWVALQSCNVPVFLSRNLQCLQTTAYS

SEQ ID NO: 26220 - DNA, 667 bp, Zea mays
  misc_feature: Ceres CLONE 1398550-F
  misc_feature: Encodes the peptide sequence at SEQ ID NO. 26221
tggagctccccgcggtggcggccgctctagaactagtggatcccccgggctgcaggaattcgcacgagaccattacctagaacatcctaatcgaaaaatctcttctcctcacaaggcttcctcccaccacctccagtccttcaccggaccaccacctccagtcctccaccggaccaccacctccaccactcctctctcagaacacgcgcaaaccgctcgaaccctagctggtggcgggaggcggaggtggctccgggatgacgcggcggtgctcgcactgcagccacaacgggcacaactcgcggacgtgccccaaccgcggggtcaagatcttcggggtgcacctcaccgatggctcggccatccgcaagagcgcgagcatggggaaccctctccctcctctccgcgggaccaccagcgggtgggcgtcccccgcccgaaggggcccgaccttcccgacggggggcgggggctaccccctcgaaagaacttcgtcagggggtcggtcccccgccagtcgggaaaaaaaaaaaaaggggttccttgggattgaaaaaaaacccccgggggtttgggtggaaaataaaaaacttcgggaaaaggggattggggaaaaaatttctcccaaatttggggggggccaaaaaacccctctcctagggggggg

SEQ ID NO: 26221 - protein, 136 aa, Zea mays
  misc_feature: Ceres CLONE 1398550-F
MTRRCSHCSHNGHNSRTCPNRGVKIFGVHLTDGSAIRKSASMGNPLPPLRGTTSGWASPARRGPTFPTGGGGYPLERTSSGGRSPASREKKKKGFLGIEKKPPGVWVENKKLREKGIGEKISPKFGGGQKTPLLGG

SEQ ID NO: 26222 - DNA, 667 bp, Zea mays
  misc_feature: Ceres CLONE 1398551-F
  misc_feature: Encodes the peptide sequence at SEQ ID NO. 26223
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (441)..(441): n is a, c, t, g, unknown, or other
  misc_feature (503)..(503): n is a, c, t, g, unknown, or other
  misc_feature (531)..(531): n is a, c, t, g, unknown, or other
tcagaactagtggatcccccgggctgcaggaattcgcacgagaccattacctagaacatcctaatcgaaaacatccactccgacaccaatcctccgctccgaccaccgccggagaaatggggcggcgccgccggttcgcgcagctggacgatgacgacgacgacgacgaagacgtgcccatcaatttcaagccctcgggtggcgcctcctcctcggacgccaaacccaggaagccccagccgccgccgcagcagcgccgcggagtctccgatgacgacgacgaggacgtggaggaattgggaacttgaggaggaggaggacgacgagaaggatctcgaggaatgcnnnacgggccgaggaggaggagcgccgcgagcaggaggccgagacgaagactcgcccgccgccggggacggcccaagcgccgccgcgacccggggnagcgaggatgaggagcccgaggagctagagctgcaaacggaggatccccgtggaggaggagnatcacggaggcggtggcccgtagctgtnaggggacccggtcaagatcactgggcagggggaagaagcagaagaagcactatgctttcctccgagtacgaggggcacaggcttcgagctgggaggacccccgtgcttctcacgcctgagggacagcatcaagaag

SEQ ID NO: 26223 - protein, 63 aa, Zea mays
  misc_feature: Ceres CLONE 1398551-F
MGRRRRFAQLDDDDDDDEDVPINFKPSGGASSSDAKPRKPQPPPQQRRGVSDDDDEDVEELGT

SEQ ID NO: 26224 - DNA, 872 bp, Zea mays
  misc_feature: Ceres CLONE 1398555-F
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (872)..(872): n is a, c, t, g, unknown, or other
ttttccccccnnnnnnnnnnntccctccccttctcaccccattccccccccacactggagctccccgcggtggcggccgctctataactagtggatcccccgggctgcaggaattcgcacgagaccattacctagaacatcctaatcaaaacatccagagagagacacggaggacctgggtttggttgcgctgcttgactcgctccgtgttccaagcgccttttgagcattcaggcagatataacattcctctttttacactacaatccccgctgaatcagcagcagcaactctctccctctccgttcttggtggcccgagacccttggccgaacgctctgcctcactcctccgtctcttgcttcccttgcccgccgggggggcccggagcaccggccgccgaaatcctggtgggttgcttggctgtctcacccccggacccctccccctccctctctgggcttccccaggcccccatgcgtaagagaccagtggagtaatttcattgtcgggcacactccccactcagtcgtgtgcgcgaggttaatggcccggccgtgccccttacgggcttctctattagcgagtagtaggcgagttaccccacggtgcacctcgcgcccggggcatctggatcattagtaataatcgagacccctatcgcgccaccacctccatctctcactcctccctcccttcctaccccgccccttgcgcgagcacacgcaccccctccccctcccccgccccaaagtatagatctctcaacccacgctcccccccgatcacacagacgagcacaccataccaacaacaacccatacaacaacaataataactccatccacagaacccccacccgcccccccacn

SEQ ID NO: 26225 - DNA, 690 bp, Zea mays
  misc_feature: Ceres CLONE 1398556-F
  misc_feature (376)..(376): n is a, c, t, g, unknown, or other
  misc_feature (690)..(690): n is a, c, t, g, unknown, or other
cgcggtggcggccgctctagaactagtggatcccccgggctgcaggaattcgcacgagaccattacctagaacatcctaatcgaaaaatctctctcgctttctctaaccatgacgctggtgaggatgccttgacgtgtctgctgcttcctgctcgtcgtcgccacctccgccgtctccggtcggacgtcggcggacaccacgctcccgagataggagggacgcctcccgttccacctctaaacaggatatgtgtagttgatagaggacgccggactgtagatctactgacactgtctgctggtagagtcgcgagtcgaccacgcaaacacatggtcagcatgcggtagtccggatgacaattcgttcgacatgtgngccatacctaggtgagatgacgcacaaacatgtttgtctcggattgctacaaaagtcctagggatgatgtgaaaaagactagtcccggaaaagagggcctcaaaatccatattgtgcttcaaaaggataaaagacagtgtgttcttttaacaaaagggtgaaaggctaaaacaaaaacacaaaatgtgggggtgggcttaaattggctgacgtcacccccaaaaaaaaagccccaaaaaaaataaaaaaaacgaccaaggagaaaaaggggcctaaaagagggcgggggccacacgggggttccacaataagcn

SEQ ID NO: 26226 - DNA, 863 bp, Zea mays
  misc_feature: Ceres CLONE 1398561-F
  misc_feature: Encodes the peptide sequence at SEQ ID NO. 26227
  misc_feature (6)..(6): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (49)..(49): n is a, c, t, g, unknown, or other
  misc_feature (826)..(826): n is a, c, t, g, unknown, or other
  misc_feature (863)..(863): n is a, c, t, g, unknown, or other
tttttntttnnntttcccggcctccccgaccgtccccgcgcccaccccngaaaatggggctccccgcggtggcggccgctctagaactagtggatcccccgggctgcaggaattcgcacgagaccattacctagaacatcctaatcgaaaaacattccatcggtcgtgaaaagaaaaagggaaacaaaccaagctagagaaaagaagaaggtactacatactagctagctagcttagctatgggcaccatcgtcgacgctgacgtcgggttcgcggtgaagaggacgagcaggtcgctggtgccgcctgcgtcggcgacgccgcgggagacgctgcgtgctgtcggtgatcgaccggcgtggcggggctgcgtcacctggtgcgctcgctgcaagtgcttcgccgcgggcgggggcaagaaagcgccacccaggcgacggccgacccccggccaagcgggctgcgagaacgggactggcgcgaagacggttagcggggacaaactacccggttactgggatgtgggtaccattcctggacgtacaccgtaacgcacacccccctacgccgctcggtcccccttctgtcttccggttgtgctcttcttcgggctcgctcttgcgttcgccaaactacaccactcccatcatgacgttggatagcgtctggcttgggggctttagtcgcggggcaccatcataatatactccatacgggggctgcattttgccgggttgaacaccaactacctagagatggcgccacaaactacccgcaactcgcagtttctttccacacatcattcacccaccttgcgtgccatcgngtcagagacccgccccgtcctcatcgcatcctccccn

SEQ ID NO: 26227 - protein, 103 aa, Zea mays
  misc_feature: Ceres CLONE 1398561-F
MGTIVDADVGFAVKRTSRSLVPPASATPRETLRAVGDRPAWRGCVTWCARCKCFAAGGGKKAPPRRRPTPGQAGCENGTGAKTVSGDKLPGYWDVGTIPGRTP

SEQ ID NO: 26228 - DNA, 640 bp, Zea mays
  misc_feature: Ceres CLONE 1398565-F
  misc_feature: Encodes the peptide sequence at SEQ ID NO. 26229
  misc_feature (430)..(430): n is a, c, t, g, unknown, or other
ggcggccgctctataatagtggatcccccgggctgcaggaattcgcacgagaccattacctagaacatcctaatcgaaaaacggtcgcgagagtgaaggcaaggaaaaacacccaaacggccaaaccccaggaagccccgtcggaccctacagaccctaaccctagcgctcccgacgcgccgcggagcgatggcgatggacgcggagcggcggcaggcggagctgatcgcgcagttctccgctcaggcggcggcgctttcgtccgcgccccagctcgccgcgctggtgcttgaggccacctcccacccggccctcttcgccttctccgagctcctcaccctcccggccctctccaagctcactggcacgcagtacgcgtcgtcactggacttgctccggctcttcgcctacggtaccctgaatgactacnagagtaattctggattccttccagcactgttgcctgaccaggtccgaaagctaagcaagctcagcgtgctaactctggcagaggcaactaagatactaccggatgatcagctcatgaaggaggtagacgtttcaaatgtaagaggaactcgaagatttcctaatcatgggtggatggattcgggtatcggtagaggcaaactggtccagt

SEQ ID NO: 26229 - protein, 150 aa, Zea mays
  misc_feature: Ceres CLONE 1398565-F
  misc_feature (81)..(81): Xaa is any aa, unknown, or other
MAMDAERRQAELIAQFSAQAAALSSAPQLAALVLEATSHPALFAFSELLTLPALSKLTGTQYASSLDLLRLFAYGTLNDYXSNSGFLPALLPDQVRKLSKLSVLTLAEATKILPDDQLMKEVDVSNVRGTRRFPNHGWMDSGIGRGKLVQ

SEQ ID NO: 26230 - DNA, 671 bp, Zea mays
  misc_feature: Ceres CLONE 1398566-F
acccgcggtggcggccgctctatatatagtggatcccccgggctgcaggaattcgcacgagaccattacctagaacatcctaatcgaaaacccttagttgtatcctctcctcctccttggaactcccatcttccttcctcatcgaacgcttcgcccaccgaagcttaccggcatgttgctactggatttccggccaagaacggatttttttccggttacgacgaagaaggagggagatagtttgccaccagctgattcattggctctactagcgattttcactgagctcggagggatgatcgcactatcggccgccgctcgagatgcgtacgtacggacgcacccgtatcggaggggtcgctgcaagatgatgatgagcggcacatcgcaaacacatggacgcattgtccccgatgaaggagccgcgccgcgctgccaacgaggagcccgtgggatgtgctgcccgctccgcatgcatgtgatacaaatgtatccccgacctcacccgccggcgtgtggccaccatctgcgccaaggccaagttcagcgcggtctaccactatatctacatcaattcccaggcatccttcggtgagctgaagaaactggtgtcggagaagacagcgctgcacccgcacgaccccaaggtggatgacaaaggacatggagag

SEQ ID NO: 26231 - DNA, 772 bp, Zea mays
  misc_feature: Ceres CLONE 1398569-F
  misc_feature: Encodes the peptide sequence at SEQ ID NO. 26232
  misc_feature (334)..(334): n is a, c, t, g, unknown, or other
  misc_feature (339)..(339): n is a, c, t, g, unknown, or other
  misc_feature (420)..(420): n is a, c, t, g, unknown, or other
  misc_feature (510)..(510): n is a, c, t, g, unknown, or other
  misc_feature (517)..(517): n is a, c, t, g, unknown, or other
  misc_feature (535)..(535): n is a, c, t, g, unknown, or other
  misc_feature (536)..(536): n is a, c, t, g, unknown, or other
  misc_feature (540)..(540): n is a, c, t, g, unknown, or other
  misc_feature (541)..(541): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
aaagctggagctccccgcggtggcggccgctctagaactagtggatcccccgggctgcaggaattcgcacgagaccattacctagaacatcctaatcgaaaaaaaaagcagcagcagcagaccttcttgacctagcaagcaatggggccgccgttcctcgccgtcgccgtcatcgtcgccttcctggccgccgccgcgcaggccgccgaccccttcgccttcttcgactgggacgtctcctacatcaccgcctcccctctcggcgtcccgcagcaggtcatcgcagtcaacaagcagttcccaggccctatcatgaacgtcactaccaactacnatgtnggtcgtcaatgtgctcaacagcttagacgagcccctgctcatcacttggggatgggatccagcagcgcaagaattgctggncaaggatgggggttctccggcaccaccttgcccataaccgccagacgttggaactggacctaccactttcaggtcaaaggaccagatggncagcttnctctactcccacccctgnntagnncggcccccccggggnnnnnnncccggaaggatactgtcacaacccgcgggggaattccgggtccattcaacgggcccgaagggggactcacgtctttctttggggggagggggaacaggatgaccacacgccccttgagaaaaagctccacaccgcaggaaaatgggattcccaaaaaggggtttttgagtaagggcaagggcccaaaaaggataaaggacccctaggggc

SEQ ID NO: 26232 - protein, 208 aa, Zea mays
  misc_feature: Ceres CLONE 1398569-F
  misc_feature (31)..(132): Pfam Name: Cu-oxidase_3 Pfam Description: Multicopper oxidase
  misc_feature (65)..(65): Xaa is any aa, unknown, or other
  misc_feature (126)..(126): Xaa is any aa, unknown, or other
  misc_feature (132)..(132): Xaa is any aa, unknown, or other
  misc_feature (133)..(133): Xaa is any aa, unknown, or other
  misc_feature (134)..(134): Xaa is any aa, unknown, or other
  misc_feature (139)..(139): Xaa is any aa, unknown, or other
  misc_feature (140)..(140): Xaa is any aa, unknown, or other
  misc_feature (141)..(141): Xaa is any aa, unknown, or other
MGPPFLAVAVIVAFLAAAAQAADPFAFFDWDVSYITASPLGVPQQVIAVNKQFPGPIMNVTTNYXVGRQCAQQLRRAPAHHLGMGSSSARIAGQGWGFSGTTLPITARRWNWTYHFQVKGPDGQLXLLPPLXXXAPPGXXXRKDTVTTRGGIPGPFNGPEGGLTSFFGGRGNRMTTRPLRKSSTPQENGIPKKGFLSKGKGPKRIKDP

SEQ ID NO: 26233 - DNA, 712 bp, Zea mays
  misc_feature: Ceres CLONE 1398570-F
  misc_feature: Encodes the peptide sequence at SEQ ID NO. 26234
  misc_feature (308)..(308): n is a, c, t, g, unknown, or other
tccccgcggtggcggccgctctataactagtggatcccccgggctgcaggaattcgcacgagaccattacctagaacatcctaatcgaaaagatagtgagcgacgccacgggacaggcatggcgagccgcgagcggcagcacacccgcagctacgactacgactacgagcacctcgtgctcgacccggcgtctctgggcgtgccgtgggccgacccggccgccgtggagatcccgacgcagctcctcgccgcgctcggggagtacctctccggctccgcgccccgcggggacgtcgagccggaggcgnacgactagttcatgatgcacgagttcaaaggtgcgcggtgcccgcgcgctcgcacccacaactggacgggggtgcccctacgcccaacccgggcggagggcgcgcggcgccggaaccccggcccgcgtcgccctaggggggggaaccggggccgggatttccggggcccgccggggcgcccccaccggcgggtggccggggggggggaccctgggccctttggggaaaggaaactttgaggggggggtcccccccggtcccgggtaagaaaccccccccttggggggggggggacgcttttttccccccctaaaattttttttttacagaaaacgtccggggggaggtcccggcggagaaaaaaacaaaaaggcgcgggggggggccccccctcctaccacccc

SEQ ID NO: 26234 - protein, 65 aa, Zea mays
  misc_feature: Ceres CLONE 1398570-F
  misc_feature (64)..(64): Xaa is any aa, unknown, or other
MASRERQHTRSYDYDYEHLVLDPASLGVPWADPAAVEIPTQLLAALGEYLSGSAPRGDVEPEAXD

SEQ ID NO: 26235 - DNA, 624 bp, Zea mays
  misc_feature: Ceres CLONE 1398570-R
  misc_feature: SWISSPROT Homolog: EC 4.99.1.1 Ferrochelatase
cgaattgggtaccgggccccccctcgaggtcgacggtatcgataagcttttttttttttttttttgtcgagcacaagaaaccattaaaatacagagtccgtgagcacggtatttatagacaacttcgatcaaaacagctgttcacatcccttttgcaatcccctactaccttgtgagttcctagcagttatttttttctctggaacgagcagaagaactgcacatcattctattaaggaggaaaaaaaggtccaaaatgaaatatctcattctcaatctcaaatttagtgctttggagaaaaacttaaagcatggtgctccggaaggcggaaactagccttggtgatagcagcaggacaaatgccaagattgagccaaacagcatcttggtgaggtaatgcgtcaggtccatgctggaatcgatgtcgtcaggctttctggtcgcgagcgctgaagcagagggcagggcttcaacgacagcatctgcaaagtccgaagatgaaatgttgaaatgcatcccaagagccgggaaccccgaacccccgtttcttggaggcccggatttccaaaacccaaacccctggggaccccccgggggaaattttttccccaagggggccgggt

SEQ ID NO: 26236 - DNA, 665 bp, Zea mays
  misc_feature: Ceres CLONE 1398573-F
  misc_feature: Translation starting site: 150
  misc_feature: SWISSPROT Homolog: EC 4.1.2.10 Mandelonitrile lyase
  misc_feature (352)..(352): n is a, c, t, g, unknown, or other
  misc_feature (413)..(413): n is a, c, t, g, unknown, or other
  misc_feature (460)..(460): n is a, c, t, g, unknown, or other
  misc_feature (461)..(461): n is a, c, t, g, unknown, or other
  misc_feature (466)..(466): n is a, c, t, g, unknown, or other
aaagctggagctccccgcggtggcggccgctctagaactagtggatcccccgggctgcaggaattcgcacgagaccattacctagaacatcctaatcgaaaaacataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcatcgtgggcggcggcacggccgggtgcccgctgggcgccacgctgtncgagcgcttccgcgtgctgctgctggagcgcggcgcctcgccctacgacgacgaccgcatncgggacatggcccgcttcgcggacacgctgccggacacctccccggnnctcgnccgcgcagcgcttcgtgtcggaggacggcgtcatcaactcgcgcccgcgggtgctgggcggcggcaactgcatcaacgccggttcctacccgcggggcagcgaacaactacgtggggggcgtccggtgggaacctgggcgccccccggggcggccgaaccgtgggatggaagaactggtgggttcacatggctgagcgt

SEQ ID NO: 26237 - DNA, 678 bp, Zea mays
  misc_feature: Ceres CLONE 1398576-F
  misc_feature (111)..(111): n is a, c, t, g, unknown, or other
  misc_feature (216)..(216): n is a, c, t, g, unknown, or other
  misc_feature (224)..(224): n is a, c, t, g, unknown, or other
  misc_feature (252)..(252): n is a, c, t, g, unknown, or other
  misc_feature (290)..(290): n is a, c, t, g, unknown, or other
  misc_feature (291)..(291): n is a, c, t, g, unknown, or other
  misc_feature (295)..(295): n is a, c, t, g, unknown, or other
  misc_feature (296)..(296): n is a, c, t, g, unknown, or other
  misc_feature (309)..(309): n is a, c, t, g, unknown, or other
  misc_feature (310)..(310): n is a, c, t, g, unknown, or other
aaagctggagctccccgcggtggcggccgctccagaacaagtggaacccccgggctgcaggaattcgcacgagaccattacctaagaacatcctaatcgaaaaaacagcanagcccaggctgcccagcacacgcgacgcgaaccagctgccgaggaaccctagcggagcactgtgcaggcgaccgcggcgcgctatcacttacggggggatacggngggatcgntcccctcggcccctcctccatccctggntgcggcgccgccagcctgcagggtgtgaatgctgattnngtgnngctggataatggnngtgatcgccgataaatcgggattagcccgctgatcgcccttctggcgatcgaaacgataagcaatctgaaaacttggcccgccaaactccgaaggactccccgggagccgggcccccaaagccaatcacccgacccaaatttttccgggaattgtccccccccaagggtccccggggacccaattcccgggggaaagaggaaattcgggaaaaaaagggggggggggttggaccccgcccccccggggaaaatcttggtgttcccacaagagagggcccccccccccccccccccccaaaaaagagccccttttttgggcggggggggaaaaaacacccaagaggttttttttgggaagatacccccc

SEQ ID NO: 26238 - DNA, 649 bp, Zea mays
  misc_feature: Ceres CLONE 1398578-F
  misc_feature: Encodes the peptide sequence at SEQ ID NO. 26239
  misc_feature (426)..(426): n is a, c, t, g, unknown, or other
  misc_feature (532)..(532): n is a, c, t, g, unknown, or other
tggagctccccgcggtggcggccgctctagaactagtggatcccccgggctgcaggaattcgcacgagaccattacctagaacatcctaatcgaaaactcttcgtcgtcctatcttataatcgcatttcgaaatccccaaacggaggcctcgccactcttccgaacctgaacaatcaccaccgttattaagaagatgatgcgctgcgctgcaacgggcggcgggtgcgtcgcttcgtggagcggcgattggagattgccggcggtcaacccctgcagcgtgcggatgctgacgggcaacgatgggtggtgcgccggcctgaggtcgcgggcggcggatctcgcccggctcgagatggccaacctgcgcggcggcgtcggggggctcttccgcgcgagcccgcgctacgggcgcttgcaagccacgncggcagttgaccctgaagatatccatgggagaaggttcaagttaaatccctcaggacatgttctgccatatgttggcgttgcttgtttgggggcaattctgtttgnttaccaatcttggggggggcaagtggcgcacttgaaatatctcgcgaaagatcttgggaattgctgaaaatggttccttggcagggggggggggggattaacaaatccctttggggg

SEQ ID NO: 26239 - protein, 134 aa, Zea mays
  misc_feature: Ceres CLONE 1398578-F
  misc_feature (78)..(78): Xaa is any aa, unknown, or other
  misc_feature (113)..(113): Xaa is any aa, unknown, or other
MMRCAATGGGCVASWSGDWRLPAVNPCSVRMLTGNDGWCAGLRSRAADLARLEMANLRGGVGGLFRASPRYGRLQATXAVDPEDIHGRRFKLNPSGHVLPYVGVACLGAILFXYQSWGGQVAHLKYLAKDLGNC

SEQ ID NO: 26240 - DNA, 640 bp, Zea mays
  misc_feature: Ceres CLONE 1398584-F
tggagctccccgcggtggcggccgctctagaactagtggatcccccgggctgcaggaattcgcacgagaccattacctagaacatcctaatcgaaaaaatggaaccagtacctctattccattccaggctgcttcttcttgcgcgattcgacacggactcagaccctcacacgcctcctcaccggctcacgacgtcgccacctcagatccggcgaccgatcccctcctcctcggcgaggcgtagcccgcagagccgagccggacaacacagccacgaccacgaggcgtcgtcgcggagtagtcggagccgtttctgctgcccccctccttcccgcaagtttgtcaaagtacgtccgatgctccagacatagtaaaaaaccatgggagaagttagtgatgacaattccaacctgtccttttctaaaaagatcgcaacaagtgacgtaccgctgttgaaagagtatggtggaaaatggagttgccgccgctccggcttcttggtggaagtactcccggcttgggtttccatgggggttgggaaaaaaaaaaaagaaaagggcgggtggcaactatatggggggggaaaaaggaaagattttgcccagggcaaacaagaagggttttcccccccttaaaagga

SEQ ID NO: 26241 - DNA, 677 bp, Zea mays
  misc_feature: Ceres CLONE 1398586-F
  misc_feature: Encodes the peptide sequence at SEQ ID NO. 26242
  misc_feature (284)..(284): n is a, c, t, g, unknown, or other
  misc_feature (465)..(465): n is a, c, t, g, unknown, or other
  misc_feature (539)..(539): n is a, c, t, g, unknown, or other
  misc_feature (677)..(677): n is a, c, t, g, unknown, or other
ggagctccccgcggtggcggccgctctagaactagtggatcccccgggctgcaggaattcgcacgagaccattacctagaacatcctaatcgaaaacccctcgtctcgtcgccgcctacgaaaatggctgcgctcgcgacactcctccgccacagccgccgcagccatgcccacgtcctccccatctcccgtgcgctctccaccaccaccccgaccaccggcggcaccgatcccgttgccatcacgttgtcggacgccaagagacaactcctccgcgagcgcgnatccggaccgcgtggtctccatcctcgacgccatcgacacggcgtccatctccgctgcttccacccggcacgcgctctccctcgccgcgcgccgcctttctcgctcccgccgcttcgctgacgcggaggccctcctctcctcccatctcaccgcgtccaccaccgaggccaccctcgccgnccgtcctgtgctcctacgcctccgccaaccctccccgagaaggccatcgacgcgtttcgctcccactgcgccgnccccttccaacccccaactccccgctccccttcaaagccctcctctccaccttcatacgatgtcgccgctacagacgcgtccctgtcctcttcgctgagttctcccaaggaggtttccatcaccccccaatgccacan

SEQ ID NO: 26242 - protein, 156 aa, Zea mays
  misc_feature: Ceres CLONE 1398586-F
  misc_feature (40)..(40): Xaa is any aa, unknown, or other
  misc_feature (100)..(100): Xaa is any aa, unknown, or other
  misc_feature (125)..(125): Xaa is any aa, unknown, or other
MPTSSPSPVRSPPPPRPPAAPIPLPSRCRTPRDNSSASAXPDRVVSILDAIDTASISAASTRHALSLAARRLSRSRRFADAEALLSSHLTASTTEATLAXRPVLLRLRQPSPRRPSTRFAPTAPXPSNPQLPAPLQSPPLHLHTMSPLQTRPCPLR

SEQ ID NO: 26243 - DNA, 624 bp, Zea mays
  misc_feature: Ceres CLONE 1398589-F
  misc_feature: Translation starting site: 146
tccccgcggtggcggccgctctagaactagtggatcccccgggctgcaggaattcgcacgagaccattacctagaacatcctaatcaaaaaaaaacgcaaaacacgagcgagcacaaaaaaaaaatcccaatatccgcaacggcaatgtctccgctgccccgcatcgtgctcctcgccgtcgccgccgccgccggcgcagcgatcacggcgtcagccacgtcgctcagcggtgcggggaacgacctactccccaagtacggcctcccgaaggagctcatcccggactccgtcgcctccatacagcttcgacgaggccacggccgccttcgagatccacctcgccggcacctgctacgtacacttcggctcccacctcgtctactacgacaggaccataaccggaaaagctctccgaggacgccatctcggacctctccggcgtccaggccaagaagctcttcctctggatctacgtcacggtgatggtcgcgcaccccgaccagggcaacatcgagttcaaggccggcttcatctcggaatcgatatcggcctcaatgtttgaccatacgcccacctgtggctcccagctgtggggcgcaacctgagcggagggtctgcaacag

SEQ ID NO: 26244 - DNA, 625 bp, Zea mays
  misc_feature: Ceres CLONE 1398597-F
  misc_feature: Encodes the peptide sequence at SEQ ID NO. 26245
  misc_feature (250)..(250): n is a, c, t, g, unknown, or other
  misc_feature (276)..(276): n is a, c, t, g, unknown, or other
  misc_feature (307)..(307): n is a, c, t, g, unknown, or other
  misc_feature (361)..(361): n is a, c, t, g, unknown, or other
  misc_feature (364)..(364): n is a, c, t, g, unknown, or other
  misc_feature (365)..(365): n is a, c, t, g, unknown, or other
  misc_feature (380)..(380): n is a, c, t, g, unknown, or other
  misc_feature (395)..(395): n is a, c, t, g, unknown, or other
tccccgcggtggcggccgctctagaactagtggatcccccgggctgcaggaattcgcacgagaccattacctagaacatcctaatcgaaaaatctctctcgctttctctagccatgacgctggtgaggatgccttgccgcctctgctgcttcctgctcgtcgtcgccgcctccgccgtctccgggcgggggcgggtggtcaccaccctcccgggctacgagggccgcctccccttccactcgaaacaggntatgtggaggtggacgaggacgccgncgcggagctcttctactacttcgtccggggncgagtccggcgccgacgacagcgacaaccccgttcgtccctccggatccccggnggnncaacggctgctccgncttcagcggcctcgnctagaaaaaaaagggaaggccccattcatggtttggccggggaagcccataaaaggggaggtttgcccgggccccttaaaaaccaaaaattgggggaaaaaaggggggggaaaattttttttttggggatccacccagggggggggggcggggttttttttcttcccccaaaaagggcccaaggggtataaacccggtggggagggggtttaacccccccggagggggtc

SEQ ID NO: 26245 - protein, 164 aa, Zea mays
  misc_feature: Ceres CLONE 1398597-F
  misc_feature (46)..(46): Xaa is any aa, unknown, or other
  misc_feature (55)..(55): Xaa is any aa, unknown, or other
  misc_feature (65)..(65): Xaa is any aa, unknown, or other
  misc_feature (83)..(83): Xaa is any aa, unknown, or other
  misc_feature (84)..(84): Xaa is any aa, unknown, or other
MTLVRMPCRLCCFLLVVAASAVSGRGRVVTTLPGYEGRLPFHSKQXMWRWTRTPXRSSSTTSSGXESGADDSDNPVRPSGSPXXQRLLRLQRPRLEKKGKAPFMVWPGKPIKGEVCPGPLKTKNWGKKGGGKFFFWGSTQGGGAGFFFFPQKGPKGYKPGGEGV

SEQ ID NO: 26246 - DNA, 719 bp, Zea mays
  misc_feature: Ceres CLONE 1398604-F
  misc_feature (558)..(558): n is a, c, t, g, unknown, or other
  misc_feature (701)..(701): n is a, c, t, g, unknown, or other
atagctggagctccccgcggtggcggccgctctagaactagtggatcccccgggctgcaggaattcgcacgagaccattacctgaacatcctaatcgaaaaacactacatcccacctacctcctcgcatcaggaaggcggacctcgcgattataagccacccttcctctcctccacggacctcgccctgaaaaggacagacacaaaccacgagcgcgaggcacgacctacatcgagtcggccacaaaccagcatgagaggctcacgcacgctcctccccggaccacattagtaaccgagcgagagcttagagaagaatgaacgcgacacgtaacatcaatctaagggctcagtgttattgttttagtaataacaacagtatctgaaatatggggaattggtctttccatctccatctccctgtcatcgtactactaggtactagctacaatttcaaattgtttgtgcttttctatttgattccatgagatttttgtttttatatgcaactgattttgtgaggatttaatccaagctgggaggatgagtctaccaaggnttttgacccactgccaccaatcatattttttgggaatccaacccccggagtggtttggtaggggaaaattccccaaaaaggacccccaagttgggaagttaccacgggatactttgaaaaaaaaaacctaaagggcaaggggnaaggggaaataccaactt

SEQ ID NO: 26247 - DNA, 591 bp, Zea mays
  misc_feature: Ceres CLONE 1398608-F
  misc_feature (197)..(197): n is a, c, t, g, unknown, or other
aagctggagctccccgcggtggcggccgctctagaatagtggatcccccgggctgcaggaattcgcacgagaccattacctagaacatcctaaatcgaaaaaaaagcagcagcagcagaccttcttgaccctagcagcaatggggccgccgttcctcgccgtcgccgtcatcgtcgccttcctggccgccgccgggnaggccgccaaccccttcgcctcttcggatgggaggttcctaaatcaccgcctccctctcggggtcccgaagaagggatcccagtcaaaaagagttcccaggccctataaggaaaggccctcccactaaaatggggggcccaagggggtcccaaagtttaaaaaaaccccccggttcctccttgggggggggaccccccccccccaaaaattttgtgggggaggggggttccctggaaccccccgcccccaaacccccggggggggaggggggcgccccacctcccccgggaaaagacccaaaagggggttttttttttttttccccccccccttgttttaaaacccccccgccgccgggggggcttccaaatatcttttttttaaacccccccc

SEQ ID NO: 26248 - DNA, 706 bp, Zea mays
  misc_feature: Ceres CLONE 1398614-F
  misc_feature: Encodes the peptide sequence at SEQ ID NO. 26249
  misc_feature (423)..(423): n is a, c, t, g, unknown, or other
  misc_feature (425)..(425): n is a, c, t, g, unknown, or other
  misc_feature (537)..(537): n is a, c, t, g, unknown, or other
  misc_feature (538)..(538): n is a, c, t, g, unknown, or other
  misc_feature (543)..(543): n is a, c, t, g, unknown, or other
  misc_feature (556)..(556): n is a, c, t, g, unknown, or other
  misc_feature (557)..(557): n is a, c, t, g, unknown, or other
  misc_feature (561)..(561): n is a, c, t, g, unknown, or other
  misc_feature (562)..(562): n is a, c, t, g, unknown, or other
aagctggagctccccgcggtggcggccgctctagaactagtggatcccccgggctgcaggaattcgcacgagaccattacctagaacatccttaatcgaaaaacaagtaaagcagcagcagcagaccttcttgacctagcaagcaatggggccgccgttcctcgccgtcgccgtcatcgtcgccttcctggccgccgccgcgcaggccgccgaccccttcgccttcttcgactgggacgtctcctacatcaccgcctcccctctcggcgtcccgcagcaggtcattgcagtcaacaagcagttcccaggccctatcatgaacgtcactaccaactaataatgtggtcgtcaatgtgctcaacagcttagacgagcccctgctcatcactttggggatgggatccagcagcgcaagaattgtgncnaaggatgggggttctcggcaccacctgccccataccgaccaggttggaactggacctacaacttccaggtcgaggaccagattggcagcttcttctacttcccaccccttgnnatgancgtgccccccggnngggnntcccgaagggatccctgtccgccaaccgggcgggcaatctcggtcccctttcgatacgccccgaagggggacatcacgctcctccttcgggggaactggtaaccagatggacccaacacgcaccctgaagaaaaatgctcgaac

SEQ ID NO: 26249 - protein, 63 aa, Zea mays
  misc_feature: Ceres CLONE 1398614-F
MGPPFLAVAVIVAFLAAAAQAADPFAFFDWDVSYITASPLGVPQQVIAVNKQFPGPIMNVTTN

SEQ ID NO: 26250 - DNA, 726 bp, Zea mays
  misc_feature: Ceres CLONE 1398615-F
  misc_feature: Encodes the peptide sequence at SEQ ID NO. 26251
ggagctccccgcggtggcggccgctctagaactagtggatcccccgggctgcaggaattcgcacgagaccattacctagaacatcctaatcgaaaagcaacccccgcctgcagcacgcgtcacgccacgccacctctccccagggtccggcgatgtcggcgccctccgacgccgcggtggcagccgcagcgcccgcatccacgaccaccgccgccgcctccagcggtgggctcaccttcaagctccacccgctcgtcatcgtgaacgtctccgaccaccacacccgcgtcaaggcccaggccgcctggctccggggacagctcttccccctcctcgtccgccccgggggccgggcagccgccgaggggtgttcggggtgcgatgatcgggggtgcagtcttcctggatctgcttcgtgctcaactacttttacggggaagcgggaaaaaacgagaccatcgcggctggcctgggcccaccaaggtctgccacgagggaactccttcttccaaaaaaacttccagcctttcttggcacaggcggaagcgaagggacacgccccctcctgtctatgggaaggggtaggcatcggggccgcacttcctactctcagtaagcaaactgctctcggacccgcacatgcccccccctccacggtaaccttgtatgctgcttcactgaccatctttatctacacgtgcctcgttcctttaatacctcctcccc

SEQ ID NO: 26251 - protein, 191 aa, Zea mays
  misc_feature: Ceres CLONE 1398615-F
MSAPSDAAVAAAAPASTTTAAASSGGLTFKLHPLVIVNVSDHHTRVKAQAAWLRGQLFPLLVRPGGRAAAEGCSGCDDRGCSLPGSASCSTTFTGKREKTRPSRLAWAHQGLPRGNSFFQKNFQPFLAQAEAKGHAPSCLWEGVGIGAALPTLSKQTALGPAHAPPSTVTLYAASLTIFIYTCLVPLIPPP

SEQ ID NO: 26252 - DNA, 707 bp, Zea mays
  misc_feature: Ceres CLONE 1398616-F
  misc_feature: Encodes the peptide sequence at SEQ ID NO. 26253
  misc_feature (281)..(281): n is a, c, t, g, unknown, or other
  misc_feature (369)..(369): n is a, c, t, g, unknown, or other
  misc_feature (386)..(386): n is a, c, t, g, unknown, or other
  misc_feature (424)..(424): n is a, c, t, g, unknown, or other
  misc_feature (425)..(425): n is a, c, t, g, unknown, or other
  misc_feature (445)..(445): n is a, c, t, g, unknown, or other
  misc_feature (457)..(457): n is a, c, t, g, unknown, or other
  misc_feature (463)..(463): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (638)..(638): n is a, c, t, g, unknown, or other
tggagctccccgcggtggcggccgctctagaactagtggatcccccgggctgcaggaattcgcacgagaccattacctagaacatcctaatcgaaaagaagccacagcagctgcaagcttttgcttcgtccgtccgtccgcccgcccgtccccgcatcattcccgaagtcccagcatggatttggaggggccgtgggcgcggttgctgcacctgcacgatgcgtgcgagtggggccgtgcggtgcgtgcgcgcgcggtggcgccggcgctggaggccgcgncgtgggcgtgcctcgccatgtcggtcatgctcgtgctcgaggtgtgctacatgagcgtctccagcttcgtcgccgtcaacctgctgcngcggaccccacagcggnggtacagctgagagcccatgcccctcggaccgcccggnnggacgatgaggaggcagcgntgggcgatgggnagcgcnagcgtacccgatggtactcgtgcagatcccatgacacnnnagaggaggtctacagatctctattgggaggggatgtgccttcactggccgcccgacgtattataatcaaggtattggatgatccaccggaccatcataaggaactttggggagtttgaatgcagggattggccancaagaaaatcacataaatatgaaatccggaaaaggaggagggaatcaaagcggagccctgaaaaagggt

SEQ ID NO: 26253 - protein, 73 aa, Zea mays
  misc_feature: Ceres CLONE 1398616-F
  misc_feature (36)..(36): Xaa is any aa, unknown, or other
  misc_feature (65)..(65): Xaa is any aa, unknown, or other
  misc_feature (71)..(71): Xaa is any aa, unknown, or other
MDLEGPWARLLHLHDACEWGRAVRARAVAPALEAAXWACLAMSVMLVLEVCYMSVSSFVAVNLLXRTPQRXYS

SEQ ID NO: 26254 - DNA, 749 bp, Zea mays
  misc_feature: Ceres CLONE 1398618-F
  misc_feature: Encodes the peptide sequence at SEQ ID NO. 26255
  misc_feature (463)..(463): n is a, c, t, g, unknown, or other
  misc_feature (637)..(637): n is a, c, t, g, unknown, or other
aagctggagctccccgcggtggcggccgctctagaactagtggatcccccgggctgcaggaattcgcacgagaccattacctagaatatcctaatcaaaaaactggtaatccttgtcaagtgtcaacccaaccgtccacggtccgccctcctccttcgttcacgtcttcctcctcgcgttcctctcgtcagtacggcgacgccgcagggctcgcaccgctgacagtcccccttcccggatcgagcctctcttttcccagatcggattctaattgggctatcgccgccgccgtgccaggtgccgagtccttagccgatcttcgccggcgaggagcgcccaccaggagttacagactgaatgacaagaatgttctctatatcatcctcagtatgtgtgaagaaatagtctgtaactacacatacctttcattgcaattaccaagaactggaaatggacgatgatnatgggcttgagcttagtttgggcctatcttttgggcggtcatcagggaaggccaaggctagagatgcacctctagaaccaaaagcagaacccccagtggaagaaagcagtagcaaaggtggtttacaaactcctgatgctccttctgggaaaatttatcaaaagagcgctgatnacatgaacaaatagtaaacagaggcacagccctgttgcacacattttgggacttctgggggacacagggaatccctccgtcaggggtaaatggttctgttgaaacggtgagt

SEQ ID NO: 26255 - protein, 66 aa, Zea mays
  misc_feature: Ceres CLONE 1398618-F
  misc_feature (5)..(5): Xaa is any aa, unknown, or other
  misc_feature (63)..(63): Xaa is any aa, unknown, or other
MDDDXGLELSLGLSFGRSSGKAKARDAPLEPKAEPPVEESSSKGGLQTPDAPSGKIYQKSADXMNK

SEQ ID NO: 26256 - DNA, 655 bp, Zea mays
  misc_feature: Ceres CLONE 1398621-F
  misc_feature: Encodes the peptide sequence at SEQ ID NO. 26257
  misc_feature (479)..(479): n is a, c, t, g, unknown, or other
ggagctccccgcggtggcggccgctctagaactagtggatcccccgggctgcaggaattcgcacgagaccattacctagaacatcctaatcgaaaaaaacccgaaacccactagtaccgccacacgaattcccgaccccgatggcgacatcgccaccgcagaaccctagctccggcgagccctccgatgcgtcgagcctcgcagccgcggcgctcgaggcgcccgtgcgcgtatggagatccctcgtcgcgcgcttccctcccctcccggactcctccagcttccttgctggcgtctccgacctccagctccgctacttcggcaacagccggccccgcccgcgcaggcgctccgctctacctctccctctccgcccggtgggcgcgcactctgctcggattgctggtgagatgcccaaagcctttgtgatcttagatgatgttgtgcacacaccctgactaatttggacagtattcacnaaagctactatttttggcaggcccaggctgaggaaacaaattctccaaaaggggactttatgatatttggaaaaaggccaagggccctttgtggatggaaatatcaaaactttcctaaacccgggaagcatgggacccccgtgcccaaaacttttgggattcggccccccgaaagg

SEQ ID NO: 26257 - protein, 105 aa, Zea mays
  misc_feature: Ceres CLONE 1398621-F
MATSPPQNPSSGEPSDASSLAAAALEAPVRVWRSLVARFPPLPDSSSFLAGVSDLQLRYFGNSRPRPRRRSALPLPLRPVGAHSARIAGEMPKAFVILDDVVHTP

SEQ ID NO: 26258 - DNA, 698 bp, Zea mays
  misc_feature: Ceres CLONE 1398624-F
  misc_feature: Translation starting site: 234
  misc_feature (366)..(366): n is a, c, t, g, unknown, or other
tggagctccccgcggtggcggccgctctagaactagtggatcccccgggctgcaggaattcgcacgagaccattacctagaacatcctaatcgaaaaactacaacatctgtcaccgtgaaatctcggctacctccttctgacttctggtacctcgccgccggggacccaactccgatccccaccccaccataccaaagccaccgcggctgcggctgcggcttccgcatcatcaatggtgctgatcactctcgtccgcgactacatcgaccgcatgctccacgacatccctggcatgaaggtcctcgtcctcgacccccaaaccgttgggatggtgagcgtggtgtacagccagtcggatctgctgncggaaggaggtcttcctcgtcgagaccatggacaacgcctccagctccagggagtccatggcgcaccctcaaggccgtctacttcctccgaccctccgctaacaacgtccagaagctccgcaggcacctcgccatgccgcgcttcgccgagtaccacctattcttctccgggaaaatatggaaggcccccgcagattcaaaatacttgcttgactcggatgaaccagggaggttcgccccccaccggttcaggagctccccacgcctgtattttctgggaccccttcgaccccatacatatgaccccgcccaaaagattacagaaaacaccg

SEQ ID NO: 26259 - DNA, 657 bp, Zea mays
  misc_feature: Ceres CLONE 1398625-F
  misc_feature: Encodes the peptide sequence at SEQ ID NO. 26260
tccccgcggtggcggccgctctagaactagtggatcccccgggctgcaggaattcgcacgagaccattacctagaacatcctaatcgaaaaacttggcgctagggtttcccccctctcatttcccctcctcctcccgctccccctggctccccaagcctcgacgcccggctagggttttgcctccttcccgccgccgctgtttcagcgagcgagaccgaggggtagagaaagagcggtgcttagccacccatgtcctgcgtccgagcgagcgggtcgaggtacggcggaaccgctacaaggtggcggttcacgcgtaagaggggcggcggcggcgcgaggacaatatggtggagatccgcaagagcccgcgtgaggagacgctcctccaggaggcgcgtgaggggctcccagcccaggtccctgcccctcccttcgggggccaaaaaaaagcttgaaacctcccacctagggttaggggggttttatccgaagaaaaaaaaccttcagttggggcccccaaacaggtcccaaaattgttttttaaaaaaaggggcgcccccctcgaaaaaggttttaaaacgggggggagtccacaaattgggggccccctccccacaaagggttccccccccgctgcatttaaaacttgggggccc

SEQ ID NO: 26260 - protein, 36 aa, Zea mays
  misc_feature: Ceres CLONE 1398625-F
MVEIRKSPREETLLQEAREGLPAQVPAPPFGGQKKA

SEQ ID NO: 26261 - DNA, 762 bp, Zea mays
  misc_feature: Ceres CLONE 1398627-F
  misc_feature: Encodes the peptide sequence at SEQ ID NO. 26262
  misc_feature (411)..(411): n is a, c, t, g, unknown, or other
  misc_feature (421)..(421): n is a, c, t, g, unknown, or other
  misc_feature (428)..(428): n is a, c, t, g, unknown, or other
  misc_feature (429)..(429): n is a, c, t, g, unknown, or other
  misc_feature (466)..(466): n is a, c, t, g, unknown, or other
  misc_feature (467)..(467): n is a, c, t, g, unknown, or other
  misc_feature (495)..(495): n is a, c, t, g, unknown, or other
  misc_feature (525)..(525): n is a, c, t, g, unknown, or other
  misc_feature (531)..(531): n is a, c, t, g, unknown, or other
  misc_feature (532)..(532): n is a, c, t, g, unknown, or other
  misc_feature (676)..(676): n is a, c, t, g, unknown, or other
tggagctccccgcggtggcggccgctctagaactagtggatcccccgggctgcaggaattcgcacgagaccattacctagaacatcctaatcgaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcantcgtgctggntgtgcgnncgccgagctgggcagcctcagccgcgacgagctgtgnncgcagggtgggtgggggggagggcaccntacgacccctcgccaccgtgctcgcccttncctcgnnccgtctcgccttccaccatctcccgtctacatcatggtcaggccccaggcccgtgtacctcatccgacttcgcatgctacaggccggcgacggaggtcaagtggccccaaggcggaggtcatcgacctggcgcgcaagtccggnaaggttcgacaggaaagcctgggggttccagtccggtctggtgggcaatcgcgggtttcggggaaaatcgacagggcggggggtgg

SEQ ID NO: 26262 - protein, 186 aa, Zea mays
  misc_feature: Ceres CLONE 1398627-F
  misc_feature: SWISSPROT Homolog: EC 2.3.1.119 Icosanoyl-CoA synthase
  misc_feature (70)..(70): Xaa is any aa, unknown, or other
  misc_feature (76)..(76): Xaa is any aa, unknown, or other
  misc_feature (88)..(88): Xaa is any aa, unknown, or other
  misc_feature (89)..(89): Xaa is any aa, unknown, or other
  misc_feature (98)..(98): Xaa is any aa, unknown, or other
  misc_feature (108)..(108): Xaa is any aa, unknown, or other
  misc_feature (110)..(110): Xaa is any aa, unknown, or other
MAREEQALLSTEIVNRGVEPSGPDAGSPAFSVRVRRRLPDFLQSVNLKYVRLGYHYLISHGVYLATIPVXRAGCAXAELGSLSRDELXXQGGWGGGHXTTPRHRARPXLXPSRLPPSPVYIMVRPQARVPHPTSHATGRRRRSSGPKAEVIDLARKSGKVRQESLGVPVRSGGQSRVSGKIDRAGG

SEQ ID NO: 26263 - DNA, 685 bp, Zea mays
  misc_feature: Ceres CLONE 1398630-F
  misc_feature (685)..(685): n is a, c, t, g, unknown, or other
cgcggtggcggccgctctagaactagtggatcccccgggctgcaggaattcgcacgagaccattacctagaacatcctaatcaaaaagcaattgtttccaggtaatctcgcatcagcaaacagcaccgggctccgttcaccgccttgccttctcttctccggttcctcccccgcgcgttcgctcgctctcgtggcgcaactcgtagaccgccgccgcctccgctctacgccaggtgcctaggtctagcttcgtcggtcccttcgccaacgacgagcacccacccgaagttcagctaggagtgcatcttgtttacctgttgcttaatcatggacaactctcagaatcaacccaccaccacctggtgttggaacatggccgcaggcacctcctagtcacccgccacaatgccatgctgatccacagtcttatcatccacaatttgctgctagacctgacaatgctagtgcaataaataagtggtagttcagcaaacattggagtcagctgtcccaggaaggctgttcttcacgcgcaggacattgaggactcagcaagtcatacagaatcaaagacatgcaaacacaacaagtgaacctacaaattattggggaaagacttacttttcgaacccgccgtgaccctaaaggcattggaagaaccatttactaaagaagacagctgatn

SEQ ID NO: 26264 - DNA, 746 bp, Zea mays
  misc_feature: Ceres CLONE 1398631-F
  misc_feature: Encodes the peptide sequence at SEQ ID NO. 26265
  misc_feature (197)..(197): n is a, c, t, g, unknown, or other
  misc_feature (444)..(444): n is a, c, t, g, unknown, or other
tggagctccccgcggtggcggccgctctagaactagtggatcccccgggctgcaggaattcgcacgagaccattacctagaacatcctaatcgaaaagctcaattccactgccaagattcgccactccgtccgttaccttcactcgctcactcacaatgcggcgccatggcgaggtacgcgtgatcttagctatggncgccgccgccgccgccgcgctcttggcgtcggcggccgtggccggacgagacggccggcagacctacatcgtccacatgtcccattccgccatgccggacgagttcgcggagcatgaggaatggtacgccgcgtcgcttcaggcgggtgtcggatgcccgcaccgtgctgtacacctacagcaccctcctcccggctactcccgcgcggctgacgccgcgcgaaggccgccggcgctggagtccagnccagggggtgatcgtcgccaaaccggggaggtggcgttacgagctgcacacccacccggacgcccgagtttcctgggggctggacggcacgggacgcgttggtccccgcagtcgggcacccgggaacccaacgtcttttttttgggggtggctcaaaaacccgggttttgggcccggaaaagcccaaattaaaaaggaccccggttttccgccccggtgcccggggggcttggaaaagggaaaagggcggaggaacggaaaaaaatttcaaacgccccccgcggggaaaaaaaaaagcctct

SEQ ID NO: 26265 - protein, 159 aa, Zea mays
  misc_feature: Ceres CLONE 1398631-F
  misc_feature (14)..(14): Xaa is any aa, unknown, or other
  misc_feature (96)..(96): Xaa is any aa, unknown, or other
MRRHGEVRVILAMXAAAAAALLASAAVAGRDGRQTYIVHMSHSAMPDEFAEHEEWYAASLQAGVGCPHRAVHLQHPPPGYSRAADAARRPPALESXPGGDRRQTGEVALRAAHPPGRPSFLGAGRHGTRWSPQSGTREPNVFFLGVAQKPGFWARKSPN

SEQ ID NO: 26266 - DNA, 624 bp, Zea mays
  misc_feature: Ceres CLONE 1398632-F
gctctagaactagtggatcccccgggctgcaggaattcgcacgagaccattacctagaacatcctaatcaaaaaacacgcgcgcacgtaaaaacgaaaaaaggtccccggccgagaccgagagccgcggtccagagcggggggcggccggcaaggacgaaacggcccaacgccaccacctccaccacctcgtcctcgatcgacacctcccccgtcgccgtcccgtgactccccgtccagccgtccaggcccagctgcccccgcgacccagacgaccacgtccgcctcggcctgcgcctccccgctacaagagtccgtccgcccgcccagcgctgcggtgccagcgagcccctccctcctccactctctgggggcgcggagatcccgtcctttctctgtgcccccggtaccgcgaggagccactgccaggcgcccggcgtttttggaactgggcatggaggcgggcggcggcggcttcggcggcgggtcggggggttcgggcgctggactgaccaggtggcagcgggcgcgcctttgggggcggtggccggcttgggtggggggccggtcttccttctacgacctcaggcgccgggggggcgcgttccgtcaagccgtgggtcac

SEQ ID NO: 26267 - DNA, 744 bp, Zea mays
  misc_feature: Ceres CLONE 1398633-F
  misc_feature: Encodes the peptide sequence at SEQ ID NO. 26268
  misc_feature (18)..(18): n is a, c, t, g, unknown, or other
  misc_feature (36)..(36): n is a, c, t, g, unknown, or other
  misc_feature (46)..(46): n is a, c, t, g, unknown, or other
  misc_feature (47)..(47): n is a, c, t, g, unknown, or other
ggccccccccccctcccncccccgtgctgtgtgtgncgctcgcgcnnaaaaactggagctccccgcggtggcggccgctctagaactagtggatcccccgggctgcaggaattcgcacgagaccattacctagaacatcctaatcgaaaaatcgatctattctcgtctgaagcaattcgcccctgtcgtgagcagaatcctacagctcgtattcgcctcatctcgcagcagcagcagaagaacaagggtatggcgaaggatgggggtcccgactggaacggcctgctcaagtggagcctcgcccacggcgacagcaccaacccgccgcgtgctctcagcgaggaagacagaaaatggttcatggatgctatgcaagccaacacggtagatgttgtgaagaggatgaaggagattactcaggtgatgaaaacaccagaagatgtcttgcagtctcagggtgtgaccccggagaacattgaagatatgttggatgagctacaggagcatgttgaatccattgacatggcaaatgatctacattctattgggtgggctgaatcctctacttagttacttgaaaaattcaaatgctggcatccgagcaaaggcaagcagaagttgttagtacaattgggcagaataatcccaagagtcagcaacttgtcatggaaatccatggactagagccactggttgacgaacttcaattcagatccaaggaacaaattgcccgcacaaaaagct

SEQ ID NO: 26268 - protein, 106 aa, Zea mays
  misc_feature: Ceres CLONE 1398633-F
MAKDGGPDWNGLLKWSLAHGDSTNPPRALSEEDRKWFMDAMQANTVDVVKRMKEITQVMKTPEDVLQSQGVTPENIEDMLDELQEHVESIDMANDLHSIGWAESST

SEQ ID NO: 26269 - DNA, 675 bp, Zea mays
  misc_feature: Ceres CLONE 1398634-F
  misc_feature: Encodes the peptide sequence at SEQ ID NO. 26270
  misc_feature (259)..(259): n is a, c, t, g, unknown, or other
  misc_feature (323)..(323): n is a, c, t, g, unknown, or other
  misc_feature (419)..(419): n is a, c, t, g, unknown, or other
  misc_feature (445)..(445): n is a, c, t, g, unknown, or other
  misc_feature (447)..(447): n is a, c, t, g, unknown, or other
  misc_feature (463)..(463): n is a, c, t, g, unknown, or other
  misc_feature (489)..(489): n is a, c, t, g, unknown, or other
tcagaactagtggatcccccgggctgcaggaattcgcacgagaccattacctagaacatcctaatcaaaaagaggcaaagccgttagccaatctgctgttgcgtgttgcaccgatcaacgtcggttcccagcgcttgctcgtcaagcgtgtcctgctgctgttctctgctcctgcttgccgcgagagctcctctcgctcatctacccaaggtccgacagcaacgacttcgtcgagctgctatgggagaacgccagcggntggtgcacggaaggaggaagcagcatccccaggccgccttcccgcccttcacctgcggcgcggncagcagcagtagagctcaagaaaaccagccgggactaccgacccgggtctcgctggtcaaagacgggaggcctcttcgccgaccttctcgtccggnctagacgccgcccggggggcacggtngnaccttgacgacaccgntgccctggatcactgcccccatcggncgaaggaagaaagcgccgcacccgcacttggcccttgggggagggctaccagcccagatttccttctcggagctcaatgcagcggcgttaagaaacggcgggggggaaaagacaaacctcagccctcttggcaccaccggtccagcacacaaaaaaccgcccccgtttgccaccacccagcagaga

SEQ ID NO: 26270 - protein, 59 aa, Zea mays
  misc_feature: Ceres CLONE 1398634-F
  misc_feature (7)..(7): Xaa is any aa, unknown, or other
  misc_feature (28)..(28): Xaa is any aa, unknown, or other
MGERQRXVHGRRKQHPQAAFPPFTCGAXSSSRAQENQPGLPTRVSLVKDGRPLRRPSRP

SEQ ID NO: 26271 - DNA, 685 bp, Zea mays
  misc_feature: Ceres CLONE 1398637-F
  misc_feature: Encodes the peptide sequence at SEQ ID NO. 26272
  misc_feature (162)..(162): n is a, c, t, g, unknown, or other
  misc_feature (204)..(204): n is a, c, t, g, unknown, or other
  misc_feature (208)..(208): n is a, c, t, g, unknown, or other
  misc_feature (210)..(210): n is a, c, t, g, unknown, or other
  misc_feature (215)..(215): n is a, c, t, g, unknown, or other
  misc_feature (216)..(216): n is a, c, t, g, unknown, or other
  misc_feature (229)..(229): n is a, c, t, g, unknown, or other
  misc_feature (244)..(244): n is a, c, t, g, unknown, or other
  misc_feature (310)..(310): n is a, c, t, g, unknown, or other
tccccgcggtggcggccgctctagaatagtggatcccccgggctgcaggaattcgcacgagaccattacctagaacatcctaatcgaaaagccgcttccaaatcccaataataccatcgcgtaaatccagatatcagggcagctgggactgaaggtggcggnagccgagtgatcccggcgtgagctgagcggggcggaatggcngcgnancaggnncggtcgctggcgnaaaacgccacctggntcgtggcaaccgtcaccacgctcatggtccgctgctgcttcctcggcgagggctccctctcggcgntcggccaggggctgcgcaagacaaagcggaaggccatgctcccccggctccaaaaaaacccggaaagctgaggtggttcgaggctttcccctggtggtcacccaaagggcgcgttaaaatggggaattggggggggggcctggttttttccagggggttttaattgtgttccgaaaggaaaaaccgggccttgtgggggaaaagggagccccacccaaaggggctcgaaaaaaaatttttttcgggggccacggtttacctttttgggggggggccctaaaactttttttttttcaaaagggcctttgaaaattcccccccgtttccttccccctgggaccacccgggggggggaggggatttttacaagcggcg

SEQ ID NO: 26272 - protein, 60 aa, Zea mays
  misc_feature: Ceres CLONE 1398637-F
  misc_feature (4)..(4): Xaa is any aa, unknown, or other
  misc_feature (6)..(6): Xaa is any aa, unknown, or other
  misc_feature (11)..(11): Xaa is any aa, unknown, or other
  misc_feature (16)..(16): Xaa is any aa, unknown, or other
  misc_feature (38)..(38): Xaa is any aa, unknown, or other
MAAXQXRSLAXNATWXVATVTTLMVRCCFLGEGSLSAXGQGLRKTKRKAMLPRLQKNPES

SEQ ID NO: 26273 - DNA, 756 bp, Zea mays
  misc_feature: Ceres CLONE 1398638-F
  misc_feature: Translation starting site: 198
  misc_feature (203)..(203): n is a, c, t, g, unknown, or other
  misc_feature (300)..(300): n is a, c, t, g, unknown, or other
  misc_feature (410)..(410): n is a, c, t, g, unknown, or other
  misc_feature (433)..(433): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (447)..(447): n is a, c, t, g, unknown, or other
  misc_feature (448)..(448): n is a, c, t, g, unknown, or other
  misc_feature (453)..(453): n is a, c, t, g, unknown, or other
  misc_feature (478)..(478): n is a, c, t, g, unknown, or other
  misc_feature (479)..(479): n is a, c, t, g, unknown, or other
  misc_feature (496)..(496): n is a, c, t, g, unknown, or other
  misc_feature (516)..(516): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (534)..(534): n is a, c, t, g, unknown, or other
  misc_feature (547)..(547): n is a, c, t, g, unknown, or other
  misc_feature (551)..(551): n is a, c, t, g, unknown, or other
  misc_feature (552)..(552): n is a, c, t, g, unknown, or other
  misc_feature (619)..(619): n is a, c, t, g, unknown, or other
  misc_feature (620)..(620): n is a, c, t, g, unknown, or other
  misc_feature (625)..(625): n is a, c, t, g, unknown, or other
  misc_feature (627)..(627): n is a, c, t, g, unknown, or other
  misc_feature (628)..(628): n is a, c, t, g, unknown, or other
aagctggagctccccgcggtggcggccgctctagaactagtgcatcccccgggctgcaggaattcgcacgagaccattacctagaacatcctaatcgaaaatccaaagtttcgtccaccatttggctcccgcaagcaccgatttgtttactgctctctccgacgcgcggcggcggagctccctacgacaactgaaccatgtgncggcggcgcgatccttgccacaccttcgcgagccggcgccgcgccggcttcacagagcgggacatctggcagcagaagaagaagctcaagaggggcnggcggcggcgggaggcgctccgttcgcgcgcggaggacgatgaaggacttcgaggcccgcaactttgtgaggtcttcgcggcagactctcaggtgaatcagatatggagncctccaggggaggggaacgtganacgacaacnnnctnncccgncgaagaacaagtcctcacttctggnncccagagatttattttnctcccgcggaatgcgtagancatggnnnataggggggntctgtaagcagtncagnnccaaagagaggaagagaagaatccctaatacaggggtattccgcagaagccttggggggccagtggnnctgcntnnaaatcagatccccccaaaaggggggggccccgggggtttggccttggaaacctttccaaaagccctggagggaacctgcaagaagcttaatgatgctgaaaccgccccaagaattccggggcaaaaaa

SEQ ID NO: 26274 - DNA, 764 bp, Zea mays
  misc_feature: Ceres CLONE 1398642-F
  misc_feature: Encodes the peptide sequence at SEQ ID NO. 26275
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (39)..(39): n is a, c, t, g, unknown, or other
  misc_feature (40)..(40): n is a, c, t, g, unknown, or other
  misc_feature (44)..(44): n is a, c, t, g, unknown, or other
  misc_feature (56)..(56): n is a, c, t, g, unknown, or other
nnnnnnnnnnnnnnnnnnnttttcgagggccgaacgagnnagantaccgctttttnttcatactggagctccccgcggtggcggccgctctagaactagtggatcccccgggctgcaggaattcgcacgagaccattacctagaacatcctaatcgaaaaatcaactcgcaattccgcattcgttccaactcctgagcactttctcctcgtccccgacaagccaatcgaagccgagatacggccatggactccaccggcaccggagcagggggtaaggggaagaagggagcggccgggcgcaaggtcggcgggccaaggaagaagtcggtgtcgaggtccgtgaaggccgggctccagttccccgtcggccgcatcgggcgctacttgaagaagggccgctacgcgcagcgtgtcggcaccggcgcccccgtctacctcgccgctgtcctcaaatacttcgccgctgagggtcctggagcctcgctggtaatgcctgccacgggacaacaaaaaaaactccgcattaattccgcggccacggggctttctggggaatccgggaacggacaagggagcctggggaaagctgcttggggcggcagtgacccattcgctccacgggggggtgggcttccccacatatccaccccctgtttccggttggcccaaagaaaaaccggcgggaaaaaagggctccccagtgggggggggagaaaggggagggaaaggccccccccaaaaaagggcccccccaggccccccc

SEQ ID NO: 26275 - protein, 173 aa, Zea mays
  misc_feature: Ceres CLONE 1398642-F
MDSTGTGAGGKGKKGAAGRKVGGPRKKSVSRSVKAGLQFPVGRIGRYLKKGRYAQRVGTGAPVYLAAVLKYFAAEGPGASLVMPATGQQKKLRINSAATGLSGESGNGQGSLGKAAWGGSDPFAPRGGGLPHISTPCFRLAQRKTGGKKGLPSGGGRKGRERPPPKKGPPRPP

SEQ ID NO: 26276 - DNA, 730 bp, Zea mays
  misc_feature: Ceres CLONE 1398646-F
  misc_feature (495)..(495): n is a, c, t, g, unknown, or other
  misc_feature (536)..(536): n is a, c, t, g, unknown, or other
  misc_feature (628)..(628): n is a, c, t, g, unknown, or other
  misc_feature (693)..(693): n is a, c, t, g, unknown, or other
  misc_feature (694)..(694): n is a, c, t, g, unknown, or other
  misc_feature (714)..(714): n is a, c, t, g, unknown, or other
ggagctccccgcggtggcggccgctctagaactagtggatcccccgggctgcaggaattcgcacgagaccattacctagaacatcctaatcgaaaactctcgtccggtatcaggctccttcggcattcgcccgttctacgccagagcccagaggaggcagcaagtcgttctcgcatctcgcgcgcctcgtgaacgaatccctaaccccacaattaaaagcaagcaacccccgctcccccacctgcgctaattaatcacatcacgagatccccttgcccacctccttcgcctcagtcacacgcctcgatctcgcctcgccgcgctcccaccaccgcaccatcccggccgcctcgctcgcgacgcaccaaggtgccctcgtatcccgcggcgccggattgagttccctccggcgatcacgcggtgagcctcgccgctcgagccacaggataatatgttcaatctgttttcctaggtacattgtaaacgtagagtggncttgaaggatgatagttgaagcaaaatgattctctatttcnacatattttggagatggatgatctggcaggagattgaaggaagattccagacacacccttcagaacggatttggccctcccattgggagcangaagtcccggtccctgcccctgacttaacaggaaaggaatttggattctgatatcttccctgcgnntagttgagaaggtgggatgnccattcatttgcagcg

SEQ ID NO: 26277 - DNA, 748 bp, Zea mays
  misc_feature: Ceres CLONE 1398647-F
  misc_feature: Encodes the peptide sequence at SEQ ID NO. 26278
  misc_feature (508)..(508): n is a, c, t, g, unknown, or other
  misc_feature (513)..(513): n is a, c, t, g, unknown, or other
  misc_feature (537)..(537): n is a, c, t, g, unknown, or other
  misc_feature (538)..(538): n is a, c, t, g, unknown, or other
  misc_feature (627)..(627): n is a, c, t, g, unknown, or other
  misc_feature (650)..(650): n is a, c, t, g, unknown, or other
aagctggagctccccgcggtggcggccgctctagaactagtggatcccccgggctgcaggaattcgcacgagaccattacctagaacatcctaatcaaaaaaaatctggaatcctttcacgccgccactctcccctttttccttctctcttcgtcgttgtggctcctgccttcctgcctcggcgcatcgactcgcggagagggacagcacagcgcctcctccccatcctttctccattcccagatcgaaggtccataaaaaaccatccttttgcatctgattgagcactgtctttgtgcaagagaacaatttagttgtacatacaaacaaaaagaagtgggagtatttttcagagtttattagaagagactgtttcgaggacccaggtcagagaaaggcgagaagctttagcagcggcaatggtctggtcaatggacccgcaggtgaccgtccacggcgactgggtgtcagccgtggtgccgctgatgaagctgctgtgccctggcgntgatncggctgctccctcgcaacccgcgnngtcaggtcgtgcccagggccacctttcagctcctgagcaagctcgtcttcgcgctcttcctcccctggctcatcttcgtccacctcggnaagtcgtcaccatagacacgtcntgcactggtggtcatcccccgtcacgtgtcatcagactgccatcggtggcgccttgggtactcgtggcctgatctgcgcgcgcgaacctgttcgggtt

SEQ ID NO: 26278 - protein, 100 aa, Zea mays
  misc_feature: Ceres CLONE 1398647-F
  misc_feature (30)..(30): Xaa is any aa, unknown, or other
  misc_feature (32)..(32): Xaa is any aa, unknown, or other
  misc_feature (40)..(40): Xaa is any aa, unknown, or other
  misc_feature (70)..(70): Xaa is any aa, unknown, or other
MVWSMDPQVTVHGDWVSAVVPLMKLLCPGXDXAAPSQPAXSGRAQGHLSAPEQARLRALPPLAHLRPPRXVVTIDTSCTGGHPPSRVIRLPSVAPWVLVA

SEQ ID NO: 26279 - DNA, 724 bp, Zea mays
  misc_feature: Ceres CLONE 1398648-F
  misc_feature: Translation starting site: 204
  misc_feature: Pfam Name: Pyr_redox Pfam Description: Pyridine nucleotide-disulphide oxidoreductase
  misc_feature: SWISSPROT Homolog: EC 1.6.5.4 Monodehydroascorbate reductase (NADH)
  misc_feature: SWISSPROT Homolog: EC 1.18.1.3 Ferredoxin--NAD(+) reductase
  misc_feature (312)..(312): n is a, c, t, g, unknown, or other
  misc_feature (382)..(382): n is a, c, t, g, unknown, or other
  misc_feature (392)..(392): n is a, c, t, g, unknown, or other
  misc_feature (408)..(408): n is a, c, t, g, unknown, or other
  misc_feature (419)..(419): n is a, c, t, g, unknown, or other
  misc_feature (454)..(454): n is a, c, t, g, unknown, or other
  misc_feature (494)..(494): n is a, c, t, g, unknown, or other
  misc_feature (618)..(618): n is a, c, t, g, unknown, or other
tggagctccccgcggtggcggccgctctagaactagtggatcccccgggctgcaggaattcgcacgagaccattacctagaacatcctaatcgaaaacttgtcctccgactcttccattccattctattcccgcttccacacgtcggtcggcgcccttcgcgatcgtgtcgtttcttcccgcagcctgcctgcgtgtggggtgatggctaggcacttcaagtacgtcatcctcggcggcggtgtcgcggcggggtacgcggcgagggagttcgccaagcagggcgtcaaccccggcgagctcgccatcatcntccaggaaccagtggccccttatgagcgccctgcactcagcaggggatacctcttccctcagaacgctgncagactgccnagcttccacacgtgtngtgggcagcgntggagagagactacttcctgaatggtactctgagnaaggcattgaactgatcctgagtactgagattgtgaaggncgaccttgcttcaaagactctgaccagtgcagctgcggaaaccttcacatatgagaccttgctcattgctacgggctcctcggcataaggtcactggaattttggtggtcaaggagcacatccnacacatatttgatctagggacatttgcgatgcccaaccagttggtgcactatcagggcaagaagggtgaagggttgggtttttttggggggggtaaactaggggtt

SEQ ID NO: 26280 - DNA, 657 bp, Zea mays
  misc_feature: Ceres CLONE 1398649-F
  misc_feature (220)..(220): n is a, c, t, g, unknown, or other
  misc_feature (256)..(256): n is a, c, t, g, unknown, or other
  misc_feature (380)..(380): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (416)..(416): n is a, c, t, g, unknown, or other
  misc_feature (429)..(429): n is a, c, t, g, unknown, or other
  misc_feature (444)..(444): n is a, c, t, g, unknown, or other
  misc_feature (494)..(494): n is a, c, t, g, unknown, or other
  misc_feature (495)..(495): n is a, c, t, g, unknown, or other
  misc_feature (518)..(518): n is a, c, t, g, unknown, or other
  misc_feature (530)..(530): n is a, c, t, g, unknown, or other
  misc_feature (561)..(561): n is a, c, t, g, unknown, or other
  misc_feature (568)..(568): n is a, c, t, g, unknown, or other
  misc_feature (573)..(573): n is a, c, t, g, unknown, or other
tccccgcggtggcggccgctctagaactagtggatcccccgggctgcaggaattcgcacgagaccattacctagaaatcctaatcgaaaaacaaatgaaacccctgagacagtcagacgtcccgtgctcgtcatcaccacccacatctcagttcaccccggcgtcgtcctcttcccccggcgctactctcccgctccacgttccaaaggaaagatggcgntcccccaaattttaaaaattttttttgggggggggntttttttttttttgggggggggggggggaaaaaattttttttaaaaaagggcccccccccccccccctcttttttttttgccgggggggggaaaaaaaaaaaaattgtgggtgggggggggggngnnnnnnnnccccccccccccccccccccccccccncccccaaaaaaanagaggggggagaganaaatgaaagaagagaagagagagaggaggggggggggggagggggggggnnctcccctcttttttttttctccncccccctcccanaaaaaaaaaagaaagaagggggggggggggnggtggtntgttnttttttttttttttttttggggtgtggggggggggaggagggaggggggggcccgcccccccccaccgtgtgtctttctttttg

SEQ ID NO: 26281 - DNA, 725 bp, Zea mays
  misc_feature: Ceres CLONE 1398650-F
  misc_feature: Translation starting site: 232
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (478)..(478): n is a, c, t, g, unknown, or other
  misc_feature (496)..(496): n is a, c, t, g, unknown, or other
  misc_feature (507)..(507): n is a, c, t, g, unknown, or other
  misc_feature (656)..(656): n is a, c, t, g, unknown, or other
aagctggagctccccgcggtggcggccgctctagaactagtggatcccccgggctgcaggaattcgcacgagaccattacctagaacatcctaatcgaaaaattccaaaagctctcgagacttcctcagcaatcaatcagctttccagcgatcggcagctcctcgatcgtttcgaagctccaatccgcccggccgcctccgcctgttgccactagctaggtgatcgatcgaatggactgcggtggcgcgctgcagctcccgcctgggttccgcttccaccccaccgatgacgagctggtgatgtactatctcctccgcaagtggcggcggctgccgctcgccgcgccggtcatcgccgaggtggatctctacaaagtcgacccatggcagctcccagaagaagcgnnntcggtgggagaaggagtggtacttcttctcgccgcgcgaccgcaagtacccgaatggctcccagcctaanccgggcggcgggacaggntactgggaggncaccggcgccgacgagccggtagggtcgcccgcgccccgtggccatcaagaaggggctcgtcttctaacgcgggaagccgcccagggcgtcagaacaactggatcatgcacgagaccgccctcccggacgtcaaccgctcggccggcgnaagcaaaaaaaccacacgggctcaggtggaatgactgggggttggccaaatcaaaaaaaagaaggggtt

SEQ ID NO: 26282 - DNA, 664 bp, Zea mays
  misc_feature: Ceres CLONE 1398651-F
gctctagaactagtggatcccccgggctgcaggaattcgcacgagaccattacctagaacatcctaatcgaaaagattttcttcacccgtccacctcgtcttgcgctcctctgtctcggcgacgactgtgctaccgccgccgccgccgcaagacttcgtcgggcactttgccggcgacgatttcccaccagcccaacaggatcagaggaggtgatggcgaggagtgacagctgcctggcgcgcgtgggtgccggaattgctatcggtggcgcggtcggcggagccgtcggtaaccttcgtccctaaacccctaaacactaggcttgcagcatcaatccctcccgtgcaagccgttgcacccgccggtgttttttttttttggttggaactaaattagtgtgccaattttcgggaatcctcctcaagctaagctagtagctacattccctggttttgggggggttagctaagcggcagaatgaaataactaggtgggtttttgttcagaaatttcctaggggcttaggggagcatcctcttggaggggggaaaaatatccatggcccccaggtgggaagttgggttcgccccccaaattggattggggctccaaagggctgcgtgccggattccgtcgttgcccggcgctttggccaaaccttcg

SEQ ID NO: 26283 - DNA, 696 bp, Zea mays
  misc_feature: Ceres CLONE 1398655-F
  misc_feature (360)..(360): n is a, c, t, g, unknown, or other
aaagctggagctccccgcggtggcggccgctctagaactagtggatcccccgggctgcaggaattcgcacgagaccattacctagaacatcctaatcgaaaaaaaacgactggctgtccgaacggggacgtctggttcctctcattccccttccacctcgctctctctctctctcctcccactgctcgccctctctctcttacgcgcgcgtgacaacctccctccctccactgcgcgcggcgcgggagcagcagcggcagcacccaccgactgatcgccggtgggcggggcggcggcgatctgatgcgggcgcggcggtgatggcagcgccatccggcggtggaggcgacgctgcgtcgnacgactacctcctggggcgccgcagttgtcacgatcagctccagcgcggcgtcccccctctgcaggccgggtgtcaccagggaatggtaacaagcgatggaattgtccaccataccaaaaccggtttggagcacccgacctgcactttttccccgagcaccgcccatggcacaccttggaatgaattggcaaattgattggcccagcaacaacaaacgccgctttccctgcggctaaaaaaacgagaggaaacaaccccccatgcgagcgcgcaacgtgggagcggaaacaaaaccgaacatcgagcacatgacatttccagaaccctcaccgatc

SEQ ID NO: 26284 - DNA, 648 bp, Zea mays
  misc_feature: Ceres CLONE 1398656-F
  misc_feature: Encodes the peptide sequence at SEQ ID NO. 26285
  misc_feature (311)..(311): n is a, c, t, g, unknown, or other
  misc_feature (446)..(446): n is a, c, t, g, unknown, or other
ccccgcggtggcggccgctctagaactagtggatcccccgggctgcaggaattcgcacgagaccattacctagaacatcctaatcgaaaaaagccccccattcccattctaccaccgtacccgtgcccgtcccactgcctgccagcgtctcccccgctccctctcctcgagagatctcgcgctccggcgatcgggcgcggcgggcggagggtcgcgaagtgccctgcccacccccgatgctcttcccgaagcgcatcaactacgtggccccgatgctcgcctccgccgccatcctgctcctcctcctctcnggctacttcgagctccccctcatctgcacccgcggcgcgattcctcgcggggagcagagggcttccccaccgcgctcgactcgcgtcggatcgcgcgaacgggaccccttcacctcggtcctcgagggcttcggntcctggagaaccccccccgtagggtgccccccgcgttgggtcaagttctccccccggggggttgggaattgggcccgggcctggcctttccaaaggcgaaccccccgcccacggtaaagggcccccgggagaaccgggtgggggtcccctaagggggggggcacagggggggggatccaaaagggggggaaccctcccccgc
